United States Patent 11,492,637 (RESISTANCE GENES ASSOCIATED WITH DISEASE RESISTANCE IN SOYBEANS) - sequence listing, part 3

SEQ ID NO: 22 - DNA, 3122 bp, Glycine tomentella
taaatttcttttggattatgtttatattcgagtacatgctattgctaattgttaaacagagttatttatatgccttagccttggctgtaaacatcttcgttttcacttaatgtttgatttagcaaaatagaaacaaatattctttagataataatcgttttgcaatatcattacatgtcttggtctttttttataaaaaaaaaattactaaaagaatatcgtaagaatcaatactgtctctgactctctgtgattctgttactctatgttttagatgaaaggaattttcatgaggaatataactagttacttgtaattacttaaacactatattcaactctcgcttaattttcatttattagttagcttttcagttggtccggttctcataccttacacgaggccaatcaagttgtggatttgctagcaaattaatgaaattatgtcaatactatggagggtcacatgttaatattttagcctatgctatttccatgatctttcctggtggcttttagtgttttttccttggggttttagccccctttcattcaaaaaaaaaggttaactttttcagttgataatggcaatagaccctgggtaaaattcgttattaactgactgataaattaaaatataaaaagatgtatttttatacagatcaatttattgaaaaacaaaattataatttttatttaaacacattaaataataaaataaattcatcttttttaaatatatttattttaatcatatagttcacgtatataatcaaatgtatttgatgaagtctctttagtttgactggtaaacaaaatcttcattttgaatcttgtaaagatgtgattagttaaaatttttttatgaagattagttataaataaaattaatagatatttcgtattaataatatgataaaaattatatttaattaaaatgtaaaagtaattgtatacatattttttaatttaatataatcaatactatttgcctttaaaaaatcatcaataggcaatagcatttatctttactttttttcctatattagtattataaggatggtatcgagccgacaccacacaccgaagtgataaacgcgttgacttgaatccattgtgaaacaaacagagcaagcgataatcaaacacttgatcgatcattttgcaaaatgaggatgaagaagatctgtcggctacggttgctcgcactcgcagaggcacacagtcatagtcataaatctttctcaactattgcttctgattcctcactcatccttgaaatggatctcaattctgaccactcttaagtcttatgtagtttgattctgtatatcactttcaactaattaaggaataattaatttattgtcttctatttttgttttcatctttctctaaaatacaacaatttccaaatatataacttataacataaaagttttatgattgttgtctttttattttgtcttgctaatttccaaaaatgattttattttactccttcctaattaataaaactcgtattttcaacaaattatatttgtatatttaattttttctcttttaattttttttataaaatatggtatacctaataatactaaataatccgtatctatctaaatctattacatttttaattatacacattctgactaacatatatatggaataattagtttattagataattttactaaatatttcgtattcaatagctttgaaactatatctgacaaaaataattctaagttaacgcaatacttaaaagtgattttttaaactaaaacttgaaagtaattaaggtagaacaaacttataaattaaataagttcttaattatttgaaatgacttatcaaacagatatattatatttggtaaaaaaaaatggcttaaagatgacaaattatttgaaatcaaagttgttaaagtagatcatttaattagaaacgttagataaaagtatttattgaattaactaataataaatgtaaaatgatatgaagaatatatttataaatattctttttaattttgtagtcaaaagtatattttttaaaaatgtagatgttatagattaaacagacctagaataatcaaatgtatcttaatcagtagtatttattttggttggtgcctgtcctccactagtattgaacaaggacaccagagactcaatttggagctgctcatgcgttgacttacccatcattttgcaaaatctgtgcacaagagctgctggcagaggtagatatgcatgaatctttcttagctgttgcttctgattcctcactcacccttgagatggatctcaattcttaacagttagcagcagaggtacacatgaatctttcttacttaactcttgctcctgattccccctcacatacattccaatcattttgtatatcagtttcaatagggacggattgagaaacaagaaaaagaaaatattgttaataaaaaatgaataaaaaaatcgagtattgagttcatgtttgtctgatttttttttctagaagtagattttatttctagttttacgcataaaattaataataaatacttctgtgaaacttttttatttattacataattatttattagaattaaataattaaataattgtgtaagaaaaaaaaatcgtcccccccccccccccccccgatccctatgcattcctggatccgtccgagtttcaataagttactacttttaaatggtgctacttctagtctcaaggtttatatatacctatacacccacacatatacaattctttttgtgttttgtgtttcgtaatcattgctttagaatttaagattttattgtaattgcctatatttaaaatgtttttactgtcaaacagaaaagataaataatgatcaagtgtgttactaaaaggttgaatcattagtttttacatactgaagttttggctttgggtgttacatacatattcatattgaataaagcgcctatgtttgtgtatgcttcaaaattcttcaaaattctataccgctgatgtctagaatttctatacgttgatttggtgtattatatgaatataaccttttattttattttcttatttaacgtattgtaggctttgaagtttcata

SEQ ID NO: 23 - DNA, 1000 bp, Glycine tomentella
ttatatatcctctaaagatctgcttcgcagttgacaggctaggtgggtctctatgagacaaatgcgaaaaaaaaaaaaaaaacttacaagatactaaagtaactttcataactctacaaatgggatgtttgactaatggatgtttgactaatctaagatgcctttgaatcccgtttattttttcatttttttgtatatgaacgtttttaatataaaataaacaaatttaaatatatacaagataaataaataaataataatttaaatatatatatatataattacaaaatgtttacctactttaaaattatgctaatttaaatatataacatagttaaattcaattttttttttatatatacagaatatttcttgtggacatttagttccaatatttatagcatatactcataaataatgttaggagtgattctaccaaaataaaattgtaagtgattcacatttaggtaattaatatgaagtaagaaacaaaaaacatcatcaaacatttatttttcattttttggctatggacgttttaatataaaaataaataaattaaaatatatgaaacataacttaaaaaatatatagaattacaaatgtttacctaccttgaaatatgctactttaattatataataataaaattaaattcagttttttatatataaaaaatgagaagaaaaaatattacacgaatttattttcttcaaaaatattttatttcattagacttataagttattaacaaaagaaaaatatactatagaatatttctcgtgaacataacatttatatcatataatcataataaattaataatattgtgcgtgattctacgtacgtaccaaaatttgtgagtgattcacattcagataattataataattaatatgaaacaagaaaaaaattatcaaacatttattttattttttctccatggacattttaatataaaaataaaaatatatacaacataaacaaataataacttaaa

SEQ ID NO: 24 - DNA, 2979 bp, Glycine tomentella; identical to SEQ ID NO: 21

SEQ ID NO: 25 - DNA, 1958 bp, Glycine max; identical to SEQ ID NO: 16

SEQ ID NO: 26 - DNA, 354 bp, Arabidopsis thaliana; identical to SEQ ID NO: 17

SEQ ID NO: 27 - DNA, 2976 bp, Glycine tomentella; identical to SEQ ID NO: 15

SEQ ID NO: 28 - DNA, 1949 bp, Glycine max
gtgattgcggttacatcatgtacggaaaaataattctaatccttgatttaaatttgatcttgactatttatttattctttatttcattttgtaaatcattttatgtatcccctggcaaggcaattttatccaccttgcacccaacacttcgggttcccataaatcaaaccaccttaacttcacacaatgctgtaactcacaccgcccagcatctccaatgtgaaagaagctaaaatttaataaacaatcatacgaagcagtgacaaaataccagatggtattaatgctttgataaaattaattggaaagtataaaatggtaggaaataattaattataattaatttaaataagattaaaaataatttaaaactaaaatgttaaaattttaagaaaattattttaaataatatttaaaaacatttaaaatcattttaaaaaatttatttataggacaattaaatgaatatttcagctaattaaaaacaaaagcttacctagccttagaagacaacttgtccaacaattagatgatacccattgcccttacgttttctttaacatcaattattgtttttgtcaacaagctatcttttagttttattttattggtaaaaaatattgtcgccttcaagttgcatcatttaacacatctcgtcattagaaaaataaaactcttccctaaacgattagtagaaaaaatcattcgataataaataagcaagcaaaattaggaaaaaataacttcattttaaaaaaatcattaaggctatattttttaaatgactaattttatatagactgtaactaaaagtatacaatttattatgctatgtatcttaaagaattacttataaaaatctacggaagaatatcttacaaagtgaaaaacaaatgagaaagaatttagtgggatgattatgattttatttgaaaattgaaaaaataattattaaagactttagtggagtaagaaagctttcctattagtcttttcttatccataaaaaaaaaaaaaaaaatctagcgtgacagcttttccatagattttaataatgtaaaatactggtagcagccgaccgttcaggtaatggacactgtggtcctaacttgcaacgggtgcgggcccaatttaataacgccgtggtaacggataaagccaagcgtgaaggggtgaaggtacatctctgactccgtcaagattacgaaaccgtcaactacgaaggactccccgaaatatcatctgtgtcataaacaccaagtcacaccatacatgggcacgcgtcacaatatgattggagaacggttccaccgcatatgctataaattgcccccacacccctcgaccctaatcgcacttgaattgcaatcaaattagttcattctctttgcgcagttccctacctccccctttcaaggtccgtagattcctcctgtttttttttcttcttctttattgtttgttctacatcagcatgatgttgatttgattgtgttttctatcgtttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacag

SEQ ID NO: 29 - DNA, 354 bp, Arabidopsis thaliana; identical to SEQ ID NO: 17

SEQ ID NO: 30 - DNA, 13473 bp, Glycine tomentella
atggcttctatctccagcgtccagagcagctcttctgcgtatgacgtgtttctcagcttccacggtgatgacacacgcaacaactacaccaacttcacaggttttctttttcaagctctcagaagaaaaggcatcgtcgccttcaaaggtcatacacttctcgaaaagggtgaacccgagctgttacatgcaattcaaggctcccgccttttcattgtggtcctttcaaagaactatgcttcctcaacttggtgtttgcgtgaactagcacacatcttcaattgcattgaaacttcgccaagacgtcttctgcctattttttatgatgttgatccatcagatgtgcgaaaacagactggatggtacgagaaagccttttcgaaacacgaagaaagattcttggtagataaagagaggattgaggaaatgctgacatggagaaaagctctgactcgagtggccaatctctctggttggtatatcccaattaagtaagtaacccgctctcatctcatgaaagatgtaacttgcaaattgggtccaaatttattataaatgtttgacgtttgatgcaaatggtatttaaacgttgaaaactactcttctattatcttctcctgttttgcttctcttgggtgatgatttcgcattcttcattttctttaaaatttcaggccacaatatacagagattgaagaatttgttcaatatataataactctattgggtcctaaattttcaactcttcaaaatgaagcagagggaacatcttcagataaagatgaagttttatacaatgatgagctgtcagatttgatgaggataagagattttatcagcctcgtgttgacttatcccgtgaaattagaagatgaatatattttaagatcttggattagtgcatttcctgaatggaaagctcagttattgtccactggtgatgatactgtgatggacaaaccatggtgtgtactaactgagaaggcactgggatctatgaagggatttatgccaatggaaataataagtaaagtagaaagtggtgagagatccatcatcagccataatgatgttgatgcaataccagaagccattctccaacaatctgttgatctcgcagttaaccaactacttcaaactttgttttctggggattactgtgcacgctatatcagactgttaaccagaaacttggctgaaaaaggatctgtagtggacacaatagcttcagccgttgaagataagcacaccatgtttggaattgacaaagattttcttagagccctatggatcaatgcctcaacatatgagactgatgcagaggttcgagttcaggaagaaatcgatgtcaatatgatgatggaagttgatgacatgggaagcaatgggcagttggtaattgtagtggatgcagatagcaacaacaagctggacctccaaaagttgcgttttccaactggaattgtggtgttgataacaactgagccgtcaacacaagcagagaaggatgttgactttagaattgcatgcacaatggatttgaatatttggacccaggatcatctattgccttggaaagtcttctgcagctatgtggcagttgtatcagcagtagcatggtacgttcatcaatggccattcagaaaattgcagtggaaatagttaaggaatgccacggtcatcttcttgccattgtccttgtggcaaagtatcttacgtatgtgcaagattttaaacagtgggaacttgcacttgacaaattaagcagtctgaatccttcctatgattatcaagatagtgatcgaattggcattagtagagtcatggtcaatgcattcgtaaatattatttgggaagacattggtgatgcacaaaagctttgccttgaactcagtttgcctgttcacaacattaaaaatggcgtgagagatgatatcttggtgtctgattgggctaagacaatattaggatacacacaagaacttggtgaatacagaaggcaattacaacattacatcaatgagcttcaagaccgttttgtcttgttgaaatatgaaagtggagatgtctatttgccagtagaaacctatgatataatacaatcattgcacacctcaaagccttccatcctaaggcatggtgcattaggattgacagagccaccctacattggacgatggcatagtcttattcagatagaattgatggacaataaaatatgtgaattaccacaatcaccagattgccctaaactcaaagtgttgttgttgcagggcaatgttgatttgatggatatccctgactcatttttcaaccacatgcccctacttcaacacttggacttatcctacactagtataagggatttacccccttctgtctctaaattaatacaacttcagaaattttatcttagaggctgtgatctcttcatggaactaccacatcagattggacagctaaagaatctcaaagagcttgatcttgatgggactttgatcacccatctgccaatagagatccgagaattgatcaaccttcaaagcttaagcctctgctttgatggaacttccaagtcaacaattattcctccaggattgatatcaaatcttactcaattgaagtatttaagcatcaacgttgaccctgaagatgagcgatggaatgtgaatgttattagtgtcttggcggaaatttgttatggattatgtaatttgcagaggttgagtatatatgtcccagaggctgacttcttgaaagtcataccagcccaaaaatctctcagtttcagattggttgttggtcaacatatgcgacgtttgatatcgcgtgtaccacctgaactggagacaaaatttaaacactgtgactatagcataaagtttgttaatggtgtgaatgttccaaatggagtgaaaatgcatcttgggcgctccaaagccttgtacctagaccgacatatgaccatcaagagtctctctgatttcgatttgaggaatttatgggagttggaagtatgcatattggcagagtgtaatgaaatggaaacaattgtcagtggaagcaattcacctgataggccagcttctctaatgttgaagtttttgagtgtattctatatgaagaatttaagaagcgtctgcgaagggagtagtcccttctttctctgcttaaagtctatagcattacacacttgccccatgttaactaccatattcaccttagattctgttaaaaacctttcctttctggaggagattattgttgaagactgtccaaaagtaaccaccctgataagtcatgccacaccagaacaatatccagtgtttttcctccccaagttgagaatgatatcgcttctctatcttcctgaattggtcaacatttttaatggcatgcatgttggaccttttatagaagaaatgatattttattattgcccaaaactccaaagtctttccaaatcagagttgtcaagcaaatctttgaagatcatcaaaggagaaagcatctggtgggaagaattgaaatggaatgtagcagagtggggagatgctggtcgacccaattattttgagcgaattttttcaccaattaacgaggaggctgacatgatgaaccagctagctgcacttcaagagactcaactaaatgaatatcacaatacgacgtatcaggtaatttttagttatcctcttttcaaatttcatggtgttattggcatgttggtattttcaaatttttgctaatttttgtataactcgttatgttctttttctattaatttcactatcatctttcatttcttttacttcattactattactatgctttttttgttctcagattgatagtgactctgagcataaaatgtgactatttatcatgaatttctttaattttggattttttttctttcttgattttaatatatatgtagtataaactatttagcttgcattataatattttaaaaaatgcccatcctgcttcctgctatagtgttttaagctatgtacttctatgtgagattaataactatgattagttttcatgtgtaggatatcttcctatttttgtatatctctttcttaatgaacatatttttatgtcaaacaaaattaacttcacaacaattcttcttggtgctttaaaaattgtggcaaattttttttcctgcactttatgatcatacttaattatgtttggagatttaaataaacaagtctattcatatttatctccctactcatcaaactccaaccatgggtcatactgagctagtgttataattataataattttgtatctctgtatgaattgcttttgctaatatgatcataccctcttagcttcatttttcgtactgtattacttgaatgttttcctttcagggaatttcaagttctacacattcgatagcaaagtcatctttggaaatacctgttttgtcacctttagccccagtttcatctgtgggtaggtttagttcaaacagtgaagcccaaaagcggaaagtcgttactgaaccaaaaatattacaagatgcatcaaaaaaggtaataaagcaggtttgagatgccttgtcacctttcgtgattgattgcttttggttttcttatatgcacgagttggtttacttacattagaggcatgtttgataaacctgtaaaattatacgtcgaatgtgttttgcttgaaaagattataattttaattgctgaaaaactcatttaattaagaaaacttaaaacatttagatgctaaacacggtgacaccaaaggaaattattgtcatttaattattcagataggatgtagttgctgctttattcattcagtatcagcaatgtgctgaatgtattcaacatatttcacgtaaagaattattttcagttttcatatgactagttgccaatagcaacaaatagtggtgctagcgcagaattgcattgcagagcggctagagcatgctatgaaaattgaaaagtgtatcagtttgaagtagcgaccatcacagctgccgtatctagcaaaattgctgaaattgctcctggagcaggctttattggagtgggtcacaaaaaaacctattttaatttaaccattaaacaactttatttagggtgttttagtgggcaatgattttgccctcttctttgaatcacaactgaaactctgctttctcaatcacttgcacacactgtgatgacattgttatccttttcccaccaatacacactcttttctggcaacatttttggcatttccctgcattttcgggccttctgtgagttttttgccatccccaacctctgcagcctctattctccatagtttccggtctttcctgacctttatggccattttctggagaacctgtcactgtttctggccaaccgcgacctttgctgccgtgctctgttcactgttctgtccttggattgttcatctctctaatacagatccttcatctctctgttttgtgctctcttctataatttactttaacatttaatttaatatttgtcaaatttttatttttatttttatcaattacgaaatcattgatcaaagttttataagaaagtataaagtatttctagcattttattgtcaatatataaaatgacaaagtcattcaaattatttcgtaacatagttaatatcaaataagattttagtatgtaacataaaaaagatttgagtaattttagttttaaaaactactttcaataataataagaattaccagttttatgttgttcattttactgaacttccttgtctatgatccttaggtgagaagtacaatctataatcacaataatggaaaatgaatcatattcaccatactagaaataatgcgcaactgagaaaaagatagaagaatgaacactccaattcaccatattcctaacatgatcatgattggaatgagttgaactcaaaagcagcgagtgagcacttcaaagcattagcatatgacagatatgattggaaatatatgctgtctgacatgatgataagttttttaaattcacttaacacgtgaagtatcactattttatacgtactgacactgactgacacaccaaatgtggagaaatattgaagggttttttttggttagttaaaagcaagtcctaaatcatgcaaaattatcatttaatgaaaaaatatatgtaggaagatatcattgcatcgttccttaaaaatggagcaagaggatggccaacccttaaatccctgtccagtttcccagcaagtgcttgcagcagtgtagtttttcctgatcttggaggccccaaaagcaaggtcaatctgaacagtgtttttgaaagataaatagatagggaaaggaaaaaacaaaagttagcaacatacctaaaataatacattaatgcatttttgaaaaatataactcgttatgttctttttctattaattttactatcatccttcatttcttttacttcattactattactatgctttttttgttctcagattgatagtgactctgtgcataaaatgtgactatttatcatgaatttctttaattttggattttttctttcttgattttaatatatatgtagtataaactatttagcttgcattataatattttaaaaaatgaccatcctgcttcctgctatagtgttttaagctatgtacttctatgtgagattaataactatgattagttttcatgtgtaggatatcttcctatttttgtatatctttttcttaatgaacatatttttatgtcaaaacaaaattaacttcacaacaattcttcttggtgctttaaaaattgtgacaaatcttttttcctgcactttatgatcatacttaattatgtttggagatttaaataaacaagtctgttcatatttatctccctactcatcaaactccaaccatgggtcatactgagctagtgttataattataataattttgtatctctatatgaattgcttttgctaatatgatcataccctcttagcttcatttttcgtactgtattacttgaatgttttcctttcagggaatttcaagttctacacagtcgatagcaaagtcatctttggaaatacctgttttgtcacctttagccccagtttcatctgtgggtaggggtagttcaaacagtgaagcccaaaagcggaaagtcgttactgagccaaaaatattacaagatgcatcaaaaaaggtaatagagcaggtttgagatgccttgtcaccgttcgtgattgattgcttttggttttcttatatgcacgagttggtttacttacattagaggcatgtttgataaacctgtaaaattatacgtcgaatgtgttttgcttgaaaagattataattttaagtgctgaaaaactcatttaattaagaaaacttaaaacatttagatgctaaacacggtgacaccaaaggaaattattgtcatttaattattcagataggatgtagttgctgctttattcattcagtatcagcaatgtgctgaatgtattcaacatatttcacgtaaagaattattttcagttttcatatgactagttgccaatagcaacaaatagtggtgctagcgcagaattgcattgcagagcggctagagcatgctatgaaaattgaaaagtgtatcagtttgaagtagcgaccatcacagctgccatatctagcaaaatagctgaaattgctcctggagcaggctttattggagtggatcacaaaaaaacctattttaatttaaccattaaatttagggtgttttagtgggcaatgattttgcccccttctttgaatcacaactgaaactctgctttctcaatcacttgtacacactgttatgacattgttatccttttcccaccaatacacaccttttctggcaacatttttggcatttccctgcattttcgggccttctgtgagttttttgccatccccaacctctgcagcctctattctccatagtttccggtcattcctgacctttatggccattttctggcgaacctgtcactgtttctggccaaccgcgacctttgctgccgtgctctgtttactgttctgtccttggattgttcatctctctaatacagatccttcatctctctgttttgtgctctcttctataattttctttaacatttaatttaatatttgtcaaatttttatttattttttatcaattacgaaatcattgatcaaagttttataagtaagtataaagtatttctagcattttattgtcaatatataaaatgacaaagtcattcaaattatttcgtaacatagttaatatcaaataagattttagtatgtaacataaaaagatttgagtaattttagttttaaaaactactttcaataataataagaattactagtttattaataatattagaaataatgcatgtatttgaaagaaaaatacaatatttttagtgaaatatgaatttctttttctatacttcttgcaatatctttattttaaaaataaatcaagattttcaatattataatttgcttactcttctgtatttttctttaatatttgtcatactttattttatttttttatcaattacgaaattattgatcaaagttttatagaaagtgtaaagtatttctagcattttattgtcaatatataaaatgacaaaatcattcaaattatttcaatatcaaataagattttagtatatcaaataagatttttagtatgttaaaaaagatttgagtatttttagtttaaaaaactacttttaataataataataatatttacaagtattattaataatattagaaacaatgcatgtatttgaaagaaaaatacaattttttaaataaataatgtttttagtgaaatatgaattttttttgtctatccttgttgcaataaataaatcaagattttcaatattataattcttagtagaacttaaaagtattttcaatccatatcttcatctaaagttttcaattgttcaattaatacaatcttaaaattacagtcttaataataaaaatagtaatatatgtcattataaaatttatcacctaataattcaaattaataataaatatttttcaaaaagtataaattttttaaggctaaacgtaactacttaactggccatggccttttggttgccacagccctagttagaagtgaatcttagaggggtctgaaagtgctaacagacggattctctccatttttagtggaatttgcttactctttatcagcaacttaagttattcattgctgtcacgaaaaaaagaaaagaaaaggaaaacatcactttggaaatgtctcattccaatgaagctatgatgcatggtcatataagtagggagttatacgcctgcaacttgaaattgtttgttctctaattttactatgcatcaattataccacaaaagattcagaaggtagatattctctatattgcaaatcgatctttagcttcaacacaatgtaagctacttccccaactgaaaaatgatgatgatggttttattcatgaatcgagatcaaatactgttgctgagttccaatgtgaagatgtgtccgtaggcggtgtctctatagtctttagttaaacaaaaataaatttcacgaacctaacatgttgaataaaagactattgtggtttttatattttggcatggcaattaacaggttcgtaaactaagaacagttcaaactgaagtttggagagaaaagataagtgtcaatgcggaaggttgttttgatgatggacgtagctggagaaaatatgggcaaaagatatccttggagctaagtttccaaggttagttaaaagctatttttcatttaactttttcttgttataaattaatcaagtttaattagcaaattttttcgtagtataagttcatataaatggcatttgatttgaatgggacagaaaggttcacccctctaggttattgacatacaaggttcacccctctcgtttagttaataccagaggccttaggcctggtaactggaaaatcagtaaccaattagctaatgaatggggaaaataaaatatgcatgtataatgagttctctttccttgttttaatggttctatgcccccagtttttcaaaatgacctgcaatttgaaaaattatctaaaggaccatgtcagctggtttcaaatgggcccaaattagtgcttctgttggaaacttgttattgacattctcgacaaaaacttgttcatttgacaactacctttacaaaatttaaaaccgagaacaaccacaaactccagataacatctcattctttatttttggacatagactatagtataacattcacagcaactaaaagagaatgtaggtttcttctccaacttccttatcaaggcttaaaacaagagggatttctattaatatttttatttgatgttcgtaccatactaactttgccagtctaatgtttatattaagaacataaaaaagttgttttctagttttgccgaaaaattgacaactagtggtttgcattgcagagaatattacaaatgcacatatagaatgacaaggtgccgagcaacaaaacaagttcaaaggttagacgacccaacaacatttgagataacctaccgaggaagacatacatgcaccaaagaacagaatttgatcattgagattgggatgaggcaagtttgaataaaaaaacttgtcttgcaaatttgcattactaaaataaaaataatatttaaaatatattgttgatgttgaaccctagccgggaatcgaatccggagcccaatccagagccgaaccacccaaaatataatatttaaaaaaaatgaccatcgtgcttgcattatatattattattttaaaatatattatattattttaaaaaaataatatttatcatgaatttctttaattttggatttttttctttcttatttttaatatatatgtagtataaactatttagcttgcattataatatttaaaaaatgaccatcgtgcttcctgctatagtgtttaaagctatgtacttctatgtgagattaataactatgataagttttcatgtgtaggatatcttcctatttttgtatatctctttcttaatgacatctttttatgtcaaaacaaaattaacttcacaacaattcttcttggtgctttaaaaattgtggcaattttttttcctgcactttatgatcatacttaattttggagatttaaataaacaagtctgttcatatttatctccctactcatcaaactccaaccatgggtcatatgagctagtgttataattatataattttgtatctctgtatgaattgcttttgctatatgatcataccctcttagcttcatttttcgtatgtattacttgaatgttttcctttcagggaatttcaagttctacacatgatcatctttgaaatactgttgtcacctttagcccagttcatctgtggtagtagttcaaacagtgaaacatgaagccaaagcgaaagtcgttactagccaaaaatattacaaatgcatcaaaaagtaatagacaggttgagatgctttcacgttcgtgattgattgcttttgttttcttatatcacagttttacttacattagagcatgtttgataaacctgtaaattatacgtcgaatgtgtttgctgaaaagatataataagtgctgaaaaactcattaattaaaaacttaaaacatttagatgctaaacacggtacacaaagaaattatttcatttaatattcaataggaatttcaagttctacagaataccttagtctacttttattgtatattaaaaaatatcttaagagatattttttgaaatcttatataacttctaatggattgcacgtgaatttcacttttaaatatttaaatatatttttagtttttttttccattttttccttcactattcacttttttctctcctccctctctcctcttttcacttcttcaacttccaaaactatcttttcttcttttttcctcctccctctctcctctgttattccactttttcttcttcctcttcttccttctttgttgcggctccaccttctccttctcctccgcgtgcgcaacccccacctcccttttcctccacacacgcgagcccccttcacctgatatgtttttttttccaatgcgttgtttgtttttcttcttcttcatttatatttgttgtgtttttacttcattccaacgaatctgttacctctgcgttttattgttaatgttgttgatgaataattttttatttggaatctgtgcagatatacacattttttcctgaagaactggattttcaacatggagatcaagatctccatgttctcgattttgaagatgttatatttttttgatagttttttattgctgaatttgggaaatgttagatcttcagcttaagatctatctccaagcttgatctccatttctcgattttgagattttatattttttgatagttttttattgctgaatttggaaatgttagatcttaatctatctccaagatctaatattaaagatattttaagcgttaatgtgaagggtgtttagatgatggatataattggataaaatatgggcaaaagagattcttggagctaagttttcaaggttagttaaaacctctattctcatttaactttttattgttataaattaaacaagtttaattagcaatttttttcgtagtataagtttatataattgcatttgattagaatgtgacagaaaggttcaccccctctaggttattgacgtacaagtttcacccctctcgtttagttaataccagaggccttaggcctggtaactggaaaatcagtagccaattagctaatgagcgtaatggggaaaataaaatatgcatgtacaatgagttctctttccttgttttaatggttctatgcccccagtgttttcaaaatgacttgcaatttgaaaaattaactaaaggaccatgtcagctggtttcaaatgggcccaaattagtgctttctgttggaaacttgttattgacattctcgacaaaaacttgttcatttgacaactacctttacgaaaatttaaaaccgagaacaaccacaaactccagataacatctcattcttttttttggacataactatactataacattcacagcaactaaaaagagaatgtaggtttcttctccaacttccttatcaaggcttaaaacaagaggggtttctattaatatttttatttgatgttcgtaccatactaagttgccagcctaatctttatattaagaacataaaaagaagttattttctagttttgccgaaaaattgacaaaactagtcgtttgcattgcagaggatattacaaatgcgcatatggatctgtacaagggtgcctagcaaaaaaacaagttcaaaggttag

SEQ ID NO: 31 - DNA, 3609 bp, Glycine tomentella
gagaccagtgtgagtatttgggatttaatgtttgtcctgcctcttcttcttgtcaaacaatttgcatgcgggcgtgcatgttttctaactcatcaaatcatgtaatatgagagtgagagtgagatcaagcttgagaattaatgaaagaaagcatgatgaggtgtgaacgagtttagaaggataatcgaagataggaaagaaggctaaataaggataaatccactatggccatcataccaaaaagaaggtgtcaaaataacactactacaaaagcagtcttctacgacatcagttttacgacggtttcacaaaacctgatgtcgtagaagacgtggtggcatttttgtaagtaattgcaaatttttaaagataggtcaataaaaatcgtctttgaaaactcattacgacattggtttatttaaaaaccaatgtagattaagagaatacaaagttgcttttacgaaatcgtctttgaatcagttgttcctccttctcgtgattcttgaacattctcttcttattcccaactccacgggcgcgattccatattctcaccactcacgtccttcttcttcttctcttcttcctccattagggttttctcacattgctggatgtggcttcgctctcacattaacccttgaaaccacaatattcgtcctgctcgatcatatcaagatctataaatagaaaatatagggaaaatatttaaataaacaaaaaaatatttttttttcatggattccattttcaatcgatttgtcaatgcaaatagattactcgtaatctgtgtcgatctcacgaaagtgcatatcgatatcgatatcaatcaatatatacaaaaatccacctctttcatttacaacaaaatggttcgaatccgaaatagaaaaatagaaaaaagaaaagggtttgaaagaaatcgtaaaaatatgtatattgtacaccccttttcctgcttcgctagaccctataacttcctcttctctctcacactccgtctttgaatgtgttgtataaccgatgtagaaagcctataaattatagtagtataatgcatacaatatataatctcatgtactcaagtttgtaatcaatgtgatcataaaacaaataatatttattattataaggaggtgatcaaataagaacgaagagatagaaagaaaagaaaatacctatgatgtataagattaatatttggtttgaatgaaaaaaaaaagatagcaaaatatagataattaacgagaaaaaatagaaagaaggtgtggggggggggggagttaatttttaaacaacaaaaaatcaaatttcttttgacttttcttcatattcaaattttaagttttcttttcttctgtctttctctcattacaaaaacaaattttttgaaggatagaaggagtcaaatacaaaaaaataaaatgaacttaaagaaacaattattaaattttaagagataaatattaagcaaattgttaatatttttttaaaatattaagcaaacacatataaaaaaaaagttagccttttcagttgataattgataatgacaatagatccttggtgaaattcgttattaattgactgataaatcaaaatataaaaagatgtatttgtatacagatcaatttagtgaaaaataaaattataacttttatttaaacacattataaacaaaagatcaattttatttaaacacattaaataataaaataaattcagatttttaaatatatttatgttaatcatatatttcatatatataatgaaacatatttgattaagtctccttgatctaagttataaataagatatatatagattagttatcaacaaaattaatagatattttatattaataagatgataaaaaatcatatttgattgaaaagtaaaagtaattgtacatatattttttaatttaatcataatcaatactattagccttaaaaaaataatcaatagcattatatttaccttttgtcctatattggtatcgagacgaaaccacacattcaagtgataaaagcgttgacttgagtccattgtgaaacaaacagagcaagcaataatcaaacacttgatcgatcattttgcaaaatcagggtgaagaagatctgtcggctacggctgctcgcactcgcagaggtacaaagtcattatcataaatctttcttagctgttgcttctgattcctcactcaccacttgagatggatctcaattcttaacagttagcagcagaggtacacatgaatctttcttacttaactcttgctcctgattccccctcacatacattccaatcattttgtatatcagtttcaatagggacggattcagaaacaagaaaaagaaaatattgttaataaaaaatgaataaaaaaatagagtattgagttaatgtttgtttaattttagtagtagatttgatctttttacacataaaattaataataaatatttttgtgaaacttttttatttattaaattattatttatttgaaataaataattaaataattgtgtaaaaaaaaaaatcgctatgcattcctggatccgtccgagtttcaataagttactacttttaaatggtgctacttctagtctcaaggtttatatatactatatatatatgtgtatatatatatatatatttttttttttttgtgtttcttaatgattgctttagaatttaagattttattgtaattgtctatatttgaattgtttttattgtcaaacagaaaagagaactaatccgaggtgcataaataatgatcaagtgtgttactaaagggttgaatcataagtttttacatactgaagttagagtaataaaagctactagaacgcgctgtaatatgctgtagcatgatttttccgctagcctgtatgcagacgcttcacactgggaatatattattgtaagatctatattttgggggtgagtgggtgagctgtggtaagtcaaaagaaaagaaaaagaaagaaatattgtgccagaattcttttcttaagtaatgataagtatgttagaaagagatttgctttctttagttgtattgatattgatgatgttgatcatatgtaaaaattagaaggctttcgttatataattgatcatttaattattattaaaagttaaattaaattatctaattaataaaaatgttataatcatattatttttacgactaaaataaaaaatatatatattgaatatgaatataattatgtaaaatattttttatgtataatcttttttaaagaaattaatttcggtatcattcggattaataatttcttattaataaattatttgattgaattttttaataattaatggattcagttgaattattaactataattaaaagatgaattatataactaagcgaaattaaaatttcaaaaataagattaaaaatttaaaataaatcaaattgagagtaattgattaaaataattcccgccacaggccacagcttttcttccattggatcccattttacaactaccgcattccgtgcgctccccaactccagcaatcgagaaatacttgtcctttttcacaaacaagtttacttccactttcgcaattcca

SEQ ID NO: 32 - DNA, 2129 bp, Glycine tomentella
acgaaaacccagcaataattgagataacgtaccaaggaagacatacatgcaccaaagaacagaatttgatcattaagagcggggatgaggcaagtttgaacaaaaagactagtgatcaatcttcaagttataaatacatttcatccaaaaaatgttactggtaatccactaaacttggaacatacaaaacatcaagctagtatccaatgaatgttaattaaagattgttacaatgcatgtaatctcttgttgaatcatcgtcatcatcaaaggttgcctacataacaagacaaaaaatacctccattacaaggcaaaaaagtgggggaaattgggttaaatgattttaccatcaaaatgtagtgaaaaaaatgatttttggatgtttgaagagaggggtggggggatcaaaagtattcatgataaattaatataaaattataaaaaccagaaattattaattgacttaaaatatgttttttgtctatacaaaatgctcaaagttcatttttaatctttataaaattttatctgttattcgtcctcgtaaatttatattgtgactttttggcctgcaatccaaacctatgtgaaatttgcttgttccagaaaacttgacagctgtaactttttttttttcgtcacaaaaaaaaaagttgtcttccttgttcacctcaggagctcggtgaacttcttctgaaacttgttcaagggagggtagcccctggtggtggtgatgcgtgtaagaagcaaaggcgtagttagctgtcacagatttgccacgcaccgaaactttcctcgtttttcccagcatctcgatcagtttttggggactttcagttgccaccgcagaggacaatgacgtgattagggaattgaatgtagtgaaaccagatctggaggtttggtcgccgacgtcgacgtcaccgaagaggatgaccctggcattgaacatctctcttcaaagccatccccaccgcttccgctttctcttcattaactcaactcggtgtgcgtgaagaggccgctgtcggaggggataggagcagagaaaatgactctggccaaagtggaaaaaagaaataatttaaaattttcggtcgttcaatttctgttcgtttttggccgtcagaaaacgtaataactaaaaatttgaatccattcttttacttataatttatccttttttatctttttattcttgtacaattgtttttttaatcatttatgtttgttttatttttagtttttaaagtattttaaataatattttgaaccataaaaatattatctaaaatttcaaagataaaaaaaacaaaacaaatataatttgtaggactaaaaaaaattcaaatataaaaatatatttaatataaattaaaataataataaaataaatatcatatcatcacttaatatctaaaataaataaaaataattaaaatcataaacaaaataaaatttaaaaaaccaaatcaagtctcaaaaagtacaaggaataaaaacttataagattatcaaattagggaatacttatttcacaatttatttatttatgggaatatgagtttgcaaaaaatatcgccacatttgttaggaggtaacaagataattatattgcatatattttatttttgggaaactcatatttcatatttgcccattatttattttcaaattaggagattggaaaagtttatttccatttgatacgaagtctaattaatgagtagggatgatagcaacaaatttacatggggtaattttaaaaaaattacaaaattaatagattttgaaaatattatacatatgataagtctattttaaaacacaatttcctataaaaaaagtcatattttaaaacatattttagaacggtataattttttaaaaaaatactaaagttttattttagatatcattttaatatttttaaaaaataaaatattaaaagtagtaatttaaaatacaattttactatttttttttagaaaaatataaaatattgaagtcgtatttgaatcatgacattagtattttttaaataaattataattttaaagttgtgtattaaaatacaatttttagaaaattttattttaaacacgaattattaatattatacaatat

SEQ ID NO: 33 - DNA, 690009 bp, Glycine tomentella
taaataataataacacggacttatgcccccgccaggctaaatatataataacaccacggacttaagcccccgccaggcaaaatagaaaataacacggtcttatgcccccgccaggcaaatataaaataatacggactttagcccccgccaggcatttgcatatgaacatgcataaatgattctcttttcctcttaattttctcttcaatgttacctttctcttgatctcttatgctcaaatttgtcaacaggaatctattacagagtttaatgtatgtagaacaatatataaacttctttacacaaaattccaattatacaaccacagtccacttcatagatttttcagaacaagtcacaattaatcacaactcaaatagtttcaacataataaacataattccatcatacttttttttatataacatttaataagtaaactcaagaatttatagcacaataaacaacacataaactttagtgaaaatattcctttaattatcattcaaatccattacttccttagatattcaagccaattaaacaaattttaatcattcatactaccaatcttttattaaactaaattcaaattatttcttcaattaataattcatcaaaccaaacttagttctttgaggcaattaatcatacacctaatgaacaaagcttaattctaaagcaatttgaataatcctagcatacttaaaccatatttatcataaacttcccataccttgcttgattttagaactttggacagccttctttccttgcttcttcacgtggaattttaggataatggaccttggcttttctttaggtcttttgaaaggaataaggtgagtttggaaaatgatggaatgaaagtaatatggagtatggttttttgcacgttcctttttggcttgaaaggcttggattttcggtcccccatccttcttatatagtgttaatgaagtgctgaatcactctttgcactactacaaaacccactttttacatcggttatataacccctttttacgtcggttctgcaaccgtcgtggatacgggcgtcgttaaaagcgtttcactttttacgtcggttgtcaaccgtcttagaaaagcactttcgaagacggttctttgtgacaaccgtcttagaaaggcattttctaagacggttgctaactacaaccgtcatagtatactacattttaagacggttcgtacccaacaaccgacttagaatgtcatgtagcacgacggttggtacaaacaaccgtcttcgtttttatcaaaaaataattaaaataaacttttcaaaggaaactacgacggttgttatattacacccgtcttagaaggttgctttaggttctttgtgacaaccgtcttagtaaggcattttctaagacggttaccacgttagaaaccgtcttagaatatggctttctaagacagttgacatcaaacaaccgtcttagaatatggctttctaagacggttgacatcaaacaaccgtcttagaaagcgtatttctaagacggttctttgatgtcgaccgtcttaaaaggttgctttctaagacggttctttaacgacaaccgtcgtagaaagacactttctaagacggttgccacgtaggaaccgtcttagaaagtgtgttttttataattttttgccaatttttttacacgcagataataatagcgccacagtgatattctcaaatatcaatgaaccatacaaagtctataaaaatgaatatcatttcattaataacattaatgtcgaagtttcactaacaacatataaaaattacaatggtaaaaataataaatgggcgatagcctgaaaacattttaggcaagtgtaatagagaacagactctactgcatctttactacataagtaaaatctagcaacacaacaacactggctatgctaaaatcacttctctaatgggaaacaatatgctcccaacctatttgctgataaactggaaggcgatttgaaagagtatctccttgaataatccatatcaatggtactgaacaaaaaggctcctgcataaagttgcataaatataaaactcactaataatagattttaaaacttcaaagatcacattaatacagtggaactatgatgttgccaagcaacaactcaatacatttgcactttttccagatatgattacaaatataatttacttctatatagatatgattacataaatgcacggtgttctgaatgctaaaaatatgtcaatcttatctagcaccaaatatagacacttacaaaaatccctcaattaaatatatagtaaaattttattattttttaatcatttatgtaatttaatattttcaactactttaccatataattttatcaatacttatattcaataataaattattcaatttttcactaccaactaactttggagtttctagcttccagctatcttttaagttaaatttgttaaatataatgttgctcctgaaacactttaaaaaaattaataagattaatattactagataaatatgctagtcatttcaaattcatatattacttataaaataatgttaataatttcagtaatgcttcagtggaagtaaatttttcaaaactcaatctgattattttttttttatctaagaccaataatgtcatgaaagattaagtgaactgactttattactgattgaaaaaaaaacattaaagaaaattaaaagtaattttgcattaagaaaattcaaagataaatttaaataaaaattatggttttaataaattaatttcattaatttaaaaatatctcaggttgaatatgggtttggacttaaataagcgttaaaccagtctttggaagaatggaatcccaactatatactattaaaaagattccttagatgatgttataattaatctctataagtagtatttgcttaaatggcaaatgagtttgctcctcccatattgttatcacttatcacaaacttaaagttgtaggaagataaactttaatcaacttcgttgccaaacttgatataagaaaattattattttttatttcgtttttagttaacgtttcatttgctaaatcggtatggtggtgtgtttttcttgaaaggttcagtaaggtggtgttagttgctcctagctagtttccactttccgcactacactcagtaaataattaattagcactttaaattatctctatctctttgttcaattaatagtttgaataaatgtccaacacttttaacattttaaatgatttttattttaagcatcattggtcatttggcctaatttaaaacgtacaaatcgtgaattcatgatcaagaaaaccaaaataaaatagaagtagatcagaaaaccaaaaaaaagtggtcacaacacgtttgacttgagagatataacaggctgtagttgtcgtgttagacccaactactccagttggataattttttatattttccaagttctgtatgtagtcatcgtttcgaatccaaaaacgtgttttcctcttgtctcctacttgacgggggtagtttacaagatggatcattgtattagtgaattaaatatttgtttcttatatataagagcataacaacaatacttaattgttttaacattgaagcacggaccaatagagctgaagctgcttattttagctagttgtttatttaagtaacattacctagtaatttcttaacaaaaaaaaatactagaaaatcttaaatgtgatgtagtgtgtagctaggatccaccaaaaatgcattaaagcaactcaacactgtaattaacgtactaattaatgactctattgttataagaggaattctcgtcaattccagctactcctacactgtaattaggatgactagatttctttctttctcactcttcaagattaagtagcttgttgaatgagatactcctacacttcataagactccccatttataggagtgtgatttattctaaagtggttaataaaagctccttaatgctaattgtatttctaagcactactgaagattttaaatttcattttctttatgttgaatatgaaagcctcaaaatcaaataataaagtccaagactttgaaatgttgtcgtgtccattatatgcaggggattttttttttttttacagtgaggggaggggattgttggagagccgagataaaagtgtaaatctctatctttatgtgctatatatattaaaacataaaagttcttagaatatactaaaacaaagaataaaatcacaaataaaaaaagtcatttcttgcatttctttctcaacaagtaatctataaagagagtgaaaataattttcgtctgctttctatataatctcactttattatgcagaaactagtttaagaaagagtaaagataatgaaagaaaccaaaacaattgtgctttaattcccaaggctacggctcaagaaagaaacaaaaatgtgtagaatttggcgaaattgatcgccgctgttgttgggtttggtttggacacgagggtgcatatatatttacttccacgcaaagcaatgatattctttatgcttttagaatgaaagatgtgcagctacaaacataatctacaaacacctttttccctttagggtaaacgatatcgagacagttttatcaggttgagaaatagttaccataactttttgaatcggctcattactcttagatatataaatagatccttttgcatccactaattaacttctatagttatcaacaatattattcactaatttcactaacttcactagttttatcccgtcgagaaataatcataccatattttctttttctaaactgggaggaagaagatgactcaatccttccatgcagatgcaggaaattaactaacatgtaaggaagatcaatagaggccttatcactgcacgtgcctaaaaattcgagcagcaattttaggcattcaattactcagctagtttttgaggatcgtgagatttcttgaggagaaacctctaccaaacgagatttagatgactttaggatcaatgttcttgaggaggaacctcaatccaaaatgttcttacttatatttcttacaattttttttctcaaatagatgaaataattcaactttcccaaattaatagaaaaatatatactctttctttcttataatatttgtcagttgttgattgttttttttttaaataaataaaagaaaataatgattttataaaattattgttattattatattaatttatttataaattttgttatctattattaatattataagagatgtaaatgaaaaaataattaatattacattaaaaaaactaaaataataatgtaaaaatacgacaatattcttattagctcaccaatcattgtatatacatatgaaaagttttcaaatatttttctattaaatatgacaataattaaatttaagaataaaaaatattaataaatatttttagtatgattattatattttaaaaagaaatttttttataaaaatattaaatttaaattttttcagtatattagatattgtaatttttaaatattatttatttttaaatatttaaaagttgtgaaagcgttgaagaacgaattacttaaaaatatttgtcacaatattcaataattattttttagtggatagtaaaaaaaaaagtcttaagtaaagatatatggaaaattttgtgatgggaaacacaacaaaagatatataatcacgccaacatttatattttaagaagttatgaaaaacatctttataagaaaatctacacttataaattgtttttttttttaaatatatcttattttacctataaaaactgttataacaaattgtttataaatattattatcccataatttttttacatatcaaataaattatttaggttaagttagtaataataaaatttaaattatttacacaacgaaaaagctaaataacttacataagaaatacaaatcattttaaatatttcaaaaaaaaaaattctttataaaaaagttaattttatctcatatcaacttaaatattttctgaatctatttagtttgagataatttttttatattcactttctgtttagttatcgtgagaatctggttttctaagggatgtttgagtcaagacatctcaataattttaaattttttgatagacttaattgtgtttttattcctaaaatttgtgtcaaatccagttttagttcctcaaatttaaaaaagatcgttttagtcccttaaattttcaaaatatgttttgagttccgaaatactaaatttaagggataaaataattttttgaaaactatttttagtccttaaacagtaaatttgaggaattaaaactatatttttataaatttttgagggactagaatgatcttttttaaatttggggactaaaattgaatatatcctaaattttaaggactaaaaatataattaaatcttttgaaaatttataaaaattgttgtcagtgataaaattttgaatcttctttccacttaattattgtgagaaggtatattcaaaattttagagtacatttaatttgctaaaaataaacatatctttttaaaagaagaattcatggtttttttttgtttttataaaataatattttaattaaattaataaattcataaaaaattgtaatgaaatatgtaattttgattttttcgttgcacctacagatacttaagattaatggacatccttctcgagttaattggagaaagtgtttttttaaaatattattccaaaaataataaaaactattttaaataatataaattctcatatgaaaaaaataaaaatattgaaaattcaaaccacatagttttcaagaagtttttctaatcatatcttttcactaaaaagagtatttataagaagaaaaatacttttatatttgagaaagttctattgaaaccaaatttaataattttttatttgtaaaacaaaacgtgaaaacatttctaaaaatgtttacaatattaatcatataaattttaattatttctgtatatatattttgtgacttctggctcactaattcagttagataggtctattttaacaaggtcttttttttttttttttttttgagatttctaaaaagtattgtaataaacttccattgaactgaaatttattaatttaacgtttttcaattaatggatacaaaacttttctccattctatccttaaagcatgccatacctactcattattacattttaagaactaattcttaaatggtctttgttgatttggcaatggcaacgagaagagttaaatacagtacggataaatctacatcaagacatttgtattctattaaatacaagataaataatgtgccactgctaatttatatggttcaatattacaaacttaattttgtaggaacaaatatataatttaatttacttctcttattttggcaaatgctaacgaattacaaaataaaaaataactttttttctcccgaatctctaatatttttaataaaattaggattatatttaaaattgcatatcatgcgtaatcaattttgcttaccaaactcattcataaaaacgcacacagcttctgtaatataatgtgtaatacaaacctcagcttttgaatctatttaagcagcgttgaaaataaccgcacaagaaagcctacgagtccaggacatgcaatagcttttgggttgtggtaccatacgtacacatatagcatatgctagagttcattatttccacggataaaagttccctcaatatcccttaacttgcaaggacacccaattgcatatacttccgtctcactacttaattatgcgaccgtaacaacgttgaaaaccatccccacgctagctgtacgtacgatcatatatttgagagaatgtttgatttgcaatttaaaattgatgtgacatgtttttatgtaattcaataaataaaaaaataagagttttgattttatttttttaaatactttttctcttaattttcaaatgtgcattgagtcatagatggacatttcataattctcgcgtaataatgcaattacttgtataaacacgaattctttctgttaattaatgaacatgatcaatgtcaatagttttcgtgtacagataagtcttgggagttttgtttgtgttatcttcctttttccagctcacttaccaactagaatccggcataaacagtcaggggatcatgaattatgtaactacacttctcatcaatttgaagtttcagacaatcaccttcttttgttagtttgtatgtgtgtgcgtgtgtaattcaattaaaaattgttcccatgtaatatagctgtatctatgtacgggtctatgttgcttttgcatccaacaaaatgacctacatgaaagggagctaggcaactagctagcatgcatgtgtctgtttttctcctacctcataggcacacatagcacctctttaataaatttaaatcatgcactagccttttctctacaaaatctctaaacgtacagttccttcacaatcgcaaatgtttggtcatatatgggatgtagaattccaaccctattaagtactaattattatatataacacgagtgtgtatgtgtataagtttgcaaagcagtaatcacatagatttttcttgtttacggttatattttcttatcactttggtgataagccgatccttggtattattccgttgtcccgcatggccaggtagacgagggatgaaaaaatttctcagaaaatgtaccatttcatgaatcatgagagctatacaggaaagggaggaacatgcatgtgatgcaacaggttgtaattttctttttctttggcagcgttgcaaaaccaatggtggggtccaatcttattagctcaatatgccatcaaatcagtgggacgatcttagtaaaaggagactttttgatcgatcggttgatgcatcgcaagttcaatacgtgtccctggactgtggtggtgcacacttctccttgtccacattcattttgaatctctaaactcaagtaggaccatgcattaggaaaaattatgttcatactactttgttaccttatatactatggttgccgcataggatccaatggttaattcaataacatcctaaattctctattgtatttatgcttgcacgatccccaatgccataacgcttcaattgttgtttacttatgggctaccttcaattcggtcatctaaggcaataaatttcaacccctttgacgtcacaggaagaaaagttggtgcggttgatcaagtaatcacattaattatcaaatatagcattgtgatgtgtcttattaaaaatggcgatgactgcttaaaggtaaccgttgctgctttcagctgaatttgaatagtcgtatagtagacaaattgaaacctgcatttgccatattaaaaagtttcatgatacagccaaaagtgtaaagtggagacatagagataggaggaaatgcattgcattgcattgcatgcatgatgcattgctgggacagggaagaggcactgagccccaaaggcatgccccatcctaaagggtttatgagtactgagtgggagcattgaaagagcactggctgcactgcctctgtcacaggtcctacagcacaaagggttaatgaagtagtatactgatcagcttagttagaaaagaagaagaatgggtccaccctaaagccctgacattgcatttaattctcttctgcttggagttggggtgtgcacttttctgtctttacatgcttgttaatcacttggacctcgcattcaattcatgtagatatgttgaagttctctcaaacagaatgttagtatttcaaaaaaatttgaccaatagagcttgcctcagagtttgagattagagaacacaacttaattaaataattcttgggttctgaatttctttaattaatatacctgaatattttataattaagcgggaaaaaactattctattattttaaaaaattaataatcattcactgataatataaaatattatcattcaatcataaaacatcacaaatataattttttaaataattataataaaagtctaaacttatcatgtacaatatattatgattataatttgatgaagaggtaaaattattttatactgtctttttgaaaataaaagaacaaacataatgaattattataaccttctaattctcatattattcttattttatatatgtcatccttgatatacttatcattagagttaggtttataaagataaaatagttattttataattttaaaactttgtattataagatgaatctcaaatttgggagaacagctttctctttcactctattcctctttattccacttactatattacaaattcaaacatactgtcataataaaactttagggcaaattatgatcacaacgatgtcattttttaaattccacacgactcttatctttttaacacctacatacaaggtacacctactaaagaaacacattatgtaatatagaaagatagtaaaaagaaacttcaagaaatcatgagtattaacgtagtttgtcctaaaaactaatgtttagttgagagtgacaaagtggataaatggatgggggggtcttcggtgtggtctccctatattttgttgtgaatgtgaaaatctaggtataaacgaaccaaaagtgagaatgtaggagtagttcattcagttactgtcggtgcacaatgacaaggcacctttaattaggggaatgggttaaagacagagagaagcagcgaaagcacttcaaatcagagcctacaaaaggttctatggcaaatggacaagtttttccagtaatggaggggtctaaaacaacagttcccagttccttagtcggccattaataaaggggtgggtccaaacactcaccaaaccacaaaaaaagatgacataacataacccttcaatatctttcttttctcggcaacaaatcccatttttaatttgcttttctctttgtacctcacgtactgttccctccctcattttaaataaaaataaaataaaataaatttcatttcaatattataataatcactccaccccataagacccgttccaaaaagctttctccacccttttcaactttctgcttcttctaacactactctactccttgtagaaccatctgaattctccttttgactcaatatcactttaaccccagacccagtttccactctttctcttcaccaaatcacccgccacatgaaccctccaacacgaccacaacttcacatctcatacacgcaattttgtggcatatattagcccgtgtttcttgctctttccacatcaaaaagctaggctaggctctttcaaccacgtcgtcgcaaaagtgagttattacttacttagtgataatacaatattgcaacaacaacatggttttgcataggagacctctgattctagtaatcatctggttgttattgtttctcttcatattgggtcactgccatggttctagagccacaacaaccgtgttcaaattcaagcccaaatctcaacatcatggtcacttctctggcttcttgcctaaaaggatgcccataccgtattcaactccttcaaggaaacacaatgacattggcttaagaagttggagatcaccctgaacctgaggatcatatgcggattagtagttttgttttgggtaaaggtgaccattgggttcttatttatattaattttattttctccttcatcttcatctttcttttctttattaagaaacaagggaaactgattaactaatgtacatggcaggggttcttagtgagatattcattgtctttacgtttgatgatgatgttattttgtttcaagggatgtaataggtatgatctgttagatgatggatatggatttctccttgttacttgaaaaggaggaagtcatggttgtttaatttagtctctaatttttttttttttggagtgtgaatcaattaatatagacaatgaaatggtcaacagcatcatagaattttcagatacgtagtttaaatgttgttctgctgtatacacgacatcaagtgttttcattattcaatgttcaaacagtgctagtattagacatgcatgtgttgttgtatttcttctagttattattcaagaataaagggggtaaattacagtggaaaatcggtaatatttttcttttggagcgaataaaatcggtgattgacatactgaaccagtattgattcatgaggtgttttacaaattaaattgaatcttgtattataaagaagatatttcgttttacggttacttaatcagattagtgataacttaatattgaatgaacactttttttttcgttggtagtacaaacaagttgtggctggcatggaaactaccccgttgaaattacccgtgtgcaagcagcattgaactcgggtaaggtggtatcagtgtctttcgatgcgtgtggttgttgtgtgttgctgtcttgatttgatatgcacaaataaacatgtgtttgtacgtatacattatactgttgaataattgattcaagattttcggggattattatctctgtatctcacacacgagtgctacaatggcagtgtatgtagcatacacgagttcaataaataaataaaagatgaaaaaaaccaccgaattcttcgtgtatatctgtaatgatgaaaagctatttgctttatgcggtgtttcctgtgaatatgcccaattaacgccaaaactttggtataggttattattttatgtcatcataacttcttacgatctttggagaaaaggggaaaagaagttcgacctagagcatataattcgaggaatagtattattttagtgataattataataccttcttgctcaaggattatagaattccaaatttctgatctagcagcttttctttttcatatataaaacagatacgaaagtcaaacccgaatcaaagtttaaattgtagtctagcaaaatgtttaccgctaatttaatttggtcgataaattcgttgaatactaaatttgcttatatatgttgaactaaaatactttaaaatttcgttcaaaaccttccatttaataaaacgtgagttcaaaaatttatgagctgaatccaagcaatatattgaatagtttatatatagttagttgccagctagtattccatctgaaagttatgtttttcttttctaatttgttttacagagatcttaatgttgtaccccttctttcctaagtaaataaaaagggggaaaaaaatattatcaacatgccttactttggataatgtctacaaaatatgaagtttcattggattccactggaaaagacatcatgattcatgaggaggaaacgatggataaattacatttttttttatctctgttataaatatgctggagtattatcatcgtttagatttcttatttcaatttgcttggtttttcgtttctttacgatacaaattaccaattataaagaactatattgtgatgtgggagtctgtcattatctctttgctttagttgaaataattagaaatcaatggaaagtataaagtacttcctgtgctccctttaacgttttaaattaatgcatatcccaagtcctaattacgagattattgaatccttcaaacttcataggttcattttcacaatattttttccaaattagcaaaacacagctcatgaatcccatcccatacgcatcccgtacctcatactacctaactatgacgcaatgatcttaaaattaaatgacctattgctaaaagtcttcatttattttttggtttaaaaaaccacacctataattcaattttcatttcaacaaaacactctgtcgtagtgactcacattttagtgacacactacaaaaaacctggttccgtggctaaaacaagggggaaagaagatattattaattatagtaaacagcttccctgtttcaagatcattactctgtgttcccacacgtagaaattggtaatgaaattcagaataacatcaccaatgaggctggagggtacctttcccatttgtaagactgatcaggcaaaacccttatcccgaatatcctatgtgatatagaaatgtcaatggattctacgaattctaattctggaaaaagatttggctgaaacttgttctgatttcccctttccactatcaacttagtcttgggctcccttcacgttagcaccattaattttttgaaccgtgtcatgtgctgttcatatctatactaatttcgagtgttatgttgtcccagtcaaacttcagaaaacattgttatttattaaggaatagacccttcaatttggcctttgatatttaatttacttgatcattaatttgactaccagctgaagagtaccaagatccctatttcaaggcaacaagtaccattattggcattataccataaataaatggagaatcagaataaaaaggcttcgcaggcactttattatcaagaattaaaaatacacttaaacggggttcattttttggatttttggagtccataactattactgaggtttaaaaatattgttaatcatagttttaaaaacctaagacagcatgcttttcccacgtttgtcgtttaaaggaagagaataatgaacattcaacttctaacatattgtcgctttaattgcgcattagctttaatcgttttcaaaaaaaaaaaattgtttattgaaggattaggatggtctagtatattttctcttttttcttttgtcaaaatgcaacattctgactcaattctcatttgctaagatctctaatcaggtttcagtggcttcattcatgtgccctgtaattgtaggcccatgaatgatggagtagagggacatttaatgtcaagtcacatttccttattaatcaaaaggattaaataattgcaaatgattaccttcatggtaagtgaattcctgaccccacggttaaagcaataacagataatcatagtatataatgtgtatctgatattaatccaataattccagtaactcggtggattatatactttgtgctattcattcatgagcgtctgtgtacaattttattaatccaaattatgcatcttaactaggtcgttttatgcataacactcgactatcaaagagaataataatttgtatatttttcttatattttcgtctcaaaataataatcgtttgaggttgttttacacatattaataataataataaataaatgaaaaagaataataattttataaaattaattttatatcattaataatttatttataaattttattttctattattaatattataaaatataaataaaaaattataattaatattatattaaaaataaaataataattattttaaaataatttttttctcttacatgaaaattataataaaacagactaagtattaatcaacttaaaacacatgagtattataaatgcgtatcaaggttaataagtaaaaatgattgtctatgtttccaaaatattaaaatgattgtcttagttattgatttgatggacagactggttgttatgcatcttaactacagtattcatccaaattatgtagtaacatacttttccaccggatatgaagtgatgataaaaatcttatccgcgtaattacgtagatctaacaaagttataagcaataactgtttttttttacacatgtatcttatcactaaacaaatggggaagaaaggttgttcccataagaatatcataggctaggacagggcacgcagtttataaatatttatctgctagcgttagaatattacatgcatagagtttacagagctcaaattcaaaaaaaaaaaaaaaaagctggataaaaatatttaagaaaagtaaagccgtaaaggactcgatttaatattgaggatcgaagaactgtttattaggacatttaaaactttttcataccatttttagacatcttagtaatcaaatagcatattttgggccacacttttattttaatattaacaattatttcaaatatcttactagcactttttttttattttagattaaatataaacatgtaactttaaaatatttaatttaaaatgagatatattcttttagtttacattttttaaaaattcaaatataaatacttttaaaactataaaaaaagtagaattactttaatatataaacttatatttaaaaatactctaagaaatttaacatattcaaaagagtaagttctaatttattataaaaagctggatgaaataagaaggtactaaggtttgtaatgattgaactgcaaaatacaattgtgatcgaagggaaatataatatgcaatttaaataattgcacttggattgtatggttgttgttctaattaagctgagatatgagtttcatattttttcaaagtaaagatgctggcctaaggatgatttatctaaacttattagatgatgggtgtacaaagacctaacaaaataaaaagcattgcagtcgtaacgaatatatatataagaatcgtgggaatctgtgtatcactaaccagatggttagggggtcaacgataaaagtcagacatgaaagatatagatataagctacacattttatgttagtatttcaattcgcaaccatttctcatttttacgataactaacttcaacattaaaattcttgtaagtggccacttcgatctgaagaagtttgtcatagatttcgtccgaaatttacactttcaactgtgaacattctaggtggattggtgctaaactgttgtgttgctccatctatagctaatagattttcaaaatgctttcaatttgttgcaccaaaactaaaggtggattgtcgtaggttctgtaaacagaaaaccgcaggaagctaagtttgaaaggtcactaatacttgtggtatcaagacttaaaaaaaaaaaaaaaaaggacacacacacacacacacatttattttaggaattcaatgtaacgacttctatcaactactgtatgtctgtatgttgttatttggtttataattggtttattagatttttttttccttaaacattattataaaccttacaaaatgcaatggtttaagagagtcacatataagctttccaaaaagaaaaatagagtcacgtctaacctcatttctcaaactctcttaaaaaaatatcgtcaactttattttagaattgattgagaaagaaaataattgttattttagttttttaatataatattaattttttatttatatctcttatggtattaataaaaaataacaaaatttgtaaatgaattaatgataatataagattaattttgtaaaaaaaatctatatattaatttttcttgatatctaattaaaacaacctaagatgataattagtattttggaacagtaattgttgttattatttcatgtgtataattacatatttagatttcattttagaatattcccaatcattaaatttcaaaatttgaaatttatcatttctcatactcaacattcgcgattcttattcagagaagtaaatactagaaaagaacttttgaatgatacccacccacgcttaatgtgcagcattattccagcatatggaataatcagagagtataattgattggtgtttgagtttcatcatcaagatgcgtgaactctgcagtatttctttttgctgcctacacgaagagctattcagtaattaggggaatgcatttttctcctttgatactttctttacttcattagtttgagatgtttttaatttttttcctccgttgcttaattttttggacaacaaatatcattgctaattatgtgtggtcttgtatatcattgggataatcactgtagttgcggtgccaccatcgcgtggatcactgaataagttatcataaggtaccgactaccgagcatgcacattataattaatttaattttaattttagctacacttttttactcatctttctttctgtactttttaaaagctgaattttttcagattttatatcttatattcttttaacactatttttttatcacctttctcatttgttttctctccgtctggtacgtatctcaaatccttccgtagggaggtgagaggatcattttttaaccttttcaagggcatagtgaactcggctattctatacttttaaaatgaactacgcgggcagtttcaaatctaacttataaaatttagtaaatttaattttatagataaatttatccttcctaacctgttttcttgatggattaaccatgacagatcaaaatgggaagccagtcagactgtccaatccgcataataatatatacacgagattaagatgaatgttgtagcctttaaggacgtgctttacatgataaatgacgctagaggacctgtgatgtactactacaaagtgacatgcataaattcagctgttgatatcacagatatggataaagcagcaaacgctttttattcataaaaatgctctcgaacattgattgatgaactgcctcttatttttttggtcgggatattaacatgggagcaacatatcaaactttcttgcagcaaggtttcactctgcagcacttatttcccctcgttgagaagtgaataatctgctcaataatgtgcttctgacttgaaagaggtcgtgaagtcgcccatgaaccatagaatgcttccgcagcttgtgcagaaaaaccgttattgctaaggtctagtaattgcaagttctttgccttaccaatagcaattaaaaactgttgcgtgaaatggcactcgggagatgaatttctttgacatgaactggcacagctgtcgtcaagttcagatgcagctgcttctactggaatattttcactatcagcaacttctagtagatggtcggcagtgttcagagagcaaaggacctcttcattatcatcaactttcatggtatcaagtttctgctcctggctttgtgagcagctttttaccgataaatcatattgtagagaagaaacttcctttggaacagaattatcagcaagattaagttcctcaaggcagctgttctctgataaaagaaacaacatcatcaaacgatagatgtaaaaaatgaaacaaccaaatataatttaatgcctacctgccagagcctcaattatgtgaagaattccagcaagcccaagttgacactttttaacgaccaaaactttgagacagcactgtgggtttacgagaagagcaaataaagcattgctgccctgtattaattagagaatttgaacaaaccatggataagaaactggttaaactcaaaattatcaccaaaatggcacagctatacctaaatctataaactgcaaaccagtgttttaatagtaaagaaatggtatgaaaagccagattatattttgagtgttgaagtaatacattgtaacactcaaataaaaccagccaaggaagcatgcattacaataatattagcaatagaaatctagtcaaggcaacaaacctcgggcatgataggatttccttccaggttcagctctatgacagaacaaaaaaaattaacactggtgtttaaaacaaagttaaacgttagaccacaatatgataggtcaagtttcacaagctcttcagttcctttgagcaatgattctgctaattttgttgctccttcctgcagaataatgcctctatcattagaagatcaagtgggcaaagcatgctagaataaaccataatgacacagtaatgtgaacatgcagttggagataggttttactcacagttccaatacctgtccccccaagtattagtcctgataaagttaaggtccctgcaagcttgcagagggtatcgacaactggtttgcctagttttagaccactcatattcaactcagaaaacctataatgggcaaatttaatttaaatttatgtatgctctaagaaaatacaatttatgcaaagatgatatatggagatggatggtgacattggtacaattgattttaccttttcagggtagaaagcctggacagaagattaattatagcatttccagatacagggttgttgtatcctgtcaaagttagattacccattatgctgtaagattactagtatcagggatttaaagagaatgatagattcataatacctatacatagatgggcaagtacagatctagagtccaatgcatccgcaactttttgaatagttctagatgtgacacaacagttctctatattcaagctacaaagagctacacaacagaaggtaagtaaatagaagtagtataaacattttcatagctcagagtaagaccatgtatactagaacaatgttgttaatgacggatggcacaagttgtgaggcctatggtgctgacatggcaggtctcccttcacaaattgtctatggcagttggtaaaaaatccgccacaccattccgccaccattttacaacattgtactagaaagaggagggaacaacatggcaatcagcattcttcaggagataacttattcaaattggcagagcttcaggtcatgcatcttacctgtacagttttttaagattgttgaaagataagatccacatgcatcagtaagacggtttccagaaatgttaagcacttctagtcgagcaaatagcagtgaacattcacaaatctgacaggaacaagcaaagttaatacatttgcaaatttgagattagtcatgcaaaaagagaaaagcattcttttattatatattaatcaagaattgtatgaatagattatccttgtgtaaatactaaatagttaggtttgaaagttattgaaaaaaatggcctttggttgggacaaggcaggtgagctcagctgatatttcggtgatttaagacatgaaaatacgttttctttttcagaaaatatcacaactaacatcaagtgtatgcatccattatatttacgagttaaaaattttaagatatttttctgtaaaaaaaggtgtagagcaaccatcatttcaaacctcatacctaaatatcagatttaacaagatctaatgttagaaacatggaacaaggggaagagaaacaagcaaagatcaaaaggattgcaagtagtatcatacctgaaacaatgctgttgggccaaatcgattgcaatgcaaatccagagttaagccgccataagattgtcctgatgctgtgaacaccttttgaagtttttcgattgttccatttcctaaaatattatcaactcaataaaaggctaaaactatttaatagattccctcgttagtttttatctattttaattcttttcatggttttagttttcaaaccattcattagtcaccaacaaaattactgattaacagacgtagttgatggaatttgagacttgagaaccataaaaaatgctcctgaggaaatataccaaaagaaaaggcaactactagacgatttgatgacaagacaaataccgcacgatccacagcaaaaaaaaccacaaaccaggaaaaaaaaatttacctaacaaattgtgagagagatcaagcattgcaaatgacttatgggaatgcagtgcatttatcaatggggtaatagacaaatcttgcaggtcacagtcagacacaacaatttcatcatctgaaacctgtggacaataataagcaaaaagcagttgaagaaaaaaaagaaagaaacattcaatccaacatctgaaaatgtgatggcatatctgtcaatgtgcagtggctacgaaagaattgatacagctaagatcccccttacctctaaattgtaaagcttcttcagtaccttgatgttcggtacctcagacaactccttgcagccgtctacatacatttttatcaggcacttgtggatccatcctgtaaaggataaaaaaatcatttgcttatctcacttagagattgatatggaaagctaaaaattgattttaaatacagcttcaatacagcataagcctattttccaaattatgcatacatcttcggatgtcaacttcctatgcttgttgcttacataaattgcagtttgcaagatcaatgaatatcaagtgatgagtcagattaatgttaattttttttaccaatagataacaaccatcaaccatctgcaactagtctagagatttgaatatttatgtcaacatatgtgcaagtagttaaatatattgaagataaagttcttgtcaaaaagccagataagaaaaagaaaaaaaacaaggagatggcataaaaattgaatggtgatatcactgaataaacaaaaagcataagtatcacataccatcaacagaagcttcaaccatgctatttcccagaacttccttcagatgttcaacagtttccagggattctaaatctcttccagcacattttatatgctcaataatgggcaacaaacctatttataaattcgtaattgtaagaacagtcaagtgcactcagcaggaaaagaatatcagcaaaaggaaaactgcaataaataaatatataaaggaataaaaagttgatataacatcaaagttgataaacaaagaagaaattaccataaatccgggttttgattattttttcccaaattgtaattttttaccagaggggcaccaatcttttattttattacaacaaggagcacatgtcaccatttatatgcaaagccagaattccccaaaccctcttccttcctatcttttatacaattcgtaccaaattaattttcaagtcaactgggatcttctatgctaatattataaagtgatagaaaacacttcaaagtaggaactgcctaccctctgatttcttttcagttggaaattgtagataatataagcatgcaactgcagccttcaaagagtcaatgttcaaatgatcaccagtggcacacaaggttgtttctacatgtattagatcattcccaatccggcatgtaatatattgctggagccagaaaatatagaggcagcaagttagaaaaatatcaattagatgaaaatgacaatttggcaaaaggtcctaaatatattcatactcatttaataacagtagaactcacgtcattttgggaatgatgcaacatgggctgggaaatatcgttttgtttgccagagacatcagtaccacatttagaaccaataggaaaatcaggttcagcaactatatcattgctcaaagacctggagtgtctgccagtttttgtggctgtatgtggactcgaacatttgaaagaactactactttcttcaacatttattgtacacttggatccatactccgagataacctgctatcccaaaaaccaaaaaggctaggcattcacatggtgatacttgagaaaagctcacacacgcaactaagtggagatttcattacctgaattttacaaggactggctttagtcttaactgcaatcaggcaagtatcaatcagagcacaatattggtacaagggaaagtttgggtcagagcaaagcaagtaacggaaaacatactggcatcataagtgggcaagtcctctactgggcaatgatgattctttctgcttgaacactccacttcctcatcatcgtcatcatcggaaagaattacacggacacgtttacaaccaacaaccatctgatgattgatggtttgatttttcagactactgggtgactgcttatcttgcttgttagagttggtaagactttctttgtggcatgctttatttttggatgagccttttatggactgatagagtgacatgagaggcgtgtcatttttcatttcttctccagtagtcagagtttttgatcgagaagttgtctttggaaagcaaaaatcatcagacccactgtttgacagataatcatctgcttcggtatcagtttcagagcaaaaatcctctggcatacttttagcttctgcctctttttcttccgatttcttcagtttatcgattagaagcttcaacctcctataaaagatcacaattgatcagcattaatattacatgtccatcaaaaggacccatgataatggaaacaatataatggatttagttcacagagtatgagattttggcctccagaggtttgaattctaaatggatccctgagtaattcaacaaaactgcaagaaatgtatatataaggaaacagacttccatgaaccagttacctggtttcatcctcatcatcaaatcttatcatgttgctataatgcatattttccaaggcagagagttgcacatcaggaaggtctgcttcaactgcgatactgcaatatgatgcaatcaaatcaacacagttcatataagaccatcataaggatgccaacatggatgtattttttaagaaaatctaagcaaggataagtcatataagtagtagactagtaggcggtcaagtttcattctagtattggctgaagcactgacttctaactttgtaacagccaacatattctcaaaaaatgacttctgaaaatatgtaaaaagaaaccagtatgaccagaccaggtcatcaacatggcaaggaatggaaattacattatgagaaaattctaattctaataattttctttcatgattcagaaaccatagtggtacccccaaccaagctgcatcaagcctgaggaaactattgtgttcaacttacagtacatagttcatgtgtcttatgcaaccaagttgcatcaagtcgagcatgttgtgttcaacataaattcagctacttggagattccgttataattagaaactatttcttcttccttcactaatttcaagaaataaaatcatccagtaaagttatatggatattattacctgtagctctcttgaaatgcatccaatgcttttctccaattttcagtagaatcgtaaacattaccaatattaattttcaccattgcttgcccctataaccattattaggaaagcataagaattaaccaagtgacaaaaaaaaaaaaaaaaaaaatcaaacaaactatttcagctacatttatctttggatactaagtaacctaggacattgacatgcatacaaaaatttaagtgttccatcaggatttgaattgtgtcatgtcacactcacacaagagtgttagatgttagatttcaacttaaaaccaattaactctaagtgaggatattaaggtggatgtgcggatatacgaagatggataagataagaaatgaggatattcgacgaaaggtatcagtggtaccagtatgtgaaaagatgagggagcatagattgagatggtttgagcatgttatgagacggccattagatgctccggtcaaaacaagagtctgttaccaagaactagatacaaagagaggtagaggtcgaccaaaacttacctggggaaaggtagttaaacaagacctaatggagtgggatatagattggcggacggtatgtcttaggatcgagtggagaaaagctataagtctggtggagggttaaaccctttagtagtctatgttccagttgtttccttgttttaattctttttttttcttcttttcttttctcctctcaccattcttttgtaactgtgtttctctattttgttctattttcgatttatcattgggttcatctaccaccgaccccaattaatttgggttaaaggtgctgttgatgttgatgttgatgttgatcccgagaattgagacaggcaatatgggacttcctaacacccccctccacagatgcctaccaaaacaagcgagcttactagaatagacgagaaccaagatgggctataggctttgatactatgttagatttcagtttaaaaccaattggttctaagtgaagttgtctaacagatatataagttgcaccccgagaattgaggcaagcgatgtgggacttcctaacattagacacatgtctgactaacataacatggaaaaaattcttatgtacagtgagtataatgcattcatttaccacggttttattataaagcatttccaaaataaatcttactgcatagacttcatttctgtgtcacaagttatgttttagttagattgttctattacttaatttttcttgacatgaacattgctcctcttttgaagtgtccatgtttcattgatatcaagcaactaaatctcagaattttcatgttttgtgtgtatgggtaatggatgtatttaaagttacttcctcttgattttgtatataaattataggcttaatcatatagattttgaagattaaatgtatgattagtggcttggagtctttaaaccctcattttgcaatttactcaaagcatattttgttcagcttaattctagaaatataattgcttatttttcaaaagctctttcaggaagctaaaagaaacaagttattaattcttccaaaaataagtagaatgaaacatgaattcatagtaccaattatttgaaataatcatggatgtttctaaattcagatttgtgacatattgaataaggttaggttgaaaaggaggaaaaaagaaatgtcatagaatgatgaaaatgtcacctctaagttaccaatatttttgtacatttcccaactctttttgtaccacttgattgctttgttgaattttctgagtttctggtatgattctgcaacatccagatatgaatcggccagtctctgcctatcacagagttcacttgctattttcttcttctcctttgcaaattcacaatgctaaacaaaatattgtttagtaagaaaggtcacacttaaggaactactaaacataccatagcttcaaaaagtctctgcattcaccacgtaatactaataggtcattaaattatcaaatgcggaggaaaacatcatatagttatacctacaggcctgagagaaatacgtgcatcatctcaaacttcaatatattactgaacaaagtcttacattttccttaaagtaaatcatgaaaggttttcaattgaataaattgcacaatgaaacaaaccatgcttaaaacaacttcaatgaatctgtgcttaatccataacttacaaaccatgagcatgtgtacatctgttccttaaagcaacattaatagaccaaaccaagaagacttcttcacgtgtagcaaaagggagcagtaaaaggtcaaatggagaaattgatacaatggaacatagccgtgcaggttaagcatttgtttcattaacatggtaaataaaaattgatcatactaaagaaatgaaacccaattggtgtatcagaaaaattatgaattgcctcatcaaatctggaaaaattccagacaaaatagccattccaagacagacatcatttggttaacagaatcaaaccgaacacaatgatagagccaataccttctcccacgcagagatcatccttgctttctcaactaggcgctctagaactgcattctgctgcagcaagaatttgcgctcatttggtgtccctctggcagtggctatatctcttttgagcttcttaaggctctgctcatctttctttatatcagccattaccttaacagcttctctcacagtttcaatattctgctcgatttgccttaccaaagcgtcctcatcctccaagctcttcgccaaaccaagcgccttctcgtaataagcacttgcatcttcatacttctgagtcctgtaatgtacttcaccaagattaatataccccttggcttccccttgaacatgtccaattctgttacaaatcacaatatcagtcttaatgtgtttcctagctttatcccaatccctaagttccatatacacattcccaaggttgtggtggagtctactgcggccatcatcgaattcagcgacctcctcttcctcacaaatctccaatcctctagttaaagtcttccgcgcctcgtgcaagttgtcgagatccatctccagcatgcctatgttgttgtgcgcgtcgatgtactccttgagaaaagaggacttgctgttgggaggattctccttgagcttcaccgcgagattcatcgcggacttgaagtacttcttcgcgttgcgaatcgagttgtggtcgtgctccgatcgcgagaagagctcgtggtaagtgcgaccgagttgcgtgctcgcccgctgctgctcaacgacgtcgtcagcgtccctcgcaagctctaagtgttttttctgtgacggaaaaaaaaagtaaaactctcagtgttaaaagggaaataataattagggttttgggaggaagaagtgaagcgctgacctgataaattagggcatcggagaagtgttcgaggcggagatacatttcgccgagggattgacaagttggtagcaaatgcttttcgggtaaatgtttgagcgaaacgtcgtaatcgattcggagccatttgagggcttggacgtactctcctcggtttttgagtatgtcgccgatgacgttggcccaccgcgcctcctcccggtggtttacctccgccttggcgttccgatacgccgccttcgccgatttcaggtccgcgtccatctcgaaacgacggcgaataaggtgtcgtcgtgggttctctctgaatttagaaaactcttctcttctcttttctttgtaaggtgcgatttgcaaaggcaaaggcaaatgttagtctattcaaggttcgaatgaatttgctgtgtcccgccaaaaacactttccccttgtttttctctctctgttttttccttctttttttcgtttttttttaaaactcgtttaatagtttatttctcttgttattactattgttgtggataaatttttgtttttatacattgactgtttgtgtaatgtgaaataataatgattagcaaaaatattttgtttacacaatttgaaaaaatatgtattcacaagaagaaacacaatatccgaaagaaaaaaaaaaacacaaaaaaacaggccataaaaaacatttataaaaaatcacgtgactagaaaaattaacaaaaaattatcattcatacataatttttcacataaataatcacatacagaacaagcaaaaaaaattatacaaataagtaaaaagacactcaagtgagtgaaaaaaatattcaaattagtaaataaaataagtgagaaaaaatcatgtagcaaaagagaaaaaacattaaaatgtacagaaaattaaataataaaaaccatttaaatcagtaatgacaaattagttttaaaaaatcttaaaaagaaaataatatgtaaataaacaaggaaatcattcaaatgggtgagacaatgaaaaaaataactacaacaaataagaagatttaagaagaaaatttattgccttaaatgctaatttgatccctttactttttatagttgtgaagttttggtcctcataagtcatacctataatatttataattaaataatttattcgttatgttttattataagttagaattatatccctccgttcgtctcgcatctaaataggaatttgctaataaatggaaacacagtggattaaagtaaggtttggccctccctcttccttgcttcgtcaaaggcaagacaggtttagcacataagtgtttaaaaaattttaactcaacctatcgcaatgttttctttgggttcgtggaaacttagattagtaaaacacatgaaaattcttcttcaggttatcgtttatgaaaataaatgttaaaatagcctttgataaaattattatttagatataatatagcgatggttcgaataaatttttcaactcaactctaacttagctttattgaattagagaaactccgaccccaatcataatcttttcctaaccaatataaggtcaaacaagtacccacaagttcaaatttaaaatgtcatgtgtatgcgatatcaatagtcatttacttaattgatagcttaatttatatatatatatatatatatatatatatatatatttcacttaaagtcttttgagtgatgggatcaaaattttaattttataacaatcttgatttcattcaattatgtaaattttattttgacattttaacaccgttagatttaaactttttattatagttgtcggatcgaaatattttaaaagaatataaaattttaaaataataatttactatttctaatagttactattattattattaaatagatatagagaaaacaaataaataagagataatgcagtgttaatttaaaaacaaaattatttttagaataattatttaattttagaatatttactttcaaaaataattatttaatatatgtatattaataatatgcacatatataaaatattttatatctatatatctatatgtaaattacaataatatatgttttattcttaaattttaaaaaaaattaatttaattttttattataaataaaattatacttactatattatataataaaatatgtgagaaaatgaattgatgaaaataattttaaacgtatatttaaattttgaattaattttattaaaatacatttaatttgattacttttaaaggatataatttatataaaattagaaatcacgatatatttttcaattttaaaataaaaaggttatattttgttatttgtaaaatataaaagatatatacttttaaagcattttttttttggatgaaataaacactattacatatttatttttcattatcaacgttagattaaaatgctaagagtactatcattttattttattaattaatttgttccgttgattttaaagacaaaaaataattcattcaacttttaaattgatcaatacttataaaattgacttaaattttgtaactttttataataacatataaattttattaaaaaatgaattgaccttattatgatcatgattaaaattattattctcttttatatattttatattcttttataaagtttaggggtcaattaacaagggtatttcttcattctttatccgtttaattttgtataaaataagaaatgaagaataactatattaagaaactttaaaaacatatgcatcaaaaaaatacaataaatatgcaacatgcaaagctgaagtcgaatgaatttttttcatgttagtatttaaagttagggaattttaaatactcatattatatcatagcttcttctttttgtttcattttgctaatcaattactgagtattagtatctatatgacaatctctttatggtattttttaatatattatatctatatataatcgcaaacaattagacatcaaaataattaagttaaaaaataataataaatgttttccccttacatcgtattgattatgtgagtggaaaattttataagtatgaatttttcccacaccattattatgattatgtggaataaaactaaactcgtgtctttaaaaaaattagagataaattaattattttatattttttcctttttttttcttattcaaatattaataaatatgaaatctatagtttataagaaaatatttgaaatattaccttaataaaatataagatttaatatattatattttataatgacaacctcgtgaaaaaattgataataatttattttagttgttttttttgcttaattgtttcaattgtttttcatatatgacttattttattttgttattgacttctttttttgtcctaggccagagatgtgtgcttcaaaaattgacccacaaattttttttacacaaaatgagaatcaaatacgaattttctattttgagattgaaaattttacttgattaatattcaccttttaaggatcaattaacatatgtagtttttttttattctgtctttttatttgtttttttttttttttgcttttgcatacttaatatttatttctctcattttgctactgcagtttgaaagaacaaaaataccactcgatgttttatttatttatctcacaataagtgacatttgtatagaaatgagagataaaaactcaatatctaatgaattgaatttggtggagcatatgaagtgacgactgacgactgataaccaaatattacataacaactcatctcaaatatatatatatatatatatatatatatatatatataaacagacaagtaatgaaatttaaatcaaaaacaatttgcaataatataacagtaaaaactagtatctctcttaaaaaaagaaaaatttaatatcacataattgaaactaatattttcaaatgattaaatgtcaatttattaatttttatttttttacaataaaggtatttaaaaaatattaattatgaaacataaaatttaaatacatgtaaacatagtattcacaataaaaaatgaatactcaaatttaattaattattaaattatatgtttaacatatatatatttatatttaatttatacatctcataaaactattaccttattattacttggaaaaagaataatcaaaataaatttaaatagactaaatgttttaaaaaattgaattaaaaatataattaattatctttcttaattttaatgtaattatatttaatatcctattagatattttttactattcattaatatacatttcttttatatatatacactaaatctatatatatatatatatatatatatatgaaactatatataatttcatcaaatttcgtacggatttaaaatctaatatataagtaagttatatgtgaaatcaacactgacatattagaatatttaaaagacttgagaaattcacattatagttgactgtagtttttttttcacctacatgcgcacacccgtattctcctatggttgaaatagtctcataaaaaaaatattatttttcgttttagctgtgtcattatcaagaatagtagtaactttgtaccaacaaagtttgttaaaatttggatgtcacactaacataaggatacaattttaacatgtaattcaatttaaggattaaaattgcttagttattacataagcgtgaaagcacacatactattagtgcatttaaacctattttgaattataaccaaatcattaagtagaagaagtgaaggatccagacaaataattaatgaggcactagtgacaaatataggaaaatttatttatgtttgtacacttaatagtggggatttggggataattttttttaaaaaaaaaattttaaaaaataaataattataaaccataatctaaaggaacaaaccaataaacagaccaaattacttttttagattgaatagaacaatgaaagaaacttattataacttagtgatgagattttaaaaaaccatgatgagaacatgaaagttagtttagatataagtattgagtttgagatatttgaacacgagctattataatatagactaacatatttcttcgaaatacatacggttaaactagaattctcatttcaacgaagagcaatgaccttaatcaccttataaacaagtgttaatgcatgaattataaatgaaaataattaacaagcacgacaaactatgtaacaaacaccgaaaataattaacaactacctacaaataagtgttaaaagtatattaatattttaatagaaaaatttaaggagaacacttatctcaaacctataagatagatccgtccataagtagaagtgattaatatgttaaagttaagattgaatcatttggatattactcgaattcgatctttaaataaaataattgttaattagactttacttatttttcaataaatcaaatttttttctcttaatgaattaagacaaaatatatattttgaattataaataataaaatatgaattgtaatgtaacatgtgaatccttttaatatatacacactagtttaattaattaattgtaaaaaatatgtatatatttttttattcacaaacttcaaattcaaaatttattttaaaaaatcaaacgcaatatcatttaaaccaataaattatatataaaggataacttttatcatgcgaaaccaaggccaaaacctttgagtcagcatacataaactatttaataataagagtgaaagaaatttttaaagagaaagttttaaagctaaatacatctaggataatttcaaattaatgtcaattataccatattaataaaatttttgacgggacagatctttgaaaagaaaacatctttccagttgccataactaggaaacattttcatttacaccgtagtatttacacttaacttcataggtataataaaaagatgggatacagcatgtaactattaaaaagactagtaaaacatttaatatcccaccccttatcctaaacaaaaaagaagggaaaaaaagctagggaaattgtaccatcgtatttctcctcaataaatcttcatttcttcttgatattctattcaatcatttctaactttattttcaactcacccttagattcagatgaggaggaaacaatgttgggaaaactaaagaagctttctatgtcggagaacttacagtcgaataatgtccaattttcagatgcaaatgaggattgactccctctataaaatcctgattcagcatacatgaatgaaaccatagaaaacttattatcattgaagtcagttgttgcatgaacatgtgacatatctgcacaaatcatgaaatcaaacctggtcaatatccatgttatcaaagttttcttttatggttgatattgcagctgaggtcaagggacctaaatcatcagccacaaccacagttgcagtcaaatgttttgagcttcctttgcatttttgccaactccaactttctctgttggctctaaccaatgtttggagaaaccaaataatcaattgcaataacaattctattaactcagctatgaatttaacattatggtcagcaagttcacatttcacttgatatcgagacagcactatcactcccaagatcgaatatgaaatggacatttgtcgctcgtcctacacataaatgccatgacgttttattcaagtaaataactaaattcgtgcaagagataaattaatttttaaaaaataaaataaatatttatttactaaatatattaaaaatacaaattaattttattattaaatttataaaattaatttattattaatttataatatttaaaaaccaacgattataaattatattttttaaaaattaatttaatattaaattataaaattttaaattactaaaacatcattaaattatctatacatcaattcattatactttttacattaaatttaaattttttatcttttaagattaatttgtgaccgtgtcaaccaaattgggaatttgcccttttagtttcttcgcgtttccgtttcaactgtttgcgagagaatggagttcctggacgaggacgctaggccaaggttcgtgttccagtccggtgcagcagcgaggagcaccgagccgtcgcacccgaaccacaaacctaccaagccattcctctttgccaccgtttctctctcctcactcttcctcgctctctccctcttcttcctcgaagcggagcccttcaaatcgctcctcttctggcttgcactctctctcctcgtcggccccttcgcccctccctccatcactggcggcgacgtccgcgtcggccgcggcgaggtcgtcaacttccccgatccggagcccgagcccgacgaggacgctattaggaagtcctcacaacggcgatccagacagcggaggcccgaggaatccgccgccgtaggcccggtggtttccttcagcacggcggagaagagaaaagaatcttctggaatcgagaagcgtgcgacggtggtggaggaggagaaggagtggagcgaggaggatgtggaggtgctgaagaagcagatggtgaagaatccggtggggaagccagggaggtgggaggcaatagcggcggcgttcggggggaggcacggagtggagagtgtgataaagaaagcgaaggaattgggggagaagagagtggatgattcggagtcgtatgcgttgtttttgaagaagaggaaagcgttggataagagggttgtggaggagaatgtggatgagggtgagaaagttgttgataatggttggagttctgctgaggatatcgcgttgctgaatgctttgaaagcgtttcctaaggaagtttccatgaggtgggaaaaggttgctgctgcggttcccgggagatccaaggctgcttgcatgaaaagattcgccgaattgaagaaagggtttcgaactgcaaaagctgcagccgagtgaacactgaacactctcaaagggatcgtttttttgtttaattttgatatgttaaggtaaatggattcgtcgacttgtaacttaaacacaatttttcgtttcttgctattttgagttatgatttatgttggcctccttctaggtgacactcaaattgtggttgtgtaactttataaaatgcaatgaaccgatcgagattgtgtattcggaatctcttatagtgagaataaatatttaacatttcgacttgaatcttggaacttttctggtttgcttgttgatttcattttcaggctttcagcttggtgaagttttacctattatctgaagtctttacctttttacttttatgccgaatgggtttagactctaggtgccaggtttttgttatttaggctcaccttgctgccaaccattcccctagtttagtttgtggaactttgatttaactctttctactgtcttggagttttggattttgtgcatgttcgtcacatagagcctttcattttagcatcctattgtgttaagttctgatttgtgaaatgcatttatattggatagtgatagtttgggcaattggactttcaattacttttgttttgtgcaaggtgcttagtgcctactgtttcaaacatggctaataccttagcaagttgtgttggtttgcttgggttatacaaaagtttggccatgtgttttatcagctggttgctagctttactaacccatttaacattactaatctttaagtggggtgtggggattgccttcttatctctcgctaaatttcagtttaagtgctccacatctaattgctagcaccgtattggggaatattgttttcgttcttgcattgtggatttagggattattggtttatcatagggattattccacttgcactatgctaatttagaaaattacactaacctctcatgctttgttattttaaggggattgtgtgtacagtccatagtccatactctgtaaataaaagtgagatagatgtgtgtaactttctacataaggataatatataaaataagggaagtagttcaaacaagcaaggtgtaagtatatctagtgtgctaaccttaagggaggtctatgtaattaatcctttatgtcagatgatcttatcttggaaccagttgcgtgttggtacaattgggtttgaaattttgatttcagtatatactactataatattaccagagtcctgaaacttgatcagtgtatttggctattgaaaagttacatcttttacaatattgcttacagataggttggttagatttagtctcttggaactttacttgtcatggacactgaatggcaacttagggcaaagggggataaacaccatctcatctttctttgtctcagtttggttattatggtttatgtggatactggatagagcttgctgagttctgaattatttcatacttctattagaaaattcagattttaattcttagccaacaaaataacagttgtcatttaaagccagatctggttttgcatattgctttggctgactgcctgtcatgtttgacttaactttagtttttcatattgaaaaaacacctttttttaagctaagaaaacgattagtttgttttatccggaattcttttttaattttgggtctaaaggaagtctcataactttagtctcattgttttatccggaattctttctaaattctttcaccaatcgttgcattccgtttctgggtgtcaaaccaatacaatactactatcaagcaccatctcattatcatgtaaaacttttatacaataggctaagtgattgatttgatgtttcttagtgcatgtttggatgacttttaataaaattgattttggatgaaattaatttacgaaattgattcagttaaaattgattttaaagtgatgtaatttatgtttgtatatttttattataaaatcaagttaagagtaaaattcagtataaattttatgatctaacacaaaacctactcaaagttacttaaattcataatcaattgtttaacattaaagcaaatacacttattttaaccgtcaggattcccaacaagaaaatatggattatgatcatgcattctctcttcttgtaaagctcgatgttgacatagttacatataaaaatcttgctgatgaaaggaggaaataggttattaagctcaactaataaatgattaattttaagatttttcaaaatacatattgaattataaactaatttataagataattttcaaagccttaactaatactagtaaatctgtacaaaatacattgaaatgcccaatactgtgattctcctagtcatatcccattcaccataattgaatgaagaaacaacacaaaagccacttaacctatgttaacaggtcaataataaaatgaaaagaaccaatctatttgaccttgtcattctgataagccgttggtacccagattgaagccactgtcaaaggccttgacttccaacacaaggccgacctactcttctcgaattggacccaataccctccaccaaagaggcttaccaagaacttggcttgtgaaatattacatgtactcataggaacacgtttaaaccctttcaaggaataaaacccttcgtcccacaccattatctcctttctctcacaaggaaactgcctcacactgtctaaaattctgagccccagaacctctttctcaatcagggtcaactccatcttgtggctaccccatagactactagcaagtgaatcacaaagtgtagtgtagtgatgcaaagcctcacagaagaactccacaaaggacatggacttgagcctagaaaaattaaatagttcttcttccactaaaacaacaagccttggggacaattttgtcacgccatccaagaaaattttgaccaatgagaagctcctattaggcatccactgatgtatcatgcagttgactataagtgtttgaccaagttcaattccttgaaaatcttcttccctttccatcattaactggtcaaacatgaattaaaagttgatagaagctgcaaactctttgagccttcttcctgcttgttgagcagaatcagcacctctcaggtccactgtgatggctgttactctgaggggagtagcacttttcctcattgcaaggtcaagtatcaagggtggccactgaatcccctccatgatgtcaaaatcaatgatgtgaacattctcaactccttctgtggcttctaagattgcttggtttgcagtgaaatgagcaaatttcacatagggagagagttcttggagaacctgaaacacacagaaagcatttgtgtgtgtggaaacagcaccacactgtagcaattcaggggcatttgtacttttataatagagaccctgagtaaagaaaagagccaacctgctcaacaagccatcaccatattctaaagatgaggcattgttaagtttctcaattatgtctgaagcaagagcccagttctgtgcttcaacagcttcagctcctgttagcaacagatcagctaaactagtctctttcattagctcttcttggattcccttcaaacaagaatccccttcttccattgaaaattcagtctctagtggatcattatggttcaagaaaccaaagtcctggttgtttgcatgttggtgcagcaatccttccatggactcttgatcaatcatttcatctagaaaagtatttggtaataagagatcttctgtttgaaatggaaatggattttctaagctacactcatggagttgattcaagtaaggagggccaaatgagtaaccagattgctcgtaatccatggcattcatagcagatggtgaaaaaataaaaataaaaacaaaaaaggcttaagtggtacacctgggtagaaacttaattcgagtactcttataaatagacaacctaatctcgaattatgatgtgtattggacgttgacaaaactgcttctagaagtagcttaaatgataggaacggagtaagattggtatcagcctactaggaaagttgaaagcaatagcccaaaatatgcttgtggataatgtatacgggaatatatgacaaaaatgtatgtatgtaagaagatttatctagtgaaaaaaagtattttataagagagtgtcaatagcaaagaaactccagacttaattatccctaatattagttttgtcaaattagtagacttgcataggtttttgaattatagattttaattaatggaaaaattgttatctattgaaggatgtttaggagtgtggttttaatgtttgtatcggatcattatcgagcatatgaatcaattgacgtaatattattttagtttaataaatgattgcaagtttgaatctctgaatatacaatttatgttaaatacttgaggaataattttgtcatccataataatcttatataattgaaacaattttgtttgaagtgaataatatttgcggttgtaaaaaaaaaaaaaacttcatgtgcaatttagatttgagtaatctgtttgtcatcataacaggtgatatgatttcacttgtatctttgcttaatatccctaataatgatttgaatgatcataatagtaagataaataaaagtgaaagcggatgaaaatgaaattggaagttaaaaaaaactaaaactaggtaaaaataattaattaaagactaaacatcaaaatttgaattttataagaactaaaatcaaaatttgagaattttcttaggacgaaaaacacttggtcacataataattgtgttgtaaccatttcacacttgtaggccatgtagctcttatgtcaacgcgtaaccaaacccatttgacaaaaggggtgtaaatatggacaaaaaagttaataatagacgaagattatttaaaaaaaaaaatataaagagtcatttgtaggagctaaaaacaatatttaaatcctaaaaaatacatattcaaatttatttttaattcataaaaacaataatacaatttattctattgagtggatcgtgcacttttaatttttgaaaaaaatatttagatataaaaaaatgaatgttaatcatatattcttaaacacactttttttttcatacattttgcttttaacttatatttattagaaatcgtaaaattatgaataacacataattaaataaagaataaaacttgcattattatttatctgagtgataaaactctcctttttgagcatttaacgtgctcagtggtttgagataattgttctcacttttatataaaagacagaactacacaatattaatggataattgtgctacacaaattctttctttaactataatggataaaaattaacagaaatttattgtatatttttcacctttgataactaaaatttgaatttttatattttaaagataaatttgttaatattttatatattcatgaatgaatttttttttaattctttatataaagattcagaaaatattggatctccaccaacacaagcaaattgtcgataaaattctaaaatgaaattttttttgaccctatttttttttatccttatcatttaggaaagacatgaaaatttcaggataacaaacattctctaagacaaaaataaatatttatccttttttaaaaatgtgaccaaatttttttaacaatatttttattaactattagataaataaatattaaaaatcagatatgtaatagtgtgaatacctccctcaaaacgagattaggtatgcactgttaagctacaaaaagtatgtgtgtgattcagatatatttttatatgcatggtaagtgacattttgcaagttgaactataatttcagtggcgccttttcttacttctcaggccttcttagccctggtaggaggaaaataaaagggagagaaggcattaaattaatttatgttgttcgatgcatgggaaaagagtaaaaatatttttaaaaatggtagaatttattgtataattcttcacatatttttacttatctatttttaactaaatattttttatgtctattttatttttatattttttattttcattcaccatattttttcccacaacattaaacaaacggactctaaatgtattatggtcaatgatacatcaatgatgtcgtcatttctgaagtaagatgtaaacatgtcacatattaacgtacctagtagcctaataagaacaaattagcatagagacgttttggttggtaatggtcgctccattggtcccaaccctccactaatgttctctcttaacatattaaatgaaaaatcataataccagccaaagtaatgggttcgtagttgtacttttgtatgtaattgtcacatcatgcgccttccttttttttaattgcagaaggctcaaggcttcatttccgggaaactcttagaaaaaatatttgcttgatgggaatggaaaagaatagaaaaggaaattacaaaaaaaaataaattgtgtcgagagttgtgagctgtaaaatttaaattatttttttaattttttaaataatgctctttccattttaaaataattgatataatttattttatataaataaaaaataaaataataattttacaaaattaatcttatattattattagtttatttataaattttattattcattattagtattataatgttataaataaaaaacaattaatattatattaaagcattaaaataataattattttaaaataatttttccttttatacgatacttaaaataagacggatggaataatcttttctttccaaccaaaccaaggatgagagttgagaataaattcatgccagaaatgtcacgtgaaaaggaggatcgaagctccactatataagttaatgattacgggtcaataatagtttctatctcattccttaaaaaaaatagtttctgtctcataatctgtgacgctataaatttatcccatttacggtgagagactggtttttaattaagctaaatgttaattaatattttaatgatactagttaaagaattaaaatgtttttttattgtaatgtgaaaaattgtgttatccaaaatatttttacgtttttcaataatttttaataaatatttttaaaatattttaaccaatattaaaggatattaattaataagatcttttaattaatagttataatttttattgtattttctaaagtaatcttgagatcttaatgaatcaaattcgcatgtcttataattttagaagttacaggaatattttgaaacatgaaaaaaaaatatggtgcgtgtggcgtatgtggttcccctttaagttaacctttttctctctctaaaagtttgtcctttttttcttttcctttatatcgatcactatagttacagtctttttaaaaatattttgttatcgttaaaagggcatatacgcgtggtatgtaattaaaaaaaatcaaaattaattccctcaattttaactgagtttaacttgactaaaatttagttcaagtttgactaagttcaattatgattgattaattaataaaaataaaaatgattgattagttaaattaacaaggaataagtatcttaaatttgcttgtcaaataaaagtatcttaaatctcactcatataatcttacataaaaaatatgttttattaatttgattttcataaaactttttatattaatttggttttataaaaataaaacatattttttatgattttcattggtaattccattaaattataatttgacttgactaataaatttatatgtgtaatttaattataaatgaattaaataaactgtaatagttaaacccctcaaaatgaattaaatattttttgtggccaaaagtcccaaatttgtaaatttttttcatttttgagcaattttcttacaccttttttatgagattatgaaaaaatacgaaacaaaaatgaattttggtatcttttgagtatatttgaaaaaataaaaaaaaataattaaatatattaatcatataagagaacggtctaacataattactatggaaaaccataaaaatatgtttatttttatagggaccaaattaataccaaattttttacaaagatcaaattaatacttttaaattttttaggaatctcatacatgttttatcctaaaatttttatacaacttctagtccttcattaattttctgattgaaattatggttcttctaaattttttacctatttttagtccattgttatttttattgctcaaaattagtcattattttgtcaatttttagtctaatcccttgtttattttatatttcaaactacctttgaaaaataaaaataaatgaaatactaaaaatgaacaatttattttaaagaaactaaaaattatgacaaaattaataaataactaaaagttgtcagacaaaaaattataatatgaaaaagttgagaaattaaaaatttaactaacccaaaaaatatataatcatatttgacaatcaacttatcaaaattaattgttaataaaaaggttacatgaccacttaaaaaaatgtatatttatcttttgatattaaccatacaaattatctaatgtttaatgtttacaattttcatttcttacagtaaaaaataatgtattttagatcttttaatgtatgaatttaatgcggcatctagctacaaaatggacattataaagaatataatatacgagaatctaaactaattctaaaatagaagattgaccaactaaaacaaaaacaaaagtaaaaaaaagttgggcccgttggcccaattctccatggtcctatcaaagaaggctgaagtgcaaatttggagagcagatagatgcgcatacgcaaagcaaaaatagagaactgcgtagcgacccatcatagaagatcacgatcttctgaaacatgtctggggaagaggaagaaaacgccgcagagctcaaaattggagacggtaattaaattctctcatagggatagggctagttgctccaatctgttacaccttacgcattccgcaacttttgaagccctatattgtaatttctaaacttgaattaggggaatgtttcatgaagactgacatagggttaggttacatgtatctgaattgaggaaatcctagccctgtatcgtaagcgtcggtcatttaatttttagtttataactttatgaaattctcattttagtcgctaaagtgtaaaatgaagtggataagtgatataattaatggcattttgtaactaaagtgaacaaacctgtggtatatatgctaaaaaccaagtcattggtgagaattttgtcagtcgctttattaaggtcagtgccatatgtacgaattagcacaacttttggctcagagtctcccctgatttgagctatatatttccttgctaatgccaaaagaatttcaaaatacaagatcttgttggtgattcggttttcacatcatggaaatgtggctattaacaatttgtctagttgttttgaagtgggatgaaaactaaagagtgagtaaccattagagtagcaagccagtgttcccctttgacagtggccattttcacagacatggttcccaaattaagagaaatcaacctagaaaagaattgaatatgacaaaactaaattaatgtttaagacactaataaaattatggaagaatttaagggtagagattagaatcatagataatgcaggaagtaaactattttttatctttaactgaaaaatttagtaatttgtactttaattcatattgttttgaagtttgagctgtgctatttattcctgaaaatttaataactaaatgatttgtgtgttttatttataaatccatatttgatgcatcatgctccttgcacaaagctatcttacatcatcagaaatctgattgattttacaatatatggttctattgtattgtatcatgtttgattgcttgaagccttgaacatgtttttacatttggtatttcaccttttgatttcacaataatgaaatagtttttttctcccagagtttttgaaggcaaagtgcttaatgaactgtgaagttgcattgattcttgagcacaagtatgagcagcttcaacagacatccgatgatcccatgaaccaagtttctcagtgagttcaattccttatcaagttcatggttatttaacacaaagatcctggtataatgttttcggatgctcttggaataattagcttttattacaatttggcttacattaattcctccaagatcttgtcttttattacacagttgaaaatgtcttccattttggtgtcctttaaatgcaattatattaagttataaaacatgtctgcaaacttcctgatcccaattgacattttggcagaattagatttgatattgtcatattgataatgagatggaagaggagcaaaattgttggacatgattcccaccttatagcactgattgtttttctcttcttttttctctctcagggtatttgaaaagtcgctgcagtatgtgaagcgtttcagccgctataaaaatcccgatgctgttagacaagttcgagagtatcctcctaaaataaattgaatagcccgtaacccgtttgtcatttctctttgtccatacatttactttcggttaaattatgttgaattttgatgtaaatgtcctgttcttttataaaaatttacctaagtttctttcatattgttattgactttttattgtctaatttaattttggattttccttcaattaaagtaatatatgtcttttgataaattaaaggaccattgtatcttatttagttctgctgagaaaaattggtctatgttaattcctcttttcctggaaggaaatgctaagaaacctgattttattgccatatttcagaattgtgtgatcttaactgacatacagaattctcgcaagatatcagttggctgagtttgaggtaatacacctacttccttcatgaaatgagttaaggaagcaagtgttcacattttattttgaaaaaagttgagtgagtagtcagttcacacttcacacattacaatatatgattctttgtttaaatgaatctgttgcagttgtgtgttcttggcaacctttgcccagaaactgtggaagaagctattgctatggttccatctatcaaggtaaaaataatttgcttctccctctttttgtattaggtatgtttggttttcttttgggaatgatttccattctctctttgatgcttgttaaaataaactgggaaggaaatagagtatttaataaaagaaaatatgacaagtttttataactttctgctcttctaataactgttaaaattcaattttgacatgcaccagaaagtgtataaaataatttagtttacataacaccccgtagtggagaacgcacaaaaagtaaatgctgataattgaaggatttttgttatgttaaactagagatctcttacttgcatctctccttaaaatcatctcagtaacggttcccttcatttacccccctccccccaacccatgaaacttcggtagcatagttctcgttatttaccctcacaagcttatgtttgccacactgagcatgtttgccatgcgttggttatggtctacgcatgaggtttttttgcgtttgcaggtgaggcaaccagttacttggaatattcatgctgtattgggttctttgaagctgctaagcaagttatattttgcatgatatatctgaatactaaacgtaacagccattaaatcttttacgttaattaatgcatcattttttttgcctgcagtcaagaggacgggctcaggatgatgaagcaatcgagaaaatgttaaatgacctgtcgttgattaagaaatttgaataaatacgtcagagtgcatgatataatgttgttggtaccgtataactgacatatttagttcattttgtgacttttatcgagtaggattttgacacatgcgagctggtgtatgaaagtgcttttgacctgttatgatgattctgcgaatgagataattgtcttactataaccacctatttatagcaagaagatagattattatcctttaagcgatgactgggcaggggtaaaggaaaaaaatttacgtaagctctggttcctacgaatgtttcgcctagcactcgtcgttactcaacaacgtggctttatcaagtgaaaaccatcttacgtatggccattaactagataaccttcaccagtcagcgaagatcagcgtaatataatggtataacaagatagtgcgatgaattaagacagaaaagctataaagtattcaatattgaaaatacattgaatccagaattatgaatttaggattcgacaaaatgaaattaaaagggagtgtaagattgaaccttattgtcattatataaaaaatattgtacaaaatgttgataaacaagttcttgacaatcaattttttgtcactattaataaaaaaaattgattgactaattttaataagattttttaattacattttttttatcaataaatctttaacatgaggccgtaggttacatgtctaacataagttatatgcaaaccaacacaatgttaatagtaaatagctgacaaataatgcaaactagtattttagcatgtgcattctacataataagtgtttattttataccactaaagttataatttacaataaataaatatttctaaatgtataaattatatttaaattaaaatctgaaagaaatatattttaaaataaattatattttagatttatgacaaatagtttatttgtgatatattgttatttttaattattgataatttcttttaaaaaatattcaaattcttgttgaacatgatagattgaaaaagataagaagttgaattgttttctttgatattaaaagtataatatgatatatcttatacatgttaggatcatattttgtttttttaaagtaaaatacatatttgagattggtttataatattcagttatatattgtcaaaccatttaaatgatattaaaatttaaaagtataaggatatatcaaatacatgttaagagtgtgagatccatcacttcatgataaaagagtattcaaatgaaagtgaatgggagagagagtagggagagcgaaagcctgaaaaaataaaaagacttattcctttatataattatatataatatttgtaatttaaaataataaaaaaggatatatctttaaatttttctcttgctaatcgtatttactaacatgacactcaattattaaaattctaagtgtgattttaaattttctattaacttattagagttgacccataaaatctgggcatatataatttttatttgtaagaaaagaaaatatatactacatggtcatgtctcaccacatgtaacaccactccacataatttacatccttaagatagaaacacgaaacagaagaggatgaaaatacttttatttttattttttaatgactcctgatttagatatgatatccatcaaaattgatgattttaataatttttaaccaatcacataaaaagtgttggaaagagaatgttagagaaagtgtcattagctttccttattataagaatacaatgagaatacccacaacccccaaactttgttatacgtgataattacctaaataatgacattttattataaaggaaagatcaatttactccaagaataattctttgagttatttttcatcctcattattcattttcttgaaatctaatgattgtaaaacgtaactaattttaaccattagatttcaaaaaaatcaatgattaggatgaagaataacaaagttactcttagagtaactagattcctcctctttactatatacatacataataataaatacaatcaaaggtagtgaatctacagcctgtagatgaagcttctgccttgttatatacaatatgcgacattagcagtttcaagtatttttacacaatataaggctgtaccatgccagccagccagctcagacctgatcatagatcaaaacttaacagtcataaagacttaatcatcatatttacacgtatttttcaaaactaagaacatattcttcaactggatggaccaatttatctagggggaaagaaggcttaaagcttacatgtgttttactgatttaacatcagcataaacgccatttggcagaagcataagtgtaatatactatatgatatgtactactatatctggtgcttactacctcgcgtaagcaacaagtttttcatttctttgtaaccatggaattcttccaatgcatcagctgttgttttcctagaggctatgaccccagaagacattatgctcacaggccttgatgccttaaggatctgattgggccctcgagtgttattgttccaggtttcagggtgtgaaccttgtgacacgtgttgtgaggtggagaaatcttgacgtagaggtggtgcttttttcagcatatgtacaagcgcaccaacagcagcatcttgagactttctaatgggaaagaatcctccagcttcaagcgtctcagttatatgaccatgatcaagatattcagttctggttatacacaaggaatcatgttacaattgctaaattaaaacagtctagcaaatttatgtcatctataacttatagaaaaaggaaaaaaataaccagattatatgttgttttctttgaagtttgactcagtatagagaaattatacatgaatttgtaataagcacaaggatctaggtgaagttgtgaattgactcacaaacctgaaagtagacccctatcttgatggataacaagttaacagctattcaaaattaaaattaagatgaaaaatgtgttctgccagtcggatcaatcaaataaaatatagcacaagaggaaacagttgatagatttacaagagtgagtgactaaattacatcaagtcaggatgttctacaaaaattgcaaacagcctactttatctagcaaattctttttcaagcatgcaacactagacaccagatctacaaactaattcttactataaataataaatgaaaccaatataatctgaaatcaagatgctttttctactcagatacaaaaaaccaccacgtctttgccttcagtcatcagactgcaataccagatttccatgccctcacggatgcacccaaagttggcagcaggatactatggcccctacttggtgttaaagcaaattggggcttttgcttttcagttgcaacctccagagcttgcccaaatccatccagtgtttcatgtttcccagcttaaaaaaacagtagggaaacactcaattgaagctaatccacctacagaattggaagtgtaaccctagcatatctccagcaggtatcttggagtataaaaccatcatacgccatggggtccaagtactgcaagttctcactcattggcagggtcagccagctgaggaagcaacatgggaagatgtggtggcaatcaaatggcactttctaaccttcaaccttaaggacaaggttgacattttaggcgaatgtattgttgggaaaggaaataatgagccaaaacagagaacatggaaagtgtatactagaaggaacaaagtgaataagtagatttagttagccagttaaaggggtgtataacagaaattgtgtaagtggaaggcgactttttgggaggattagaataccgagcaactactctggtataaagggaagactctttggagtaggttaactccttgaatctgcattaaataataacagaagcctttttcaattctttcactttcttttgtctctactctcctattgaactgataaactcagttcttacatcctacttccatggatgacatgaggatgatccccaaaaccatggcctccaatccagtgcagaatgctcctatcttcaaggatgtttctccacctcttaacatgtcatggaccatgttgtgttggtgacctctctttggtattctcccttggctatttcaaaggaacttctatttgaagtttcaactatgcaaaaagagattgggcaacatagcagaactcttggatttctcatattcactctggtatattttctttttctttcttggaggatattttatagcttgtttggttttagaaaacattttctattttcacttcataatttcacaagtaattgacaaaatgtcaccttatgttcattttatttcttgttttcagacacagacttatataggaaaagtgaaacaacaagatattgttttcactatatccagtacaagtctttgaaaacagaaatcaaatgaaaataagtaaatatttgtgaaaataggaaatgtaaatataataaaaatcctcttttctttcaaaattctgtttcttctagaaaattaaaataacttaccatattattaattggtaccgaaatctaatcacaaactaaacacacacccctggccccttcccaaaatgactgactccctactatcaacctggcagtcgaattatccttggattagaagccaatatgctagctctccatacaataaaaatctctagtcattttacataatagattggtcatatatttgaatcaatggtatgacagcactgatgttcctgaaggaaaacacacacccctctccactgacaaagaactgcggatcccttattacaatcaaataacagttaggatacatatgatcctgatgatcctggtattttgtctatttagccctctatcatccgactgaattttgagacataactagctgaactggatcatatttttgccagccagaaaatcaatagaactatagaagggagaacatgatgggagggtgcaacagtaaacagattaatgttgattgtttaagtgccatactataagacatggttaaagaagaaaaagtcaggaccagcagattcattcactgcaaatatgccacatcaataacttatttttggaaagtatagcattaaataccaataaaatacactttcaaagatggggtaaaataaaattagaaattaatagtgagtctaaaccatttcaatagtatagtcatttgcatacacatgataaacatttacacaattttgaggagcaattgtgaggccaaaaataatttgaagaaaagaagaatatgcaaaactttcaccaaaatataggtgaagccaaatatttatgcatatcaaaagtaagtgtgtttaccaattaatgtctagatgctaatctctaaagtggaaaagaaggaaaagttataaacactgtgttttgatactacttgtcaaaaactgtgcacaaaacagaaataatgaaattaaaaccctagagcttatttcttattttgcttctattttttaacctgttagtcaattttttgttccatttctagataaagtgttacacataacttgaagcgcaatcctcccagaacccccaagtgtattaacctagactttcccagaccagaaacaggaaatcccagtgggatggaagtgctcctgttcctggaacctgttcaacctgcttacccccattatggatttagattgtctcctatttctgaattaaaaaatatggtcaaagagaaaggcacattttaatgcaaggacccaccatgatatattgtaagatcaacaagtcatattcataaagattgttattctctctccagcaagaccatattctgttattagcatatctagcttatatagtattcttatgtaaaaattagcatataagcaaaacataaatgcaagtgaatttcagttatgaagtacctgcttcctggatctgtcatatcatcatcatccacatcaaatggacaagtaaaatcagtatcatcaaaatcatcctgataagacctactggagcttctggaaattgaaatctggggcgagctgttagcagatatcttgaccccagaatattttcgagactcatcttttccaagagaaaacaactgcagaaagtggaagacacccttaacaaatcaaatatactttgaactatggaaaaaagtacattgtggttagcacacacacagcataccttctcagctgttgttcctgtttgcattgagcttctatcaatcttagcagtgccccttgaacctcttaggggaagagatggaggcaaattatgcctattggagtatccaggggaattagcaatttcagcagtaggtatgctgactggagcactttcagatcgtaaaagtggtttgcatggaaatggcgcagaattagaggttgaaggtgatgcagagggataataatcctcaaagtttgtattcttcttctgaatcatagacatctcagttggatgaggaggcaaacttgaaggggggaaacgctgcaaacttgcattatacactgatgagtgtgattctgaatgagtaggcgaaggtaaataagaaggaggtgaggctctataatgatcgaaactccaactacgctgccttgaagatggcaacgatgatggagagccatgtgatggcaatcctgcctcgggatgagaaggaaacctccttaatggatcagccaatggactcccaacatagtcagttataacttgtggggacattggtgtcgaaggttcagagctcacatctgaggctgaggggcaatacatcacactaagacacagcctaccagaagaagtatccacaggggtgaacccgaatttcgtcatttcagcctcttctttccgggtgaagggctcaacaaaagaagacacacggtgagcaagggtgaagtccctaatctgtccagacgaactaagctctctgaaaagtttataggcaggtaaaagtctaacagtgacatacaaagaccttagaagcaaagttgatttcttatacaagttatgcaaagaaacattgcttgacctcctactgccagaattagaatcccttgtcttcctactctcatactgcacaacccacctctccacaatcttttcagtccttcccacaacccccaattcttcctgatcagtgttccagccaaaagggcatctttccttcagtgaagaactcctaggaagaacccgtttgggagaaaaactcacagtcacagggtcccaatccggaggcctctgcaccaaaatcacatcaatcactatgcactcaagattgttctggcgccagaggtcaatgttctccaacgccgcggggcactcccggagtgccaaattgaaccacttatccctcggccgcacacttgatgaagacgaagacgacgaacacggtgacgaaacaacttgatcacaataggaattgcgggaggacgcatagagtgcccttgattcaagtattatgtgaaggctcttcgcgaagaactcggtgattatttgttccatcttcgcagcatccgaatgtgcattaccatgagacgatgccattactttcaggtgtcaacacaacacaaccctcagaaacaaacaaaaaggtccaattttcaccgttagcttagacccccaactgcagtgcgtttcaggtttcactacatcaacatcacacacaacaacttcggaattcaaatgcaaccgaatcatccatcaactccattactaataatactaggttgtttaaaaagaacacgacaacaacaacaacgtaaaagggtgttcgattcttccctatatttgaagaattcgatagcatcacaagtggggggaaattgtgtggaagagagtgagaaaaagagagagattagtgtgcttacctgtgcatgtgagaaagggttggatgatagggagtgattgaaagggttgatgtggggatcttatcctatcacttagaaccttgatgatttctgttcagtttctgttatgtgagtttacacgaaacgaaatattatgaatgaagagtgttgagagaagcaaagcaaagaaagtaggactggctgaggagtggaagagtgggaccctttggcagaggccgttgttggctaaacccggataggagtcatcccggattggtttgaatcgattttggttaaatttaggatccagttcaattaaatttgatcggttcaatttttagaagaaaaataattgaaatttaatcaaatcattcataaacaattgagttcgaatcaccgggttacccatttaatttttttaataactattattttatatcacgattctttcaaatatctcatacaattaacacaatattatcaaatgtatggaagtagtaaaattgattcattaaataccatcaatataatattataaaataaacttataatataaattatttgtgaacaatattgattataatagtctaaatcacaattgtttcttacaaatcaagctttgttataatcaattttgttgcaaccatatttgctgaaacaaacaaataaacaaaatatgattcattaatattataaatatgataaacaaaatatgaaaaaaaaaatgtgaactaaataacaatatacctgaaagtaatacattaagaagtttcagcacttgcagtttcaatacttggagacccaataaaagaatagactgatatccttgtttcccagctacccttacacaacaattatctcagctgatatccttgtttccccaaaaaagctcttgtctcaattcaccaagaatagagataaattgatatccttgttttccaaccagacttgtatcctagtttgccaaccagaagtcgcatgtctcaatttatcaagaattgagacaaaactggtatcctagttcccagccgtgaccttttccaaattcaagaagaagaatacaataaaataattacatttacgcgtatattccttaaacaaatacgtacctttaaatcctgactgagagttgaagaatcaaacttgtcaaacgcttttatacgatctcacaataattcattcaatgatgcaaacataaactctctaatactttaatattatttggaatggaatgcatacatgaacaccaaaatatatttctatttatactaatttaaagatatgattttaaccaatttttgaatgcaatcctaaatatattctatcatattatccaatgcaatcttaaagatattctattatattatgcaatgcaatcttaaaaatattttatcctattttttaatgcaatattaaaaaatatcctatcttatttttgaatgcaatcttaaacatttacaatatcatacatttttttattgtcaaattatttttaatatatatatataaaataaaatttatattatcattacgggttcacggatcgggtcatcggatcaacggatctgtaaatctaaacccgtaactcaacccgcacatgaacggttcggatcggttttgacccaaatatataaatgacccaattcaaactgttcagatcagttcgggttcacgagtgactcatacccgtgaacacccataaacccggatacatagcatgattgaaataccccatcattttaaatatcaaaatcctatgatatgatctactatttctatttgatatattatctttatcgccatttaatctcaaaattttaaaaattgtttattttaatactctttttgtttgaattaagagtgaaattaagaaaaagaaaaataggttagaaataaaggaaaaatatattacttcaatgaaaataaatacaaaatagaaggaggggagaaatttctccacctttagttggacggacaaaaaagagagtgaaaataaatttgataaaaaaatattttcatagtactaattaaaagaatattatttttaacataaaatatttattattttaaaaaataaatttaaatatttttagtccttataaaatgaacaaatttttattttggtccatgtaaaaaatttgtttttgttttttattcttctaaaatttgaaattgttatttttttattcctttaaaataagtaaaaatttgttttggtcgtgtaaaataatttttttaattatcatcatttcaaaatttgaaaccactggttttagtcctaaattaatttattaacaaaaaataggtctattcttctagtatcaattttatcataaatgatttttcatctttgaatctttgaaaaaaaatcaaattttatgataatttttttgttttgttttgtaaatgataaataattttatgagtaaaaaatatattttgtttcatctatgaatcttcgaagaaatcaattttttggaatgattcttcagtcttttgaattgaaacaatatgtttatatttttaagaaattatataaaagaaaatcgtatctataattttgtctagggttcataaaacgttaaagcattccaaaaagggattatccgccctacacttttatgcgaatttgtgcgaatgtcaaatggattgtactctgattccccgaatgcataatacttcacttttccctgccatgccgtatggcccgtatcccatttatcatcccacagcattggagtacgtcacaaatcacaaacactacaatttatcaacccaattccatactccttactgttgttgacctttcatattaattcattttgtatagtgagatgccaacagcaatattaacaatatctatgatctaaattaattagatttagtgataaataaacctaataataaatataaagaaattgaaataattaaaaaaaaggagaaataagacaagataaaaaaaaaataagataaaagataagaatgatgaaaaaagtagaggaaaagtgaagaaaaaaataactagcaccatctggaatatagaaataataagtgcctaaccctccaccaaacttataatttttcttcattctgtcttaagacatatttttcgccactctatatatggtttatctctacttctgtgttgaacttttggtaatagactcttatttttacaaaagcaatcagggactgtctcattacgtgtctaaatcacttcaatctatgcttcctcatcttttcactcaccgatactactgatacctttcgtcgaatattttcatttcttatcttatctatcttcgtataatcacacattcaccttaacatcctaatttttgttacccctattttatgtttatgttgtctatgtgttgaccaatatttagttccataacattataggtcttacagatgttctataaaatttttcttttaatttaaggaaaattttgcggtcacacaaaaattcagatgcacttcgacatttcatctgatctgattttataattttcatcattatcaataactccaccttttttgcaaaattaatcccaaatatttaaaaacatatttttttatacctattgaccaagtagatgcacaggttttgattatcatcttttactagtaaaaactcacactttatgtattcagtcttcctctaacttatcatgaattctttgtactataaagtgtttctccacaattcaagattcctaataatatcattttttatctcattaataagtataatatcatatataaacaacatagagtataacacttcctcttaaatatcttttgatttcaataaaaataaattcatatgaccaaagactatgaactatgaaaccaatatcggatttggattccgtgaaaaaacaacatatcggatttggatacgatgcaaaagcaaaaaatgcctccgggctcgatactgtaatttgggcccaaattcctatgttatttcctgcacttcctttttccttttggaatgtccatcctagaatgtaataacattctgaaatgcacttgcttttttatttttggaataacaattccataaaaaaaaaaaaacattctgaaaagagtacaaaaaacaacatgggattgcagaatgtaataacccatttacaaaattttcaagctgcagaattttaagacttgtgataagagaagaaaaaaaacttttttctccactttttattcttatatctatatttagggatagaatgggttgatacttataccaaatgtcatccttaatttcattgaattttatagttaaaattattccacataaaaacttttaaaacaatattgactaaagatgtcacatgagaattttatatgcattatatattttatgttgtttggaagttactattttgggagtcgctacttcagttgtggtcttgttctctgatgtcttagtttcatgtttggagtgatttttgttttcattacagtattcagatgaagttttgtttgttttaagctaaaaaccttaataacaccccgtccttaagtttagttccattttactcttaacaattgatttggcttgccgaaacaaaaacttgatcgtttcctgaacactatcttgtccccacgtgtgcacacaatctgataaggtaaaggcttacttttgagtccctaacctctcttatctggtgctgattttcttttagatgggcttggtccattttttattttcctgaatgtttcttttctttttcttgttgggcctggctcatttgtctttttccttctgtttttctctctttttttaaatttgccgggcttcacccccttttttttcttgttagacttttgctaaattcacgtcccttattgctaagtacacttccctttttatttttggcatttcccccctcaaaaatactcttttcaggaatgtgtttaacacttccgaaaatgaatttacggatgctaaagttaaagctttgatctctgtatgttagtgtaccccaaagtatttaatcaatgccagaggagaagccattggcttagagagctagaggaattccaaagcgaaaaataggaccgtccacctcgccactctctttttctacataaaccgattagtagcactttactttgcagttccagaatcaaccaaggcctcagctatgtaagaaattatttcaaattgctatatggcacattctcctgcaattatttacaaacccattcacaacatcattaaagcccctgagaaatttgatttcaatagcatcttggtaattatgatacattgattagaacatgcttgaattttagttagaatatgaattattaatcaatcaacttctactagaccacacatacatagtcaataattcaaatatacacgaaataaaagattgacatggtgataaaggaacaaagaaagagaggagacgtcgtgaatttaaatcttttcggtaacaaaaaaaccaacaattaatcactaatatttgtttataaaaaaaataattcaaatacataatacgttgattctacataccaagtacgttagggtcatacctgcaaagtctagggtgaaattggaaatttctaatatgtaatatgtaaaaggatcaaaatttagtattcaaattgctccatcattttgggaaatcattattcttttctctcacatcaggacattcaattgtaaatattgtaaatttgtaatatgtaaaggacaaaaatttagtgtttttcaagaacttcttccaattataatttcttattagagatatgacgtctcgtaaaaagaagaccaaaacttagtgttattcaaaaaccttctccaattataaattcttatcaaagagacatggtgtttgataagaaaataactaaaatttagtgttttccaagacccccttcaaacataaattcttattaagatgtggtgcttgataagaatattttattttggcaaccttgatggagatattctaacggagtagattggtttgtcattggaatctatgtacgagattacaagtctttttcgggataaaaagtatatcatactacttgcatcagttgcatgtataatattagtgtctattgtaccgcaatatattaactccgtgattatgtgcagcttatgtcatctattaaggtttgagaacacattgtaaattcacataaactgagtatcttttaagataagaatgcaaaatgatatgttccttatggatatagccatgaggcatccacgtgtctatgcatcttcaaattcacttttgttcaagagatgcacagtgcatgagaataattattaaacaagtgaaagtccttgtaggtcttaatctacgtatcgtaaaataaaataataattaagttttttaataatatttgatgttttttaaaaagtttaacttttagcttttaattttgtataatttttattttaatatgttattcatttttttatcaacttttaaataaattattattttattattttatatttatcagttattttaacaattatttttatcaaatatttataatttaataaattaattattcaatttttaactaactttttaaactaattttatgcaacatgatctagacatacatgcatcaagtggggcgacctaataatgaccaacatcaatgaccaaaccacagaaacaaaaagaagaacagcaacctagcaaaagccaaaaagcgaattgaaatactaattcaatactcaaaagagctctagaaaaaacaaataagatcttgggacgatataatttaattccgtttgcattaacaaccggccagaatattatatgtcctgttaacatcacacatactttgcaattttaatgttactacggcctagactgatcaatatatgggaggattcacttacattaattttttacgatatttttttttatatatttatatgactcattattaattaattattcaaatatacaagttgaaaaaatcattcaatactataattttaatatgtgaatacaattaattataaaaaaattatgtgactataaatgtatgtgtgattttttaatcaatgtaaaatattcattaatttttattaaaatttaatctatcatctttttaattatattttttatttataacatttaaatttaaaatcttatttagatttatacattcgcgaatagttgttaaaattaatatggcttggtcagttgggtcgagacccaataatataattgatatgatcaaacttgactggtcatattatgctaatccaaccgagttcattttttttatatattttttgtagatttttttaaaaaaatttaaattgttattaataattattttaaattttggactataaataatttttttaataaaataatattaattatacacttatatattttatatataatagatatataattttaaatttttaatatatataaatcaaatcacctattattaatccatttattagattagattattgacgcattatccactgtctgaatcggataaatagtagccgattttaataacattatacaagctttacaatggcacactgtttagtgttcaatggagaaaaataaagacgatcgattaatgagatcagcaattagtcatgattacttatgaaattacgtttatgcagctcctagccgcaattgctaactgtagattaatgcatctataacaaattaagcaccctttcagtctgtcacttgttaaatcaaccgcttgtgagtgtgaccgaatcgtgatgaagaggatgattcccatgaacaaatccaatacataatcacactcaatcttttcatatataataaattaaaatatgtattctctatttttaagtcgcataattatttttattaaaaatcatgtttttctactttttatatttaattggctctaaatttttctattttttcaccttattattagttttataaaatatatttaaacaacttcaatattagctagattcactgttttgtacgaagagatttgtatgaaaagtataaattgctcgttcgatcatggtaaattgaagtaagaaaatcacacacacacaatatatatatatatatatatatatatatatatatatattattaataaaataaatcatgtgaaattttgccacttcataattcgcttttttaattatttatcttttctattttcaaattttgttttcctagtaattcatattttataatattctctatgtttatatgattaggcaatattttacttaattttttaaagtttttttaacttcaaaataaaggttttcatggaagatcgtccatcttctcaatttttgttcattaaaataattacttttaattttattttttatacgttttaaatgttcttggcttgactacttattctaaatagaataggaagtccaaaagaattgggttaaatactattttaatcaaaaaaatcataaataagactcttgctatattattattcgtattaagtgtctcaatatatttagttggatgaatacactcttaaagatggtttaatgtttgcttataaaaaaatggcttaatcttttttgtctactctcatcaaaattattgttttctttttaaatttatctaaattcttatatatatatatatattataaagaaacattaaagatattttaattaatttttaattttactagttgaaatacttatttgatgaggtaaacaagttttttaaatattttttttaaatactaactgaaacaacattttttaaaatgctaatttctatttttaattttttttatcatgaatatatttatctaattttttaattatcctttttaaataaattataattttattaattttttattacttataacttttaactactttaataatcaaatgattataatttaataagttaaaattttcaattttcaaactagttttacactacataggcaaaattagaaaagataagctagcttgctaaaaatcggcatgacgctttctaaacctagcctactctaacgacgctctctaaacctaggcggcgttagagattcgtttcttatgtcactaaatcgaatattaatttggaacatcatgcaggaagcctccttgaattatgtggaactcctggaattacgatggactagcaagttgcacctgctagtcctagttcatatacgtggttaagaggattttgcacttggaaattccaattgatacatacctcaatgtcaattttgatggaaggcttttgggacccaaaggcaattctctaaaaggggtataagcttctacaggttgtcgtgagtatattagggaaaatggttcaataaaagatccatacaaggaagaaaattaagagtaagaccagtctatcagcatctcaatgagcaactccacatcttgattgagactgatttacctgttaatatttttgacataaggctctagcaagctcaggaaattatagaataactgatcaaaaccgtggaagagtctgacgactatattaagagacaacagttgcgtgtgaactggcgatgctaaattcaaattctagataagagagtcctcgaccaagagaaagtgtatctccattcaattccagtggaatgaaacgaactaaaactggctgatgaaaggtttccttgttacttgtagatggttgttattgttttggagctatctcaataaagcatctatgaacgatcgaataggttaacagttattgttggctcacattctggtggttttaatcctccctttatcctacatttttcttctaaaacaacatgagttaaagctaaaaaaattttagaaaaaaaatgataaaatattttggtattgagaataagtgtgttcaaatgagtatttttcttgcacactttgtatatttattgttgatttattcttgcgtccgtaatttgtgagaaacatgaggcggaccgaagtagtagagaagggggcaagtgcccccccttgaatttgtccatgaaattactcatatacctttcatttttattattttctccaaaatatcctaggtcttaaaatttgagagtagtttttaatttctcttttcttctctcattttgctttcaccttcatgttctgctctccctgcaagacaatgtatgtattgattatattgcccaaaattctggccccttaaattttgccattaaaattttaatatatccttagcacttgtctacaatactttttaattatttccagtgcttattatatagtttgcagtacttattaattattttcatttgtaattcatgcattagcacttgtttataaggtgattaaagtctttactctttattgaaatgagaagtacaatttaaccatatgcattttatagatatattttaatctatattgtaacatctcatattcaaagatctcaaactcaatacttatatctaaactaattctcatgttatcatcatagtcttttgaaatctcattgtaagtcacaataaatttatttcattgttctattcaatctagaataataatttggtctggctatttgtttgtttttttagattatggtttaaaattgtttgttcatttaaattttctttacaaaaaaaaatttgggggctgtacggacatagatgaattttcttggatttgctactagtgcctccccttgattatttttctagattcgccactcaatatacatgtgatgatgggagaagctttaggtcttaagtggataagttttgtggtctcatcggtgctcaaagattagttataggataggttgaattctttttagttgtttgtctcaaacatgtattttattcattatgttataggttgacaataaaaaaaatgtatacacactgaatgactcatctagaaatttgatgatgtggagtcaatataatatatccgtgcaaacacgtatacacatgcgtggacacacccactttttttatataattatttaaatataataaattacacttttagactctattatttgttaaattttaattttggtctctttaattttgtgtaaatttattctctttacttttaattgtgtaattttagttaatttattaactttaattatttgcacatcattgattttaattattatgtacttgtacttgtagtgattgatttaattcattgattttgttcaacatgtgctctgattatcatgacctggctatatatagctagacatagacatggttaactacaatttggatccaatgccattacacttaaaataggagtaaagtagtccccggttgaatcttgtacgtggtctcacaattaggacactgataagtttcgcaccattgtcaacacacgggggattgagattgatgtacaacacttattgcatcctcaacccacggggggattgagactagtgtacaacacccaccgctgcctaccatcatcaacttatggggattaagattaatgtacgacactcatcgtgtgtatatatgtgtgtctatatatacagagagcattttatttgagaatgaaaatactaatattaactatcaagattaaaatattttaaatttaaaataaaatttcatttaactataaaaattttataagatttattaaacataaaaatcaaatatcttaaagatttaatcgcgtcctaaaatatttcaaacatattatcatcatgaatatttttgtcattattgtcatcaccattatcatcgtgttcgttatcatgatcattatcattaccaccaacataatcgttattgttgccgctgccaacaccaccggtagtggtgatgacgattttaacataaattaaatttttaagatatttgattttttgttttataaattttatggttaaataagttcttagtttaaattaaaaatattttaatctaacaattgagattaattattctcattctcacataagataattattctaatatgtctcctctcactctatatatatgagaagggatccacttattgcaaaaataattattttagagttattcatcaccatgtttaccatttattttctaaaaaaatatggctgccattgaaacgtccatttcattcaatacgtcccctttttttcatttcacctttgctaatgtagttattttcatttaactccaccaatcttttttctccaaactatcatttgaggtgaaacttgacaccgatgtctatatgtattgttgtcatttatacatatctgtaaataatttttatgtttgggcatgcggaaataattgtttaattgacgctattcctccaattactacactaaaattgataggcattcattgttccatctgggtattagggcatgtaaatgaaatataacacttcagccatacatctcattggaggagtcattgtgtcctccaacacggaggaagttgtaagtcgtttttccattcgcctcttgaagatctccatgttttgcaaagtaaaagacagaagagttcattcatggagagaggaaagataattttggattacttgtatcattaaaagaaattaaaattacagaaatacccattgattcatgttaatatatataaaaaatagtcttttgtctaatgcaaaaggtgttcaatgttgtactcctcaatacttttggtcgtatataagtcaatcgaaactcacaaattagtttattcgtgtttatgtacttgagactgtgagactgtatatcccctacactttcaattgtatatgagtagattgagagttatacattagtctcttcatgcttatgcattcaagaccctgagattgtgtctgtgtatacctcgatactctcgatcatatatgagtcaattgagactaaaggactatgcacccctttaatcgctccatcggtcaactcatattttaatgctaatctttgatatacgattgaggtcatgacaccatcttttaggcattcattagccatgtcatgtgacacgattcttagcctttgagtaaccctaacagtttaaatgagacatgcctgggagtcttagaagggggatgaattttgataagatggacctttttaggaatattagattggttagacacttgagttagagaataattcagttatatttgacacttgaatgatcttgaattaggtctcattcccggaccgagttacaaaaacaaatgctaacatatatcttttatttatttaagtaggtttatgttaacaaatctcatatatatatataatatgaattaattttaacattatatattccgattttctcaaacccacataaagggtggatgcaaccaagtaccaatctacaagtcaatcctcgatgaagacatagcatgtgcatgctcatcaatttgttcattattattggacaacaacatggacgcaagataatccaatatcctgttaatatgttatgcatagttgttattatgcatatatatgtgctcctcattcctcgaaagaccagtgtctctgtcggtaattttcttctctctccgttggtgtgggaccagagaaacaataacagtagtgagatccaacccaccaagatacggatccaagtagtggtacttctagtactgccagagcaaaaagcaaaagcattgcctttaaaaatggccaagcccaatagcttctcttccatggttacttactgtacacgacttaatcacttcaattattattatacaaagctaagttaattaaaaagcgaaaaagaacccctctccacttgtctcctcgtacattacttcattaattttataatatcccagcccttaatcaagcactttccgcgtaaaaagtacagctgtagacagataaaaaatcggattggagatcaaatttagcttaaacattttgccaatttgatcatttgttatcattaacaacgctgctttaattaggagccacaactcgttaaatccatgagattgcgatctatctgcttgcatcgcgtgaagattgtaaaacaaattcacaaatagcggaaaagattagggtccattttctatccaaacatatattatgatttgacaagagaataattaacatattgcaaacatcgtgcaatagtgtacaaggaaagaagacatatcatacataacgagataagagctatacaagagttcgttgtggcctacatgtggagttatatatagtttttggaaatttaataaccaacaaaataaactttcagcgagttagttgctggttcaaagttttaactgtatgtatattattgactggaaatagaaacttttactctccacacccaactcccttgtcctataatgtttgtctagctataacatacttttaaaacctagatgaatgattatccttctttttgggtctttagatattagccgattttttgcatctttggtgaaaagccagttatcacttgtgatatcaaaaaagaaaagccagttaccacttcagcttttacgtactgaagtgaattttacttgactcatcaagcatatgggtttgatatttacctatttatttaattgacaccaaaatagtgaatgtatatttagaagtagaattaaatgtaacaattttcaatcacagaaattatttaatggctacatatagtaaagatattttatttgaaaccattcgcattcaaatacaaacatatataagctacctaaccagctaacattatgattcaaaatgttggggggaaagtagcattattctttgataaaatttaaatgccacttgtgacatcactatctgtcgtgtaaagaggtgttagaaaacaatataacagcatcaactttcattaaatagtttaaattctgtaccaaagagaattccttaattttgaagaaaaaaatgttataatatttcaattataattttatttttatttagttttatgttttttagataaaaaaattcaagtggtccgtgcaatttttttttaaaaaaaattacaatcagtattataattcatcattttttttaaatatctctatatagttaccctttaaaatgtatttctttatatattatttaactaattcaaaaatattaaaatatatccctctttatgaaatatgataagttttaaattctttcacaattattattactgggtgtttgtccacttttcgaatgtaaaattgattctcatttaaaagtaataagagtttgtagtcacctaaacatgcttttcatgtaacaataataatcaatcaatcaatttgttggttcctctggtgaagaagttgggttaaatttcctctttaaaataaaaaaggaaatctttttttttattttggctctttctatcctctttcaatcccctccacgcatcgataggccccgtctcattgagtgagtgttttttgtgtacattcattgagtgagtatagtgtcgagtgtcgacactacacagtaacccgacattaatttttgccctaaacagtggagggctgtatataaacgttgtgtatcctaatcatatccaaaaagaatcttattttaattattgaaaatcatatatataacactttgtaattagttaatcataataattaatatatatgaaattaaactctaattttttctatcaaattctgaacctcaacgtatggcattggaagataaccatgttgcgtcttgttcaacaaaaggaatttggcggtttaccaaaaacaaaaaccatttcctgaactttttcatgtgagccaatacggatgaggccacttagttccactttttatcatagggacccaaattaagatgggacaataattgaatcaaccatgaaactatatttcaactcatacatacccttcaggaagcttcacaattccttcacaggctcacggtgtcttcaattacctagttaggagtaacagctgccacgttgacacatggcaaatcctgcttcgtgtaaagtggaaataaaaatggacccatcataatagccaaattgatatacaaaaggctttgtcagtggatgttccatatcatatcatatgctttctttctaatctatatatctctaacaaccaagataaaaagttaaatttccaatccttgccaaaactcccttaggaatattctaacaaaccaaccactcaccaaacaacaataatagtttcatattctaattaaagctagctagctagatatatcatatcataccctactatgttaacttaccctatatatataaatggcctatggcctaatagataaccaacctcaaagctctatctaactcttgttcaatattcccatcatcaaacatgtatgcttcaagttcctttacttcacaactagtccatgaccttctcgtggacacaaactcaagaaagctactccttcaagacccacttcttcaccaatcaatgaactcagccaactccccagataccatgagttacaacacaacagactcatacttcaaaggtcgtgacttcgatgcaaatgttgtcatgatactctcagtgctgctatgtgctgttatttgctcactcgggttgaactccatcataaagtgtgtcttgaggtgttcaaacatagtcatcaacaataatgacccttcttcttcttcaagtagtgcgagctacaacccttcaccaagattggccaacagaggaatcaagaagaaagccctcaagatttttcctactgtgagctactcaacagagattaaactccccggtttggacacagagtgtgtgatatgcctctcggagtttgccaatggtgataaggttcgcattttgccaaaatgcaaccatggtttccacgtttgctgcattgataagtggctaagttcacactcatcatgcccaaagtgcagacagtgcctcattgagacttgcaagaaaattgttggatcccaaattcaaccagtggcaccagtgccagaaacaattataaggattcaaccactagaacctgaaggtttggagcgtaactatagggaagtatgctagctaattactttaattaattagtactagaatgtaatataaaccaatcaactataaacaatgcggtggctattggagaattttcagttgcctattgttttgacctcaaatgtaagataaactagttcaatttttgtaactgcaatattattcttttcaacaatattctaaagttatcaattgaaccagggctttagtgtgtcgtgtcttcgtgaagtttaacttagtaaaagatatatccagatgaagatgcaagtgaattatttcggaacaagagataagggcaaagcaaactatatgtctatttttggtggtcgccaacttgtgaatatcattattatttccacttaattattatttttaaccttataactaaggtgaccactttgaatgaaacaaactaagcactctttcttactccgaagttcactaagaatttgcttaatccaagtaagttaaggtacgcggcatacccgataagagtaatttaataatattttgcacactttaaaacttgtattactcctccaccacttcatttttatataatcaaataacaaaaataggcatttcatcacttatagtactctctctctcattagaaaatagtgggtaatataagtattttaatgtgtaaatgtcatttgtgtttgataataacctactccaacagtctttcaaaagagagtaaacaaactggtagtactgttttatctatcttgcaagtaagagataaatacaacacccccaccccccgcccctggtgcccctaaaaaataattaaataaaattctagtgtgtcattattgtatcaaagggtttgaagtttatatagaaccgtgttagaacatcaggaatatgtatgtccacaaaagttgtaggacaatgaattcaaattaagattaacatcgagcacacaaacacaacaaaataattatggtttgtggcattgctgctcacattatgctttaaatatttgtgagatcgatcgattgatataactttagttcttctcaattagcggaattggtgattgaattgatgaacaaagttaataataaagaacaatcctataagatacataattaatcacttcgattcagattataaatcaaatgctggcaaaaaaacgccacaagtgaataataatttcgttatatatatgtttgaacggcccctagattgctataataactagactccaagtttaaaagaaaggaaaagaaaaactacaaagtgggtgtactttatccagtcaatggagcatatatataatgaatggaagctgaggcagaaatcactaatcaacttccaatcaaagaaatgtaccaaaagggaaatgttgtaacatagaactcacacataggcatagtgtataattccctacactaaactaactaaatatatattctgggcggctgaactttgttttgctagagtgagaaatatttaggtgcatttgaagcaagacattttcttactctgattcattcattatttgctatatcagtaatctacataggaaaaataaaaattgtcattaatctacatagaaaaattaaaaattatcattaatgtaggaaacaacaatgatccacaatgctaacatgacgaacaataaataaatcagaacaacaaaaatatcttacttcaagtgcacctaagaatttctatactagagtttcacgtattatataagttctgattgcggcaaaatatggtaaatgtatgtgcgtgggacactgaaagctaggcgaagcagattattatggcgttaataaattaaagcaactggatagtattattgttaggaattgtaagaacaaatcagagggtaagaaagccagaaaacagggtaagctatagatacagtatataaattaacgcataatggaagagagagacggggaaaagcaagtccaacattaaatatgccaataattcacacctgaaatcattttcttccgttacaaacaatagatccgtatgcaattaattgagttctgggttaaattagccaatttggaaaatgcagggtatgcttgaataacataaattcttttttataaaaatcaaatttgaatattattccaacaatttaatattaattttaatacattaattacttaattaacataacataaactcttataaccaaagaagttaagaaggaaagataaatagtttttttataaactaaaattaacttatacataagattaaaatattttctctgaacttttgtttacggcatattttctcagaacttgaatataagcaaacaaatataatttcatcccaattaaggttgttagttaaattcatttgattttcttgattttacataaaaaaaatactgaaatatgtatgtgatccctaataaataatcaaactttatttttacttcctaatatttttttttcatttttgttttctaataaaacaataattttatttttgattcttagaatttttttagtgcttaataaattaatgaattttgtatttgattcctgataaaattttttttattattagtctcttgaaaaaactaataacaaatgattttttttaatagggagtaaacacaaaattgcaaatttaacggggattaaaaaatgtcaggaatcaaaaataaaattgttgttttgttaagaacttaatagaaagaaaaaaaaatattatgaaataaacacaaaatttaaatatttatcaaggatcacaattatattttaacaaaaaaatatatctcctaagctaccttaatcatatttattagagattatgcaaacatttgaattaacttaagagtatttttgaaataatgatattaattagatttcaattaattaaaatttgtttatacatcaaattagcttgagcattttctcatttatgtttgagttaaagaaaaataatacaaaaagacaccccccctccaaaaaaatcgaaacatctatatttaataataattacacgtcaaaacctcctcattacttttgtacttaattttttcagttaaaaatgtttatttatatttatgtatgtatccaacttgattctacaacatctttaatgataaatttcaaattgagatctaagattattttttggtaaatttgatagtgccacataggataaagatctctttcattttttctttaatggtagatctcattttgagatcttagggagagagaaaaaaaaaagaaaatttattcttttttgaataatgtatagatcttaagagatttttttatcagaactcatccttcatgttggagatctctttaacttttttattgtgagatataataaaaattatatcttgaactcaaaattcttactcaagattttacactaaaatttatgcaaacgacaaagtaatcagggatagataaattaattggttaaaagcacaatgcatttaatttaaattaaataaaagggtctgaatatactttaactttttgctttttgaaatagatatagttcaggattatgtttccttttttacattgttttatttcactttatacgggaaatcctaatcattaggggtgaaaatattttatttatagcctaatgttatatgagtattgatatcctaattagcattagacttaatttgatgtaaggttatttattaaatatatattatttaaaggtttaactcaataaatatagtttagttgacaatatataaaatacattattgaaaatagatgataaatattaagtgtgactaaatcttgttgtttataaaagaaagtctgatgacatttgaatattattataaatttaatgatataattatctgttggtaaaaaaaaatctgatggtatatataagggttgaagctcatttatctgtttatatatatatgtcggtctatttgttaatttcaaaaaccattctaaaaaatgtatttttagtaaataagatttataattagatgacttaaaaaataataaacttaaaaaaaatccatatttaaaaaataaaagtagacttgagacctaaatcttatgtttgtcaaaagattaagctcgttaaaaatatgacttgatcattattattcacaggaaagaattatttcattatttgataattttttaaatatgttttattattaattaaaattattaaaactaaagaaatcatatatcttattttttatttaataagtttcagttataatgtcatgatgtctaaaagaattaataataaaaactatattaaaaagaacgtactaaaattagttacccatatcttcctagaatcttacctttatataagaaataaattagtccattttttcctagtaataatacaatagaaaactatactgtattgtcacagtgaaatttgatacaacaaaatgttgtccctttcaccatttcactaaacattaaaatcgcattaatttgattaatatattacttttaaaaacaacaacttatatttagaaaaaattaaaacacggaaacatattttcatttaattaactttttcattaaaaaaataatacaacaaaaatgtatttctgttaagttaatttttttacaagaaaaaataacaacgaaattgtgtatctatttagtgttgaaagtaaatacaaagcaaaaatctgttttcattttgttccggtaatgcacatccctttctgttttcattttgtaccggtaatgcacatcccttgtgaaaaaattgaaaattattttcattaggtattgatgatcaatgaaaacatgtttctgttaaggaaataaggaaagaatacgtccaatttccatcaaacagagattattgcaaagcaagggtcagtgtatataataataataataatatataaacaaagtaaattgtgatataaagttttttattactcaaatttttttattaaaaataaagataaaaaatgatatattaataacaataagcaattaaaaagattaaggtagattggaagaaaaaaaatctcattattattaatgaggggatgggcttctcgtggtgactgatcgatcagtatcccactcattaattggagcttggacgctaagttatatatataggtgaattcgtaaagaagatcaccaaccaccacttcatgcagcaactgcgcatttgttcatttggcctggggttgatcgattacttccccatccaacaacgtaagactacttatgatgtatttttatttttgaccatggattgagataaaatacacatgcaaatatcctacttatctgttaataagtgcttttcttttcgaaatcttttaaaagctactaacgttgaatacatggttgataaaacgaccagatatacccactaggcactagctagctataccacccaatatcatactccaatagaaacttcacctaacatgtaggatatactgtatgcgatgagttatatccaagagtgaggagcaataattaaatctttgcgtgtaattcacttgttttcccctcaaacttacggttcttgatcatcttcgaaacaatgtaaaaaaagaaaattgcattttcaactctaccataattctattctttgaaaatgattaaggatgcgtttagtttagaagataaatataaaatataaatttttaaagtaaaatagaatgtaaaatatgtgaattctataaaaaatacaatttttttctttaatattatttttcttctttctaccaaacataccataaaggatgtgttatggggaaagttacctgaggtgctagtttaggaagggtcttaatgtaaaattccaggttatcactgattattaattaatgctgtcaaaaggaaaggttaaaaaaatgatacaattcacggattataaaataataaagcttctaattaaataatgcataattttgaactcgttcatatattcatatattattaaaaaagcgtgctaaaaatctagtgattgtttacaaatattcgttaatatattttgaaaaatataatcattcagaaataaattcttaacataatataaaatacagttatataaaataaaatgaatctggtcatatttagataaatatcaataaacacttataaataaaaagaaaacaaaaagtaaaataaatcaaatttatttcattatttaaaatcaaataatacaccttcactttttttaaaaaaattacatgaaagagcttacataaaagttaaagtacataaataaatttaaagttatcgaaaatgtttaatttattttactttttttttatttttttcctataaatacctattgataaattgattcaaacagaacagagagccccttgtcttcttccattgtaaagcctcaaattttaatcaaatcaaatgtaaagcaaaaaaaaaaaaaaaaaaaaattctttaatccgtacgcaaaaagttagcatttatcagtatatgattggataaaaattctactcatggcaaaataacttgtctcaatatacatgcttatattattaacagttagtttggtttggccatatgaaaaatacaatgaaagaaaagagagagtatatatatatatatatatatatatatatatatatatatatatatatttcttcacatgaacataggaaaaaacacaggaaaaaatttgggttccatgaaaaaaaaaaatctcctccataatgcgaaaaagaaatagagggaaagaagaaaaaaaaaccatttaaccttttcttccttcattttcatcgctaggctcactccttcaacaaccaaccctaaccccactgattttaaccatcggcacgcatggagacgaatccacaaataatattatgtttacatttttagttgctcaagggagttgcttaaataaggtaactattacttaaatgattcataccaataaaataaatatttttcagtcacaaaattaatgtagttaatgttaagtacctattctattaactttagcattaaaataaatttttgtataatttttttaaacctatgtgtattataggtctcataaatttaaaataagtaacacatttagatttagataataatgcattataaatatttataattattttaaaatattaaaccaacatcctttatatattaaactaatttttcttaattaatttgacaaaaatacaccatgttcttgaaaagagttgcataaataaataaaaaatacaactttatacaagcatgctgtctgaacttggattatttgttgtggttttatatgtacgccttcattcccaaatattaatgtgtcaacaaaacgagcaacctttgaatgtgcacatagttggagcgtcaacggattggctgtacctagcacgtgtaagcacatgcatgcttttaaaaagatggggaaaaggtaccacgtgaataagaggatcaatattttgagctgaaaagttatatttctgaaacttgaatactgcaaattatagttgagattccttttaagaagctaataaaaccgtttaattcatttgcagaagcatacattacacggataagtgattcccggacaataattatcattgattaacgtacaattcattttgctatcacagtttggccaaaatatttcagagaataaagaaacgactggagtatcttacaatgatggggatatgcaaaagaataactgtaatatgtatcttacaacgatgaagacatgagaatgcccgcaatatctttatatatattgtgatccctgagcatgcgtcaacatattttaatatatcttgtgatccctgagcattcgtcgacagtaaaaaaacaacgcaagaaatgagaatatagtaagcagatgatggttgggaactaatttgcgattaggagatgaaaaataagaaatctatatgatgtattaaaataaattcaaataattgtttttggtttgtatagctaattaactacgaaaagaatgtagttacctacaaaaatatagttcaaaactaaataaatgtcttaaagtcatcaattgaaggacgtcgaataatgctgcctgagaaacaatttgctgattatgaaattgaaaggaaatttctgaactctcttggtgcaaattattatgaaatttaaaggagatttatagtttgaactctcttggtgcacggacctagtagttcatgtgaagttaaagttaaaagaaaaatgcttaatggcactaatcacatttcattagaatgacacgaatgatgtgaaatctcattttactctaaatcgcctaacatgattttctcactccttcaaatttttttatgcaatttcaattccaatcgaaagaagtccagcaatttcaatttccttgaatggattagcttgccttcactcgcttgctgccactaatatgtgtgcaccccatgtacctaattatcacaccaagtcttgagttgaatgcatcaattagaattcagaactccagcccaatctctcatctctcccaatcctatatatcaaacaatgcaagtttcatttttaatcccaatttcgtttctcaagtttcgtttccagtgttattattggataaaaaaatttccctactgcaattgggttgattgttatattactgaatttattgataaacaaagtttttttttccaataaggttttcaaaaaggttataaagaatgttgtgtgcctttgtctcattcgatcattcttatctttcaaacaggatgtgacttttgttgttgatggggggaaaagcttccacaattaacgggcagttactacaataacattgtgattagtaggataatgcagtttgattttaaaatatctcaagattttaatttattaatatttaaattaattacaggtaaacttttcgtgaatttcgtacttaaactcatcgaactacatagcatacatagctcaagttaaaaatatgacacgaaggcgtgaggcaagaaaggttgtcagacaggtcaccttatggtttccctttcatgaataaaatgattccatttctttctcttgtacttcaaatgcttaaatatcggtcctaaactaatctaagaagtataaagggtcaatttttcacgtcattagttatctaatctactacagtattattcacaccattagtatttcattactcaactctactattagttattttaatgaagtgcaaaaaaacatagttattagtcacaatcaatatttttaataaaaactaatgactagttaatataccttaaaattgttggttggattttaacgggaaaaactaggcctccatggtgttacgaatcaaaatttaaatttccactaagaaaaatatttgtgtttagtatttcactgtgtctcgtataaaattagaactgaattttgaagaaggatatatgtgaaaacaaaaaatatatcttaaaatttgaaattatatgataaagattcagtcaatttgtatcaacttatcaaatttcaattttattttttaaaaacattaaaatgatataactaaagtcatgttagatgtctactaatcttaatcaagtcacgtgaatttatttaaagaaataaaatttttataatacttattttttcatttacagaaagaagactcaagaaataaagcttcttaacttcttagttcttactatttcttaaaagtcaaaaggaagaaaaattgacccttgataattaccatttacccctcaattttaccaagtttgaagagccttgtacacacctagacaaaaaataaaaggataatacaaattgacccttgctaattaccattgacccctcagtttacaaagtttgatgagcctttgtacacagctagagaaaatcgttgttgttacgctctcacgaacacacgcataccctctgcactctctctctctctctctctctctctctctctctctctgtatatataccctcacttctgttctagcaccttccattactccatttcctttctcaactgagcggtgagtgagtgagacggaaagtgcaaagccaccgtcttctcttctcagagcttggctttgcttatcgattctctctcctctcatctttttcattcaaggtaattctccgtccaaaccgtcttagatcgcaccttattttccacttttagtcaaaaaaaaaattctcgcattttggttccaggttataaaacggtgctagttatgtttccttttaacaattctctgaacaaggttctccgattgggaaaatgtagccactagaactcaaatttgtttattagtgcttcttcctgtgtgagattgcctctgatagcagaaccgtgtcttcattttattttattattacttggaattttgtttagtatgtattgattgttgtaatgaagttagattgatggttatatcacttcaatgtagttgatctgtggtttggtgtcttattttgcatgctactcaccctgtctggttctgatctgctacaagtgagatcttggatcttgccacaactagacaggcaatttgttttgtatatatctgttgtatatgtatggctgcagttgcgtagttcttctggtttattaactgactttatgatcttatctggattttatgggagaatctctgatttttttttttttaatatggaaaatcgtcaggtagttagggcgttgtcaattgatagtgatatttctgagtcagtaggcaacatgtggttgttgtttattccttattgagaagcataaattataagtctcgtctaatcgaacctttattctatgatattattaataatgtctgttaatttataaatgttggcagtttaacataatgttaaggatgctctcctttgtttattaattttatgtacaccgtgctgttctctttttccatttaaaacaccaccaccttttctagttattaattaaatatatttcaacttgcaggcactaatgtgattgtttgatttcccctctttgttcttgttcttgtgtgtgtatgtgtgttttatgctatgtacttttgttatatctggtttaaaacagatatagtctttgaagtaagtcctagtcttcattggctgtaaatgtctgggtttcatattcgtcggtttttttttttttatcttttttgtaaagaaggggttcggttaataaaaagtaaacatagaattaattaaaatagaatgatctattacgggttgttcatacaataaaatgttgatacgttacttgctggcactgtatttcatggcaccctatgctttctgcaggttcgtaaaagatggccgatgctgaggatattcaaccccttgtttgtgacaatggaactggaatggtcaaggttagtacttcgtggctttgttttttgtttcacctgcatgtgcatctgcaagccttgagttcataactgaatctttgattttaatacggaacaggctggatttgctggtgatgatgctcccagggctgtctttcccagtattgttggccgacctcgacacactggtgttatggttgggatgggtcaaaaggatgcctatgttggtgatgaagcccaatcaaaaagaggtattcttactctcaagtatcccattgagcatggtatagtcagcaactgggatgacatggaaaagatctggcatcacacattttataatgaacttcgtgttgctcctgaggagcacccagtgcttctcactgaggctcctctcaacccaaaggccaacagagaaaagatgacccaaatcatgtttgagaccttcaatgtgcctgccatgtatgtggccatccaggctgttctctccttgtatgcaagtggtcgcacaactggtttgtatattaccatctgtcttgattcattcttttataatcacatcattctttccctgaatcaattcctttcaaaacaggtattgtgttggactctggtgatggtgtgagtcacactgtaccaatctatgaggggtatgcactcccccatgccatccttcgtttggatcttgctggtcgtgatctaactgatcatttgatgaagatcctcactgagagagggtacatgttcaccacctctgctgagcgagaaattgtccgtgacatgaaggaaaaacttgcatatgttgccctagattatgagcaagaactcgagactgcaaaaagcagttcatcagttgagaaaagctatgagcttcctgatggacaagttatcacaattggggcagagagattccgttgcccagaagttcttttccagccatctatgattggaatggaagctgctggaattcatgagaccacctacaattctatcatgaagtgtgatgtggatatcagaaaggatttatatggcaacattgttcttagtggtggctcaactatgtttcctggtattgcagaccgtatgagcaaggagatcactgctcttgctcctagcagcatgaagattaaggttgtagctccaccagaaagaaaatatagtgtctggattggaggatcaatccttgcatccctcagcaccttccagcaggtgattgttttatcattaattagctcttccatgtgtgccattttgattgctaaaaaatgtggtggttttgcagatgtggatttctaaaggtgaatatgatgagtctggcccatccattgtccacaggaagtgcttctaacttccaaaatatgcttcaatggtgaaatattttccgctccagttgtttttatgggtctttgtcatgtcatgttaacgatattgccatggataagaggtgaggaagtatcattaaaggagggtctattctttagcttgatgcatcatattttgtgtggcggccagacagttagagagaggcatttcttgcgtttggctatccgtggttcatctatatcttcttagtaggtgtttgtagcaaggtagttgataagttgataagatatagtaattttaggataaaataattaagaaaataaagataaaatatcaaataaagactttaaatagatagaaattatcttatcattaattattgttagtagttattgttattttgttatttaggagcaataaaaggaagaaaaggagctaaaagataagataagaagataatctcttgaggttttgctaacctgtctataaatagggaagccacagaacctttgaaaacagaacttttacatgagcaatatagagaacaaggcagagaacaatcataagaagggaaaaacgcattacgcgaagggattcaaggttcataaggaggaagccaagattgagggtttgaatactcttcttctctgtattctttcttattattcattcttattgtattgagctagacatatcatgtctagctaattctctgtgattgtggtgaaagccaaaagccaatgtgaactcttgtgttgcttggattgatgattaatgaatattgttatgatttcttccctttatcttgttcttgaatttataaattccattaatagatctgatcaatctgttagaggaacatagggctttaattcgcaatagacatattggggttttagtttctgaaagcgataaagaggacagtttgacattacctagacatagggatgaaggattgcaaagttttcatataccaacttaatgcttaatctgaaagggggttactaagacattaggacacttgaataggattaaagggttgaaaagaccgacaaaatctgggttcaaccaatttatgaaggtgtatctttgagaaagataataattgaaattaattatcaattcaatctacattaggagggatcaaaggtgattaggttttcatcacaattattctttattattgcataaattctcataaatcattctcatactttccttttatttaaattctattttttttattatttaaatccaaatcacaaaattactctcaaattcaatttcttttatttctattctttccaattttaagataagagttacaattattttagtgcctcaatcctcgtggagacgatactctacttactaaatttattacttgaacgatcggtacacttgccgtgagttacgcaatcacactctttgtgaacgcaacaagtttttggcgccgttgccggggattgagtacgccaatttaattgtaattttatttttaaaattggaatttgtttactaatctgttttctagtttatgcgaggttcaattgaacttgaaagcttacagttcgatccagaaatagagaaaactgcaagaagaaacaggaagctagctaagcaaaaatagagagcagaaaactctaattcacaatctgcagttgaattagagatggctgaaggcaacaacaatcagccaagacctggagatgaattaatggaggacatccttgctccattattcaccaggcccaattctagcatcgtcagaccacccatagaggcaaaccactttgacattcatccatcattaattaatttggtggagagaagccaattcggtggtgaagatgacgaagacccccatgactttgtggacagattcttgtgaatttgtgatacaataaaacatcaaggggtaagtgatgatgcaattagactgagattgtttccttttgcagttaaaggaagagctctcagatggttagacagacagattcctaatagcatcaccacatgggatgaactagctgcgaggttctttgcccaacacttctctatggaaaaatacaacagattagtgaatgaaatcactaattttactcaacatcctagagaaacattgtgtgcagcttggaacagatttcaggagctaatcagaaaatgtcctcaatatgatatgcccgttgggaagaaggtgcgaatttttttcaatgggatgactcctgaatcaaggatgatagttaatgttgcagcaggaggaacaatcagatctaaaacagcaaatcaaacctatgagttgattgactccttagcaacaaacgagaatgaaagcatcgtaatccagcccaaaagagagacaatccaattgggaagtagtgatgccatgttagcagaacagaagctcttgtcacagcaacttgctaagcttaatgagagaattgacaagcttcaaatttctgcattacaaaccgcacaacttagagctccagtattcagttgtgaatattgtcaagaagaccatcagacaaatgaatgtcccacgttaataggagcagacccaatccaggtgaatggtgtgtggtatgaccagagacctcagcagaatttccagagaaataagaattttgctatgaataactttcagaggaaatatcaaggaggagggttggactataaatccaacaattatttacaacccctacctattccacctaaagagccctctgaattagagaaagctatgatacagctgtccaaaaccactaatgagcatattcaagcaacaaatgcattcatccaggaaaccagagcccaattcaaaaatcaaggtgcatctattcacaaccttgagaatcaaattggacagctatcaaaacaacttgcagaaagacagccgggacaatttcctagtgatacagttgttaatccacgagagcaagctaaagcaatcacaaccagaagtggaactgttatcacacctcaagaaaagaataataaagtgcagaagaagaatggtgaggaagacaaaactgatcggaaagaaggacaagaagcagaagatcggacaatcacaggtaaggataaaaattcagcagctgaaaagcccaaacaggtatttgatttttcacgttttgaaaaaccaccatatcctatgaggattaagctgcaagagcaaaagaaacaatatgctaaatttttagaaatgtttagaaaattgcatgttaatataccatttgctgaagctcttgctaacatgcctaattatgctaagtttatgaaagatttagtatctagaaagcataaattaaaggaatgtgaaaccgttgtgcttactgaggagtgcagtgccataatccaaaagcgagttccaaccaaactcaaagatccggggagtttcaacattccaattgccataggtaatgcaaatgtgggtaaggcattgtgtgatttaggggcaagtattaatttaatgcctttatctatgtgtaaatctttgggaatttctgagcttaaacctaccatggtgtctcttcaattggctgacagatcattaagaaaacctagtggagtcattgaagacattttggttaaagttgataaattcatattccctgcagatttcatagttctagacatggaagaaagtgagatacctattcttttaggtagaccatttttagccacagctagagcattaattgatgtagctgatggaaaactagagctaagaatgtttgacgagtctgttacttttaatgtttttgatgctatgaaaaatcctattgataaaaatgattgtttcagacttgatatattagacactctagtagttacagaaaaatcaagtgaccaggagctagctgaagtactgaaaattcaaagtgaagaaaatcctgttgaggataatgaagctacaatagaagtgctgaaaaagaaagaagatgatatcatcagtgaagcaccaaaattggagctgaaagaattgcctgaaaaattaaagtatgtattcttgggagaagaagagacatatcctgttatcataaataaaggattgtctgctgaagaagaggagaagctactcaaggtactcaaagcacacaagagtgcaattggatggtcaatatctgatctaaaaggtattaacccatccttctgcacacataaaattttgatggaggatgatgtgaagccggtaagacaaccacagagaagattgaacccaaccatgaaagaagtggttcgaaaagaagtagttaaactgcttgatgccggtatgatttacccaatctcagacactccatgggtaagtcctgtgcaaatcgttcccaagaaaggtgggatgactgtagttcataatgataacaatgaactaattcccactagaacaatcaccggttggagaatgtgtgtggattatagaagactgaatgatgccacacgaaaagatcacttcccattaccattcatggatcaaatgttggaaaggttggctggacatgcatattattgtttcttggatgggtactctggctacaaccaaattccagtggcacctgaggatcaagagaagacagccttcacatgcccttttggggtatttgcttatagaaggatgccatttggcctttgcaatgcgccagctactttccaaaggtgcatgttatccatcttttctgacatggtggaaaaaggtttggaagtctttatggacgatttttctatctttggctctagttttgatacatgtttaatgaatttatctaaagtattaaaaagatgccaagaaacgaatctagttcttaattgggagaaatgtcattttatggttcgtgatggaatagtcttaggacacaaaatttctgaaaaaggtatagaagttgataaagccaaattaatattgattgaaaaactcccaccaccaattaatgttagtggagtgagaagttttctaggacatgcaggcttttatcggaggtttataaaagatttttccaaaatagcaaaacctctaagtcaacttctaacaaaggaaacagaatttgttttgaatgcagattgcatgaatgcctttaatttgttaaaagaaaaactcaccactgcacctgttttaacagcacctgattggaatttaccatttgaacttatgtgtgatgcaagtgcatatgccataggtgctgttcttggtcaaagaaagaataaattgctgcatgtgatttattatgctagtaaggttttaaatgaggcacaattgaattatgccacaactgaaaaagaaatgctagctatagtatatgcattagataaatttagatcttatttgataggatctaaggttattatttatactgaccatgctgcaattaagtttttgatgaataaacaggatgcaaagccgcgattgttgcggtggatgttgttatttcaggaatttgacatggaaatcaaggataaagttggagtggaaaacaaagttgccgatcacctttcaaggataaaagaaaaggaattacaagatggatcagaactagccattaatgactcctttccagatgaaatgattatggctataattaaaatgggaccttggtttgctgatatggctaatttcaaagccgcaggcactgtccccgcagatttaaagtggcaacaaaagaagaaatttttccacgatgcaaggaggtatttctgggatgacccattcctttactacaaatgtgctgatggtatcattcgcagatgtgtaactgaagctgagctaccagaaatcctctggcattgtcattcatcagaatatggaggccactttggagggaacaggacagctcaaaaggtgctacagtgtgggtattattggcccaccatgtttaaggatgcacgaaattatgtggaaaaatgtgacaaatgccaaaggactggtaatatatcgcgaaaagatgaaatgcccctcaataatattctggaagtagaactatttgatgtttggggaattgacttcatgggacctttccctaagtcatactccaatcagtatatattggtagcagtggattatgtttccaaatgggtagaagcggttgctttacccactaatgatgcaaaagtggttgtgtcattcctaaggaaacatatattcactagattcggagtaccaagggcaatcataagtgatggaggtgctcatttttgcaacaagcaattatctagcttgcttgttaaatatggagtcacccataaagtagctaccccgtaccatcctcaaacaagcggacaagtggaaatttccaacagagaactaaaaagaattttagaaaagactgttggacattcaaggaaagactgggcaaagaagttggatgatgctttatgggcatacagaaccgctttcaaaacaccaattggtatgtctccctttcaacttttatatggtaagtcttgtcaccttcctgttgaattagaacataaggtaatatgggctattaaatttcttaattttgaactatctaaagctaatgagaaaagattattacaattaaatgagcttgatgagttcaggatagatgcttatgagaatgctagactttacaaagaaagaacgaagaaatggcatgataggaagattcgtccaaaagactttgcaccaggacaacaggtattactgtacaattctcgattaaaactctttccaggtaagctcaaatctcgttggtctggtccatttattgttaagaaagtttttccatatggaacaattgaaataaccccacctaattctgatcaatcttttaaagtaaatgggtataggttaaaaatttatcatggaggggaagtggataggaatactatttccataccacttgattcccctgaaaattaaagagatcggtgtcaggctcgtgacgttaaacaagcgctacttggaaggcaatccaaggatttttacatttatacttcattagtttaatttattattaaaaaaataaaaaaaaataacaataataaaataaaaaaaaataatgaaattatgtgttatttctccccttacaaaatgttttatttattgctggggacagtaatgtttaaaatttgggagtggggacgcataattgcgttaacttttgagaagaatgtttaaatagaaattaggagcaaataaaatgttaagaaccttaaataagttccagatttaaaattgttgacacagtgataaaattttatattgttgattgatttggaacatgtagaagacagttaaagtatagaattgcatagtacaggattagaactacaagttaggtgattgaatacatcaggaaaaagaatagaatacttgttaggaaaatcaaaggaacattagtctgatactataagtttgtgaggtttgagcctatacagtacaatttttttccagagtgacctcatggttaataatattgcagggcttgatttgtttctcaaatgatatttgcatgattaatatgataaaggcatgttctttctttctaagctagagccaaatgaccgtacctttaaaaataatatccatagttagtcaatttgagcttaagctttttctttcattcaccttaaaaactttatccctgactaccttatttgagattgaagacaaagaagttaggtcaagatcaataggaatagaaagatgaatagttgcaagaaagaagaagaaagaagaaacaaaagaaaagtattggatgcatcaaaaaaaaaaaaaaaataaaaaatgaacaaagcaaagcttgagaagtaaagtaagagaaaagaatggaaatataaatctggaaaaagtagaaatacagctattgtatgaaaaaaaaaaaaagagagagagagagaaaaaaagaaagaaaagaaaaagaaatggctgagtacgacaataagagaaggaagtggatcagataagaattgatcaagactaacagacttcaatctcaaatcagctactatccaaattattcctacctcaagccaggcctcattacaacctttaaagaccttttgattaattgtgcatctattcatgtttctcatttttaggaacctgagaatataatcaagttcatgttcatattatagctttggaggaattgagcggttatacagttacccaaaacacttgagtgatgagtgatcacattcctaagtgagaagtattcagactatgctcatgattgatagacttaacaagtgttcttgaaattttcacaagtagttcaattgcatttaacaaaatagttataagattgtatgtgcgatgatatgcttaattgttgaatacaaaatccattgaaatcaagttttattttattttattgctgaggacagcaatgtttaaatttgggagttatttgataagttgataagatatagtaattttaggataaaataattaagaaaataaagataaaatatcaaataaagactttaaatagatagaaattatcttatcattaattattgttagtagttattgttattttgttatttaggagcaataaaaggaagaaaaggagctaaaagataagataagaagataatctcttgaggttttgctaacctgtctataaatagggaagccacagaacctttgaaaacagaacttttacatgagcaatatagagaacaaggcagagaacaatcataagaagggaaaaacgcattacgcgaagggattcaaggttcataaggaggaagccaagattgagggtttgaatactcttcttctctgtattctttcttattattcattcttattgtattgagctagacatatcatgtctagctaattctctgtgattgtggtgaaagccaaaagccaatgtgaactcttgtgttgcttggattgatgattaatgaatattgttatgatttcttccctttatcttgttcttgaatttataaattccattaatagatctgatcaatctgttagaggaacatagggctttaattcgcaatagacatattggggttttagtttctgaaagcgataaagaggacagtttgacattacctagacatagggatgaaggattgcaaagttttcatataccaacttaatgcttaatctgaaagggggttactaagacattaggacacttgaataggattaaagggttgaaaagaccgacaaaatctgggttcaaccaatttatgaaggtgtatctttgagaaagataataattgaaattaattatcaattcaatctacattaggagggatcaaaggtgattaggttttcatcacaattattctttattattgcataaattctcataaatcattctcatactttccttttatttaaattctattttttttattatttaaatccaaatcacaaaattactctcaaattcaatttcttttatttctattctttccaattttaagataagagttacaattattttagtgcctcaatcctcgtggagacgatactctacttactaaatttattacttgaacgatcggtacacttgccgtgagttacgcaatcacactctttgtgaacgcaacagtagtgattgtgatgatctctttttcccccattttcttcttgtattaagtttacatttgaaggattttaccccttggaacattgaatcattgatgttaatagtcatatgtatcgagaaatcttattattattgttattgcccgttcttgcccgtaaattcatacagcaatttttatgtatgttgaattactggcttcggagaaattgagggtgcttatgaattatgtcctagaggcggcattaagtccatttgatgaaatgcatagatcactgtatgatgttttgtcgttgaggtgtcataaagtgacaaccagtgattccataattgtatagcaaaaaactttaaaacattttcacgattgatttgtgtggaagctaaataccaaaatatagttattctaaaacatattattggcttgagactgctgatcattaattgcattaatttgttaatcaaaccaacatgttccatgccaaactgctgagtttgactttaactgcctatgtggcatggaacgtgtagtttaattagcacgttatgctatgcggcggtgtagtttaattagcacatttcatgctaggtggcggttaaccttgcatgatgcatatcaattcatctttttgtatacacatttcaattctaatgcaaaataagtgtgacatgtaaacatttcatcacagtacgaatagatcagtaattgactcattaatttcatctttatgtgtacacatttcaatgcaaaattaattttatcacatatgtcaaatagttaaaatatgatatgcatcgagattactttagcgagtcaaactagcaaggttagttttgattgtaaatattgtatcgagatgtataaacaaagggggaactgatatgcaaggtcaattgttgcataggcaatctaagttaaacttgtcagtttgattagtgagtttgacttattgcatgcttgaaaattaggtgaaaaaaatacttttcaagtcaaagtaattttgttaaaggattatgactcttgtttttatttttatccattggatttacaaatttgtatttgaatgtgactaaacattctaacttcaatttagacatgtaattagactatttacgtaacatggaacatattagtttaatcagtgagttgacacaatcaacgatcttatgttgataatatatttcagaataatctcattttaggagtatgaatttcctaaaggtactctgatttgttcaaatcagcccaaggaaacatataggagaggaagagaatgcactcaaattccaatttagaatttgatttttgatgatctacatgcatggttcaaggtgagccttttacaggcaaacttcatggcatataaaaatattaaacaactatagttaattgctagaaaacttatcaatgtgatacatgtttgttctaacttaattttttttaaaacaactttgcgaagctgaaaaaaataaccacttctaataacagttttttttctctctccaaaagttactacgttaactcaatagagcatcaacacggtttttttacagtataaatattttaaaacatcttttaatttaattttttatgaaaaaattcaaacaataaagcaatcctacattctgtagcataaaaaaaagtcctgcaatatccataaccttaaataatttcagaaactaataaaatccttttttcttatgaaatgtttgattggaaagaaaaaaaataaaaaagaaagaaaaacacgaataactatataatttattttgtttagattaaaaaaaaagaaaaaagaaaaaaaaagtttatgaaaatatcattccactttcctttcaagttttcaaattttttcttttcttttcactatctttgtctcattccaaacataatatattatactattagtatcatacaatattttcaaacaacacacaagtcgcgggtcccgttgtcccgggaaaccgaaaagcttcaattgtttataggaatactcgtttggttgctggcgccaaaatgaaaaggatccgcgtgacatctcataagccaatcttaaccgtccgataaacccacacacggatcgctccaaatccaaagctccctccttccaaaatttaaaaccctataaagcgctcttgattccaccaccaaagtacaaagcaatctcaactttcaagtttaggtcactcctcgagatggcgcgtacaaagcaaactgctcgcaagtccaccggcggcaaggctccccggaagcagctggcgacgaaggctgctcggaagtctgctccggcgacaggcggagtgaagaagccgcacagattcaggcctggaacagtggccctgagggagatcagaaagtaccagaagagcacggagcttctgattcgaaagcttccgtttcagcgtttggttcgtgaaatcgctcaggatttcaaaacggatctgaggtttcagagcagtgccgtttcggcgctccaggaagctgctgaggcttatttggtgggactcttcgaagacaccaatctctgtgccattcacgctaagagggttactattatgcctaaggatattcaactcgccagaagaattagaggggaaagggcttagttttgttatcccctttggttttagggtttacgtgtttttatttagccctttctggtttccgtctctgaatctttcaaggtttagattaattgtaatgatggcattctgaatgaaatattgaaattatgcgtattctcttctcgttttatattctttctgactagccaatagccattcttaagtgaatggaaatgatttgtagggtcttgtggttgactgttggatcagttgattatgcaaattgggtggtgtggtagtgtggttcattcactcactcttgcatgattactttttgtcggtaagataaatcaagcaaatttgtacttccaacattaagcagttcttttttactgtctaaaaaaaatacaactgtcttgttagatgaatgaagaagtcactgaattgaactgtgaaaaattatggcaattgcggcacctccatagtcgttttttattcttagctattaaatttataatagtttattgtattaactttgcctataaaaaggccacacatgtaacattttaatatatgcagtgagtgaacgaaatagtgagtgaaagttaagctaaattgttttcttcctcacagtgtgcgcgcgttagataattctcggtttatattctttcgctgcgtgtgtttgtgagttgtgtgtgaatgggtttaatttaaatcccacttttcacactttgtaaatcacagctgctttcaaaacaaatataagttcgtattgtgttctatcttgcggtttgtttgtgctctggttttgcgatggaaaatggttgtaggttgtgttctgatgctgcctgaaatatgatgcccttttatggtgatggtgttagaagattgtggttcctgctgcttcaatcattcatggtaatttttgttcattttattttttagatattaactgagtaattgtaatttaggctatctagaatttttggaactcaaaggattattcttgcctcttatatacaaatttttgtattagaagcaaacaattattcgattttgacatgtttttcaaaccaaccatctccatggtggatttaaagatcatgtcaaaatattgtagaactttttttaaatattgacttttagataacaaaaaatcttgtctttttcattatctatgcttattttcttatgagaatacttttggccttagacaaatgagagtacttgtagcttacaaataagctgttaaaattttcttttaactcttagatatgattagcgtattatccagatacaagacaaaggaaagtactatcctgtagcttacaaatataaaatacaatgtcagtttagttctcctaaattgtttaacagtttagtttaaacgaataatttttttagtttgtaatagtttacgacaatttaataatcaatttgaatcgaacaactttacttatatcattgctttaggtattgcttatttgcataaagtgatttcttctgtttgcgaactcaatcttctttttccaataatcttgaatccttcccatatataaatgcattttttcatcaacttgaacaacttctacgtctaaatgtgctaccaaggctgacaaaattttaatagatgaattcttcactaactatataaaatacctaattaaccttgtgagcaattgaacaaattcctttgttactgatcgtgccttaaattgaacatcattctttttaaaaagccatctttctttgcatataccctttgcacctaattgtctttttccaataatcttgaatccttcccatgtataaatgcattttttcactagtgtcagcttaagatctattttttaccatatctttcactaaaggatgaaacaagattttcaatatggagaatttgatcttctataagattcttaaaaatatatatattgatatattttttttaactctttctccctaatagcaaaatgagaaaggattcaacaaaccaacataagaagaagaaagcaaaataaatagccaaaaaaaaaaacaacaaaaatagacatttaagagaaggggggctcacggtggaggcttaaaaggaggaagagaatgaatcacggtaaaggaagaagcagaggaagaagacaatatgtgacgaggagagagatcaaagaaaagaaaaataaaaaagaggaagtgtgatgaagagatgaagaaatatttaatttaataaatatgtaaaagtgaaatctaggtgagacctatcaaaagttatctaaaattttaagatgaaatatatcaataaaataaaaagtgaatttttttataaaaatctttaatattaaatgatatttttcactaaaatataatctaagattctaatttaaaatctatcattaaagatattatatcacctaaacttcttttctttggccattacaatctttcatttttcatttctaaacattaaatagcttttttttttttttaattgaaaggaatgtcatctcttctactcgtgtgtgtatatatatatatatatatatatgattttttttatttgcagttttatacgtgtttttcaatctctttaattaatatcgtttatatgtttgatctttttaatctatccttttttgttctaactttagccaaattttaatattttttaaattttggtaataattaaaaataaatttacattatattttaattttttattatagattaaaatataatttatgcattacataaactaagatatttattctttacaatatacaaactaagataatttcatacttgtgactttaacaatttcacaaactaaattaaaatcctttttagcatacaaataacgagacccgtactcccgcgaaaccgaaaagcttggaatttcttttgagaaaaaaaggcaagaaatgagaaatacacatctccactccagtggcgccaaaccaaaactaaaactaaaaatggttgaaaaagatgaatccgtgtgatatctcaaaaccgaaccgtaaccgtccgattgactcacacacggatcgctccaaatccaaatctctgaaacacaaaactccctccctccaaaatttgaatctctcatctataaaactaaaccccctttcgctctaaacctcgttccagcaaagcgcaaagcattatcaactacgattcattcttccagaagcttctagagaactccagatggcacgtacaaagcaaacagcccgtaagtcgaccggcggcaaggctccgcggaagcagctggcgactaaggccgcccgcaagtctgctccggcgaccggcggagtgaagaagccacacaggttcaggcccggaactgtggcccttagggagatcaggaagtaccagaagagcacggagcttctgatccgaaagcttccgtttcagcgtttggttcgtgaaatcgctcaggacttcaaaacggatctgaggttccagagcagcgccgtttcggcgctccaggaagccgctgaggcttacttggttggtctctttgaagacactaacctttgtgctattcacgcgaagagggttaccattatgcccaaggatattcaactcgccagaagaatcaggggtgagagggcttagtttcatagttcactttggtttagtgtttaagtgtctttgtttaacgcctcgtttgtgaatctagatcgttgagctggtgctgattagatttcttgtaatgatggtcttatatatgtaatcaagtatttgtcttaggtacatatggtttgcctgttagttgtatcacttgatcaattaaatcggatgaaatggctcataacaatggattgcatcttaaaaatagcacacgtccacttcgaaggcatgctatgcttgctcttttcccagaagttgaggagttgaaggcttgtgagatgagacaatcgatcaggacttaactatagccctaaaattttagctaatttcaattcctcccggtgtgtcagcttcaagcattacgcatccaaactagacactgttgacatttggggttaggatttcttgttattctcttgcttcattaattctacaaacttcctaaaagcttcctaaagaacagacaacattagtaattaagttgactgaaacaattaatgaggcaataagtttctatctcataccgtaataaaatcatggggtcctggggatgcctctgggtggtattgaagagacatcattctttgagcagggaatgcaaggccagcacagcttccatcattaagattactatgagtaacctccactccttctggcagtgtggcagggtcaaccgcatagttgtgcttctgccaatgatattacaaagccatgccaggcaataacaacaacaacccagccttatataactatttacatgtaatacaatcttttatgttgccttctacttcttgccgaaacaaattcagtcagtggcattgacttcatgcaataatagcagactatattggtcaaatgagacatgagcttagttgtgcataaattgttttaacaccaaaacaagcattattctactgaatgcttcttttattttaagaaagtcagggcagagtaccaaaccttgttagccaaaacatccatctaaaaccaatgttcatttctcttctttagcatacctaaaagattcatggattttacacaatatatggtggagaaggaacactacaaaatttatcaaagaattagtgtagaagaaaagtccatttaatcacatacctgaacaggatgatttcctccatgatgaccaaatttcatcttaaaggttttgcctcctaaagcctgacccagcaattggtggcccatgcagattccaaaaacaggcacctttcccagaatgttctttagtgcctcaacagcataaggagcagcagatggatctccagggccattgctaaaatgcaccccatctggcttcatcttcaaggtttccgatgctggccatggagatggcaccgcagtgattttacagccataggatgccaagcgcctaagtatattatgcttaattccaaaatcataggcaacaacctatgattgattcaccacattaggtgtatattaacttatgtattagtcaagcaaaaggaaggaggcaatgcccacagaataatacactgctaatagttgcatggaaagtctccccatgctccttagaactaaaatcccattcttgttttgttgtatcaacccattcatgcacagactgacataatactctccacttattagatcaatacctgcaaaatcaaacaacagctagcacttataagatatattttcagagcctcaaacttatattatatccataccaacaatgtcccaagaattagacagcctaagtagttcctcctctgtcttagaattgtcagtactcaacacaccaataaggctgccttttttgccgtaatatgtgcgtgatagcccgtgtgtcaacgtcatctcttgcatatcaacaaagttaaaggcaaaacttgaagttgtacagagagtagattttctcaaagaattatatattttataaattacttacaaattcccatgatgttcctttctgctaagtaatcacctagagtttctgcacatctccagcttgaggtactgcatgaatttattgcaagtagaaagaaaaggtaagcatagccaaagtaaaaagctcaatcaatgaagaacatttgtagagcatgtgaaaaaaacctgatgctcaaacttctaattactaaatttacaccagtgttatcaatatgtggatttgtcatcagtacaaactgaccagcataaccaggatctgttagaatttcttgatacctgcagttaacagatattaataaataaacaaatgaaacatcggtatatccatgctcagattgaatgaatgccggtttatatataaagttagttcatctcacccagtcaatgatgtattaaaaacaacttcaccaacttgggttcctgaagcaccaaatgactttgctttccagattgattcctttatttttcttttttgttatgtcgtgctgggtatcagaacagggctatagaggttgttttaaattttcacaagtattttcttttctgtttttaatttctgacgtttctctttcgtctatgtagcctttaaaaaaaaaaatacagcatgttgctaataattctggtatagggtgttggattttaatctgattacttgatcgtaacgtgcaaattattgtagtagatctcaaaggcttgcagaatttggtccggtgtcacaatgacggcatgattctgataagattttatatagcttaacactatttgtatattaatggagataaataaatgcaatttctttatgatattaatcaataataacaaaaaatagatattaaatgaattactttcaaaatttctactccattttatatgaaaattgttactagtaagtttcatacttggacaaccctattccgctgcaatccactcaactggtcatgataggcgatcaagaaactaagcaatcactgctacttcagtaaacataagggttcacaattcaatcataggatcaggcttcctaccattagaatacccatcaagaaattctcatcacatggagtttggcagttgtttgtttggaaattggctgtctacccttgaatcatttgagtatctttaacacaaggtatgggattgcatataaggaacatctaaaatgagtatttttcctaaccaattcttttgacgataacacaaaacaaaagtatattaaagcagaaaattgtgtaaatgatagactgacaaatgaattagagagatatataggaagtagaagggatcaccacctttccacacctgtgaatgcatcttaaagttgtttctctaggtatattttatttcttgtaactaggcgttattttgtcggctatttcttgcaacttagtcctaatacattttaaaccacaaactaattaaatatttaaataataaattaattattacacatttaattatttaaataaaccacaaactaaatcaactatttaaattaaaaaataagaaatgacgaggggaattcaactttccaaatgtcgattttcctttttctaataaagaaaaaatattaacgttcagaactcatttttcaattgtcaatttcccaatttttaaaaatgagtattcggataaatattttggaggataagtatttgtgtaaataactttttcattctatccatttattttttcttttttgcactcaacatagtattttttgtatcagcgtctcgagaacgcaaaatcaaaacgtgaatatattccgttaatgaaaagcgctagcgggtagaacagaataataaataattgaagattgagagaagatacaaaacagaagagagatgggcgtgacgaaggaacaagttgaattatccttgaaggccaaactgaacccttctcatcttgtaagcttttttttccctctctttcactttgctatgtttcgtgtttcacatgtgtttcgttttctcatttctggcagttgtggtgactattacgtatttattttgcaattttaccaccagtgtgtccgttagttctaaataatctgtgcattcaattgagttctccttcttacttaccaaaatcccaaaagtgaaatttcggtatattaactgtttggataaatttctcataaccacttatagtaaaagaaaacaagaaggaaattgaagtaagtttctccataagttaaaaaccagcttttgtagaagttaatatcagagagcttctacatattagctttaacgtaagttaattttagcttttggagaagcttactttatttttccttattttcttcttttataagtacatgtatacaacctaaagtttcatcttctaaatgactaaatgagaaatagcttttggttgaaatgaagctttatccaaggagtgaagcataattcgttggtttatctagagaaccatgaattggtttgtgggtagcaattcatggttgagttgtgagttaggtcactcccattcttgtttcaattcatgaaaatgacagttggagaagagatagacaggcagggctgtgaaggtagcatcaagatacccgagtaaagggtggagcttggagttgatgacaacggaataacaagtggagatgtagcagcactatcgggaggaagagagtgagcatgggaatgctcaaactcaaagaaccccatttgcactatgcaaattatgatgattgtggatggtcatctgtgtgtatctaattgatcttcaatttcttcgtatctttgtgtatttgggtgtgagaatctgagagaaagaaaccctcgcatcccaaggcaagtacaaaagcattccacaaacccactgcatactgacctatcccattgtactgcatacttggcaagatggcacagggcatatccaaatttgtaatatgtactggatagtattgcgaattcttaagccaccagaattgatctctttggctgtctggtttcatttgactgggttttactgctttgctccttttaatgagcttaagcattttttttccaagttatttccttatcttctttctttggtgtatatgcggcaacaagttttgataccttgtgcaaaatattcaaaccctcaccacttggccgaccttagtgggttggttatttccatatctgactgcaaccattttgtagatatcaaagagttgctgacataaactgtcttctcctgcatggattattgactttcttatttatttaattgtgtgagaatacatggttcatggtgcttctacttatccatttgatctttgtggtttagttaatgcattggaattttactcaatctaaaattctcatgtgctctatggtacctgttattatctatgactatcagaaatccatataacaattttgcaatttcctttgacactggacaatctgagtgaattatgcagtgaccttgaattaagtgttggctcttgagtttttcacacgtgtccaatcttgtaaacatttacaaaaattttatgtttgccaacgtcgtggtttgcttcatcacaaaaacttctttcagtatttttaatggagagcttaccacttgcatgttacatggggtgtgtaatactttaaatatgaaaatttgttcatgggagttacgcacaacaaatcaaattttatgcaccaaacatgaaatgggcgaatttcaggggtgtaccctaccctgtatttgacacccctccctttcttcatattctgtgttctgattttattgtatttgtgtttcaggaagtggttgatatatctggagggtacgcgtttttttcccccactaacagactttttgttctctactttgtagcactgtttacttcctcccttttttttttttttttttttatcttacaatgttataatgtggctattaggtgtggtgcaagttttgtggtggagattatatcagaacagtttgaaggaaaaaggttacttgagaggcatcgaatggtgaatgctgccttagaggaggaaatgaaacaaattcatgctctctctattaagaaagctgttaccccagagcagtggaaacaacagcaagaatccaaccaatcaaatcctgctgcctagagcatatgtttcggttataaaataagaaatacatagtgtgttgctgactattgacattgtttgtggactctagttctatgtagttttatcgacactcaaatttacaattgtactactaaattttagtttacaaaatttctggcttcccgtaagttattttaatatgtgaccctctttaggtaggaattttcaaataatttgtcccgtataccttctaggaccctttttttctttcttttttttacgtgaccatgagtttttatggtcttatataaatcacccacgtcccgtgccactagatatagtgacttttaacttttttttaaagaagtaaaatatgaatctaggatattttttttcgagtctagatacattcatttttgtttctcttaatttcttaccaactgcactctttctatgaaaattgtttacttgaaaattttagttcaattgaaggacataccagttaccagatgaattttatttcaagtctttagggattgttgccagatcttaaactgcattagagacacttgaggatttaattcgtcgtcttttgcgttgcaagttcccttgtttcatatttgtgtctgcttatctcactagaaggtttactaaagcttctaagacgtctttgcaattctgctctttcccttgcaaccaattaaccagcttgagaacttttttctttctatcctatctaatcttatcccagacacatgcgaagtagattaattcataaatgttctgaacatgaccctagtgttgtgtacactccttattgaaatgaagactcagctgcagggtaattttttatatcaaaaactttacaaaataatgtttttttctctctattagaacatgggcctttttaggttggcacttagaagaccaacgcataaagtatctatcaactggatctcgtgtccttcaaatgggaacttctaaaccacatgtctcgatagacccacacaacctttgttataaaaactaaaatgtgtcacagtttccctttggccgaaattttcagccttaataactccttatcagcaaaatagatagagcaatgagcctctcctatgcttcatccttctgtctctcatcccacgtgaagattcaatggtcactaagctagttcagccaccaatgacagactcccatgtgagtcatctcatttgtagaaccatgaatgtcatgaaactccaaaattttgttccatctagaaatcattcaagaataaacacttcaaggtttggtgagagaccattatggtttagaccatcacaatcattaaaagttgcagaacacaattctggctcaggcttagctgagcttgaaacacttgctcagaagaaaagagagctttgccaggcggtggaaggtacacactccagttattatcatctcacttttactattatgattgaaaaagggttgcaaaaaaaaaacatgtttcaaggaatcaaaaggggaatttttggaatcccatctaccaagaaatctgaagttgaaagtttggtgaagcagctagaatctctgaatccaactccatacccaactctggcacttgagaaggtaacaccgatccttcttcattggcatggtgatttgatgacatatccaaggtactaaaacaattcagttctgaattttgtatgataaaggctgtttttctttgaattgagattttatttgataacattggacctcagaagatacacaactatgtactgtttccactatttctatttttttaattttttttaaaattttatctactgacttttaactttggaaatgtgatttgcaaatggtgagcaaagcagttaatgtgatcaagttcagtgcaaggggattgagtttgttgtctggacagcttagcattgatgcctctttcaggattgcttcctcaacagttaaaactccacttcttgtttggtcactcatttctctgtaaagcattaatatggcttccaaataactacctaattggttactgcttgaaattgacagagggttgacattaattttgaaaactcaacgatcactcctgaccgggtatgttagccatatactattacatttttggcttaattgtgattttaattcttatatcttaacttatgagtgttttttttttaatcttccttattctaattattcgcatttagtactcctagtgttccaattattaaaattaaatttcatactccaaattctaatatacaatgggagaatattgaagccgtggcatgacattgatttgaataaattggcaatgaaaataatgtattttaaataaaaaaatggatttcattatatttaacttaattactgatcgaaatttggggtgtgggacttgattttaataattaaaaaattatgaagattagaaccgaacatggaattaagaggggaaaaatcacacattggctaaattataaattataagaactaaaaatgtaatcaagactataaattttttttaaattataagaactaagaatataagtatgataataacattattgtttggtctaaggtggaattttaaattagtcaaaaacaaaaatttattaatgaacagaagagttatagaaagaaaaaaaaaacattattggttggcaacaattaataacgtggcccaacgttattcatctttggcaaaaagagaagcaaacactactcattctgtgtatccatcatcaatggctgactatgaaaacgaaaacatagaagcagaaccaaaagagagaggtttggaagcgttgatccagctccatttcgagaagacccttgagaagaagcgtgccatagacctccaaaagaaggagctccacaagctctttcagtttttcttcatcctcctctcccttgtgttcatgtccctctctcactcacactctcaccatcttcaatgccgccattgctggatccctattgttaaccgcctcttattcataactcatagagtttaaacaaaactccaacaatcccctggatcccagccaggggcgctgcctcttggaaccccgcaccgtaatcgcggtcaattatgcgttggctcaacaagtgtgcactccgcactaccctaacttgtttccaaagcttaacgcgtaatcgcattggcctatagtaaatcacattactactaaaatccatagatgacactaaaatcaccaacaaatcccccccattttagtgtaatccttgatctactcagtataacgatcaaacaaatgcataaatgaaatgtcttgcgattgaatttcatcttagtacaaatacacattccatatactcaagaatcagggtatcgttacgattgaacccgtcaacctatttgaatatctgaagatattgtacacatatgttttctacaacactctactattcatacttgacactttacaagccatgtgtccttatccattcgtaagcatataggaagccaaatccaaacttcttgaagcggcaaaacttcatgctcacataggtgatccttttaatcttgtaccagcatttacaatttttcaaaagaaccattaagaagatatacttcaacctaaccatcacttgcaggtctgagcaaatgccttgggaagacaaacataattgctccaatttctaattataatctttccacattgaattctgcttctaacgttgtattagaagggaattgggtatatcgatcataattagaatatttaaatggactttaatcccatccctattaccgacttctttactaagtctctagctaaccccttcgtcaagtgatcagctaagttttgttgcgaccgaacaaactcaatgtaatgagattgtgtaataacaatccccttattttcccgtttaatcttaataccaaggataacgtctgcttctcccatatccttcatggagaactttgatgacaaaaaattcttcgtattattaacttgattttggtcggtgccaaagatcaacatgtcatcaacatataaacaaatgataactcctttaccggatttatcaaacttgctatatacacatttgtcaaactttgttcgtttgttagaaaattagtatgataatcctggataaattcaaagaatcgtgttcgtacactttccgaacaaagtatttcgaccctattcttgcctgggttcacgaaatccttgttgggataattctttgaagaacaatctgcttctggcaatagagaacagatcaggaatgtagagagaaagtatgattttcgtatatattaaatctgaggccaaatgactccttatataggagtttttccaaacaatgcaactcttggcgataaaccatcgtaaccgttggtgatcggagcggttgggagtagttatttttcttccctttcccaagagcggttataagtagttactattttgaattgttaaccgcctcttattcataactcatagagtttaaacaaaactccaacaatcccctggatcccagccaggggcgctgcctcttggaaccccgcaccgtaatcgcggtcaattatgcgttggttcaacaagtgtgcactccgcactaccctaacttgtttccaaagcttaacgcgtaatcgcattggcctatagtaaatcacattactactaaaatccatagatgacactaaaatcaccaacacctatcaccctgctctccctcgcccaccttatcttctacgtgtcactcgctcagaccctcagatgcatcaacgccttcaagtaccagaaaaggggccacaagctcactcttgccttcgcaacacaaaagctcagagagatgaagctcaaggatggtactatcgcagatgatcaagaatttgagattcagtatcaggaaccccccgagagctattttggtaagttcaagaggaattgggctcttcattttgggttcttgatcatcatctatgccttcatggtctcttcctctgtcattctcctctgcctttaacggctatctatggtaattgctttgtcacactgtgccatatgcttgatttgattctttttttcgattcagttcggcgtgtgtaagatttgaaatccattccttagtcattttttgaaaaagaacaattacatgtcattcctaaagctagaagcaattcagtgaaagatctaagtgcagatagttaaatgaggtaagccaatagcagcaatctaatatgattgatcagtgagtttgaccttaaaaaattatattagtgaagaatttagaagtgtgccggatggtttggatcttgtacgtggaaaacaggacacaaaatcaagttatcaactgacgcgaaaagaatacatgttacatactttgttgaattgtttatcaatcattaagattctttatgttgaaatgaatcccgcagtgtgacattacttttcttccattcagaacaaacaaactggatagtgaactactgaacttagtttgtccttattcaacttttaccatctaagatctttcaatttaaacatgtttcagtgttctgtttttgtagtagctattaccaattatacgaaatataaaaacaattacatatctaaaaaattaaaatcattaataatgacgcatctataacagtaatcctaaatcctaataatatacccaaatggtgcagcataagtgcacctaattacttagaggttaaatcttgtacttatcaatatacagatagttgtggagtatcaggttgatactattgttcacaaaataaccaaaataacagccataaaaaggccacaaatgtcttctaccaaaaaaaaaccacctagaaacgtagagaaagactgttttcgtagacaaaaatagaatgtctaggaaattccttttggaaaaatcggttataataacctcatctaattcaaagattttgatacaagtaaaactgcagaaccacaaaaatatatataaaatggcaaggcaaggttctacaaacacttacttgatttaacataaattcagataagccgcgcgagcattgtataggaggagttcagttacgataaggaaaaaccaaactttgaacataatcagtggcatacaaccaaactctttggtggtgaatcttactatgctctataatgttatctctctggtgatacgtaaaaattaaaggacctggtttacatttacttccaagaaaaacaaggtcgccattttcagacatgctcaatggcgaacgaataaaaaaaggtagagtaatcgcaaagtcgtgccatccagtttagactgccactcacgaactgtcctttacagtaggaactagctcgctctggttggggaaaaccagtccaacttgcaacctttctccaacagttatcacccaagcagagaactctcacttctgttttcattgattcccaatccacaaccactgtaaccactttgtaagtgtctcttgaacccaagcccaccatcttacaaccacgtcttggggtgtgaatttgtaactgtatgcgtggtgatttttctgatattaacctcgtatcagggttccaaaaccggactcaggttaagtaaaatctatctttaacagtctcagctctcaaacagatcaaaaccattgcataccccagtaaggtcgtacttcatattcattgggagaccatcatcatattcattatcaactgtgaatgatggctgctccagtaaacgttccacggtgctccagtgtagggaatatggtttgaggtcatcatcatcatcaatgttgcttcccggccagtagcctgaataggatcataggggtgtttctgtgactgctagaattttgaaggtgcagcttcacaaaagtagaatcgaaaacgagcgaattccaagacttgcaaacacacttgaatcgcatcatcagagacttaactggaaggaatgacaggatttgctcgagaaattccccaggaatatactgagtaccacgcattttcgtgatagttgatgcgataagaagagagaattattggtttgatgtttgaaatatcattgctctaaaataaaatattgaaataccgaagaaaaaccaaaagcataagatgctgtatatgcatgtcaccagcgtcggatccacgtttgcccccatttaaaattacgaccaattgccaaaagtccaaaaaaacatgacattacataaaaaaaaaaaaaaactgcatgctcattgttttgtgtaaaattagatgttgacattttaaatatggatgatgcataagcagattaaagtctaaagtttggaatgtttatcactttcaagttgggctactttatcaagtaatttatagataacttcaagaattaaacaatagatttgtggaggtgaacactaagttacttttttgtataaacttaaatataagagattcaaattttatatttgataagaaaaagttaatctgtttgactaagttttatttatcataaattacttctatgaaactcatggtgtttgaaaatcaaattgaaatttttattggagatatttgatcatctcatgatcaatttttaaagttaataaaattaatgatctttttcaaatgttggtgaaaactaaatatgtattagatggtataattacttgtgaaagttaattttaattttgcccatgacaactataacaattgaaaaatgtgtttttctgcactcaattttgtaaaaaatagaatgtgcaattacaagggagataaataattgagttgtttgattacatacataaaatacaattataatttatacaatatagatatttaaaatttctttgttcatgacatatatattttataaaaccttattgttttacttttgttgaaacataaattattttttgtccccccagtaaaaataataattttaaatccgcttatgcatgacagtgttgcgcgtgcttcacattcggtgcaaatagtttactggaaaatcatcatcctcgcaattagcttgcaaatagtctcgaataagtttttatcataatctattaaagatgaaaataagtttttgtttaaaaaatacaataaaaatttgagataggaaaaaaataaaatttgataaatgagcttgtagaagattttaaaatatatataatgataagatgccaattttcataaaattttagaaaagtaatttattatgcatatgcatgtaatactaattaatgattcatatctcaacagagatatgacttattttgcattttttttaacagaatgagttattttgcatatacaattaagcattaatttttgaataaaatatgttttgagtccttataaaatttgaaaaatattaattttattctcataaaacttttcgtgttaatttgatcccgtaaaaataaaacatatatttactagttctcaataacaatttcattatacgataatatgatgtgattaacagatttagatttacaaatgtaatttgattacaattgaattatatgttttgacagttaaaatcctcataatgaattaaaaaaatttatgaagactaaaaacccccaaaaattaaaatttctctttactttttggatcatttttttcacactttttgatgagattaggggaaagatgaaatcacaatgagttgtgccttttgagtatgcttggaaaggtagagagagaaaataattaagtcgattagtcaactctttaacgaagttaccaatgaggactaacaaaaatatgttttattttatagggatcaaattaatacaaaaaattttatgattacaaaattaatacttttcaaatttgtatgggatcccaaatatattttactcttgattttatttattaatgattgagattcttttttgtctaggtaaaagatcatgggtgtttctcaatccagattaaagattaattttgctcgttataagtaattgttactaattcaaataatttttgtaaataatgaaaatcgtacacaaattttttggctaaataaatcgctctcacatgtaatttttttattaatgattgaaattatttatttcataattttttaaagataaaattatttttattttagaacgaataaaagttttaaaagatattttttatgaaaaaactattgaattaaatatattgatttttttaatcttatcttaaatgaataatcgtttagaaattaagaatcaaaatattcatttttatctgaaccaagatgatataaaatgacaaaaatatttagttctgttgtagttaaaaaatttatttttgttttttggaaaaaaaagatattatttcattcataatgataagatgtaatcaatcatgagagccaccataaaatattaagcccttgtgaagtttaacttacccataaaaaatggtgtttctaattctataggaccaattaatattctaatagagaatatatatagagagagagagagagagtcataaaatcaattgccaaaaaatatgctcatcattgaggtgacatgacatccgtgaccagcgggataaattaagaaaaaagcaaggaaaggcaatatattcgttgtccaaaatttttggataattaacatatattttgaggattaaggagcgaacacacgatgcaagtgtgatgaatgatgggcgacacgatgtaaatgtaattataagcacaccacaactacgatcgacgttttccttttccctcgaacacgacagctctactggattcgtgctgtctcttagatcacatatttttctttcttgttgccgtctaaatctttttagttacagaaaagaagattcaactatatatagatgaatgaaagacggctagaataaactcgacacatttacacatgtaatttggtaaaacaaaaaaatatataaattcgtttcatttttttaaaagtttgtacccgactcatatagttttggtacgagtttttttttaaaatatttattaattattctattgtattttaattggggttggttaaagaaaattattattggattattgggttatgtttagttattcgttgaaaagttaatacatgtgttacgaatgtaaaacaaatttcttttatttgatcaaatattaaatatgttatagtctattctaaaagtacattctacctaaatgaaaatgaagaaatcgtttcttaaattttttttatcattagagcaaacgcacgtgatagagtgcgttatttcactcttcataattgtttattatataagatacgatatcttaaaaaaaataattcattcacatctaacaagtataacacacgtatagatcataaagttatagatcataaagtcttcatgaaccagtttgaagagatgaaaggaaaaaaaaaggaggaaagaaaaaagtcagatctccatcaacattgacttttgagcccaacgaagttgaagaaatagctggaggcatcgacacaagacgcacaatgaccaacgtcgatgactccatgagctgcagtggaaagaatcaatgctggtggctggtgggaggatcgtcattggttaatggtggacactcggagatgaagatggtggctgtagtcacttggagtagcactggtggttgcagtggcaagaagcgatattggtgatgcgtgaagagagaaaagtttttggagagagagagggacttgaactagaaaagagagaagggttggtgggaaggttagagagaaaaattattttgaagagataaaagaaaatgtgatagtgcgaaaggaaaaatcacgttttgcatagaataaatttagataaaataattaattattttatttgaataataattaagttataataaaaaaaatataaatatgtgaatttttgaaatttcttgagatttcttagcttgaagtaaaattttatatgaatttcttatgagtgatatggtattgtgagaatcacaaagagtattataataccacaaaaaaatgactaaaaaacctatattaaaaattatggttagaaatactcttagggtctgtttggatgtaaacttctctagaagcacttctagaagaaaaaaataagaagaaaaaaaaggaaatgagcttctctataaactaaaatgagctttccattaacttatttgtagatgtcatctcattttttaaagaagttatattgatgagcttctaaaaattagctaatggacaacttatttttacttttggagaaactcatttcattttttccttcttatttttttcttttagaagtgcttctaaagaagcttatccaaacagacccttagtctagtcaaatgaacccaaattctaatacataaggaaaaattcaaattatagaagacatttgtactgaaaaaatctcgaacaaattgagaagatcttaactccaaataaattagaaaaagaaaaccacaagtctaataacagtaatggcatagggtaacaggaccaaatatttgttaaccttcaattattaaagttcttaattttttttctgtaataaaaaaattgatagaatttgtcaatgattcaaacgtcacagtgtgcatatataccgtgacttatgagtgctctttctcttcaacgctatctacaactcccaaagcactctaaagctctaacttctaacccctcaaagtcagtaacaccagagagcagtttagaaagaaaattaatctttgcttatgttatctatgattgaaatgatagaaatagaaagtataaaattaattttttaattaaagaataaaagatgtgaaattcacatagaaattatacaattttttttttatatttctctcttcttcttctcaacgaatcacaatattatgttgtatttgacagagagagtaaaagtatgtaacaaaaaaatgaaaataaaataaaataaaaattgtttgataaaagagaaataaagtaaaaatatgtgagaaatgttagatttaaaatagtttgatatataaaaaaagagagaaagaaaattacgataaaaagtattattgtacccttgcattaagtgggttgttatttttattctacggtaacagtaaaaattattcatcaactgattcaactttttcacctgttgagaggtgaaatattgggtcacggatccaccaaaatatttgaatatttcattccaatttcaccgctcccaaaccttcggggctaaaaattaaaaataatataaattaaataaaaattaggtaaatggtgcaatgtgaaaataaattggacatttggggtactcaaacaagttaggtttgggcgtgtttaaacacgcctagattgagtgtgtttcaccatattgtgacacgtgtcagggatgcacaatgttgaacgaacttcgaacggttctaacttttgactggaatgtccgattgagacgaaactggtggtcacgcgctcagaattgagaggagaagccattggcaagtttccaaaggggacttggtcaaaaaaatttcccaaaagaggcctctaagtgcctcaaaaatgcgatttaatctttgaacacccaaaaaatttcttgttttataatttttttattcaattattgaattgcatgctagtgataaatttgcctaattacttctctaaatttcgagcattttgacataaaatccgcctccatcggacatttctatcaaaagttatgattgttcgaaggacatattgtacacctaatttgggctaattttttgcataaattaagatgtaaaaataaaaacatcaacttaaacaatcatgggtgaataaaaattaaaaattatatgcatatttaattatatacaataattaatttgaacaacaaagttaataaaaaattagcccaaattaagtattttttttatatttatttaccaaaattatactgtaaatttttaaacattttcaattcaaaaaaaaaattaaaaaatgacaatattctagtcgcaacacattaaaaaaaaacacaatattcagtaaaaagtgttagcgactgaattagagaccaattagatacggatttttaaaaaatttaaaatgacaatattgtggtcacaatactaatttcaaaagttgaacaaaattatacggtaaaattgctaccacaatattgtcattttttaattttttaaaccaaaattgtttaaaaactacaacataattttgttaaataaaaataccaaaaaaacattacaccattttgataggaatatccgatgaagacggattttatgtcaaaatgcttgaaattcagagaagtaattagacaaatttatcactaacatgcaattcaataattgaataaaaaaaattatgaaacaagaaatttttttggtgttcgaagattaaattgcaattttgaggcacttagaggcctcttttgggaaatttttttaaccaagtcctctttgaaaacttgctaacggcttctcctctcaatttcgagcgagtgaccatcaatttcgtctcaatcggacattccaataaaaagttatgaccgttcgaagtttactcaacactacgtatccttgacacgtgtcacaatatgatgaaatacgctcaatctaaacttgtttaaacacgtccaaaccagacgtgtttgaataccccaaatatcaaatttatttccgcattgtactattacctaatttttttatttaatttatattatttttaattttttgccataagtatattcatgaaaatgtccacatttgaggttgtcgagtagcaaccaatgcgtgacaccaactaatgactactatgttactatctaacgaaaataccaaacatctaccgaagggtccactacattgctgtccatccatgcctacaacgcccatccagctggaatgcccacttctatgtgcagaaaacatagaaaaattgttctacggccagtgacatcctcactttctactcaccaatacgtgttttatgggaatatcaatattataatctaataaattttctaaacaattattacctaatcttgaattaatatcacataaggcagactaactatattaaaaattatattttcaatgattaatcaattaatgtaaagtaatagctataaattattatgttaacaatgaattaaactaaactcttaatattattaatgacttttatatttttctatctacaaggcgccaataaagatcaagcctaagtccccatacatctaccccaatccctcaccctatagaataaccctagtgattttattattaattcttaagtttagataaaatttaaatgtgtttttaatattaaaaaaagataaagtatgtttttaatttctatacttttagtaaaacttggttataatttatgtaatttcaaattaatgaatttcgtccctataatttacaaaataagtaaatttagtccatatttgatctctggatcatcactatgcagggactaaagaaacaatttttaaattatagttgtatagacatcaaattaatcgatttaaaactataaagactaaaactaaatttgattgaaagtagagggactaaaaatatatttttatcttttaaacaatgtttttaaatttttttaagttttattgtttttaataaccatcttaaaaaagtaacacgttttaattccttcatcgttaattggaagcagttttttatatcttttaaatattaaaaataaaaaatttaaacatatcaattaaaaaatatatttaaatctaaaaaaaataaaggtgaaagaaaaattattttagtacattcttttgtgtcacttttatttgttggaatctcttagtatttaataattagtgtaaaatttaactaaactactaatgagctatttgactatactcgtaaagaaaataaaagttaaaatattaagaatttaataatatgagtttttaattactaatatttaacctgaatattatcattcatagttttttttaacaatattatcggtcacaactttattggatttgaatattgttatcaatgcaaaggattgatataaaattttatcatatttatatgtgaaaaataatttatttaacatgataatacatattctatttcattagtgtgtaaaattttgtcattatagcatatgaaataatattttttatctagtcaattgatacacactcatgatataatatgccatccggggaaaatatgcatagctctaacaaaaataagataattcacaatagtttttttcaacctatggtaaaaaaaagaaagtgaatggaaagattttgtagaaataaaatatgagaatatataattgaggcagcagaacaagaaggggaactactacatacaaagtgtcgttttaaattgctttaccttattgagccaaggcccagacagacaccgcatactcctctctctcacgagtcacgaccattgatttctccgcacgttcctctcctaattcccctcctttttcttgctactcttttgttttgaggtgaaaactgaaaactagaacgaagcgtacggagagaagcaaaccaaacgaaaccaatgggaggatgtgcaactaagccgaaggtctccaaggacgataccgatggaaagcccaaggcaccccaaccagaacccaaacctgaacaccaacaacccaactacaaagacacccaaggtgctgctcacaaagaccacgacaaccttaatgtcaacgaaattcttgacgacgaccaagcaaacaaaccacgctctctcagctccttgttcaagcaggtacgctctcaaattccacaatctcaaccctttttcctttttttcaaccttttgtttttagtttctataataatttggtcaaccgtagttaaggtctctaccattaagctggtttacttacaatcctcctaactttaataaacatgatgaatttttcacatgtttttttaagtttgataaccgaattaatgataaccaaattcttcaacatgaaaagggaatattaatcatgtttaaccaaaaatataggactaaaacacattctttttctctttactttttacgtttagtgttggaattggaagtaatattttctgctgccatagaaaggtaacttttttttttatttatttagttgtaacatttttctacgtatatcccatcatcttcatcttatgcataaaagaaagtcctagtcaaatttccccaaaatgattctctgagtccttccatggtggtatttccaatactccctgttccaaaccttttttctttctctagtctttttttaataaatggataaaatggagaataccgctacaattattggattttgttatttgctacttttcttttctggcttgctggacctatgaacagattttcttgtgtcattccgttccatcccaaaaagaaaaggaaatccttacatctttaacttattattgaatactttgtcgtactgattcttggtccacttcatgactttacccaacaaaatcaccgttgtcccggtttaatggctaaaaattttaggggtaactggtaggtacccccaatcatgcgcatgtaaaaggatacaacaatatgttccaaactatttattttagaaataacatttgtattttttttatcacctgactccaattatgatatatttttttttataacagacgcaaggaattagaagcaagagtttgaaactttaatatttatgcactgtttgtgtaaaaaaacaattaaataatgaatcagaaataaaaagtcatgataagtacaattttcaaggtacttatgaaaaaaaatcaacaaatttaccatatgacaacatgtagtattagactatgtacatgtattatttattctaaaattaataattactaaaaaaaatgttatcaatgcacttttcctttgatttttaatgttttcataataacgttttaataaaatctttattattaattttttaactaatgcttttaacaagatctttttttatgaataaatgtttacttcaaatcgtaaatggactttttctctcatttctgttttggtactatttatttttcacttgtgtgtgtggactgtggacaccgattatgtaaatattgcatttgattgctttggcaagcttctctttgtttttgaaagattcaatcagaactatcacaaaccttacagcctctttgtttgggcattaaaatcaagtctcatttttaaataaaaatatatgttttgatgtaattgtaagatgaaaattaatttgaatacatttctttagtacgtagtaaaattaaatatactaaacttggaataaagtcggacggcgaatacatgacaaataaacgtgcgatcccctggagtcccctaatcgtttggatccaattcatcacgtttaccgctatcatcgttctcatgctttcattataattaattagtgtctccattcagcagaaacatcaatgatttcaaacaaaaggttattgatagagttttgcagtacacattgattatgcggagtatatgattttattttttctatatttaaatgtttatacaagaaataataaaacagagaatagaaaaatactatttattttatataaattgttgaaacagtggataaagtaaaaattaaagtgatgtaagaataaaaataaataataagatatgaatcatttttaaaaaccaaactaccttatttttaaaaaaataatgagattattatagttccttttttaacaagaacaaaaatattcccttaaaaaaacaaaaaacaaaaatattaaaccaaaatgacatgattggtggataatttttttaaacatatggtcataaatttgatctatcaagaatacctgattttttaaaaaaattaaaaatattaaatcgtcaaaagtttgactatgacggaattggaacctccacaaacaaatggacctagaaatattatgatgtccatatgcatggtaggtagtgtgggtcttcagtcccgtacatataatgcctgaagtagatttctgttattggtattaattagaccatggttttccctaaccggatttttagcatgttttgcctccgaaattagaggccttgaaagttgaatatgactagttaaatttgtgcccgccacaaattccggtgacttgttaattcctctgtagtagtctaaaaagagcgtgagaatctccccaaacagagtatgtgaaattttatgagtagtaggttaaaaatttcattgtgttcagttgatagaatctcaaccaaagggagtaaggataggcatggcagcatgtcccaaacctgtgggtactcaatcgaattcattccaattttagtgtgaaaaaatcaagttaatcgaatttggatttgtgtttaagttttttcctgaactccaaaagcggggacggagtgggtatgggtttactgatacctgcccccgctcccgccccgtaataaataatattaaaaaagaaaaattattttataatttttttaattgaattgattaattttgttttgtaattttaaaattatgatctcatattttaaatgtgattttgttattgtttttttgttacataattagcattttctttgattttttaaataaaaaagttattttatttatttatttattttaattttaatcaaatagcgagggtgggacgggctgagaaaatccaactctagcggagatgaggactgggggcaggggcaaaaaacgggttttgaatcgggggcagggaatacaatacccacccccgccctgtcattttgccatgtctaatatataaggcagtaagatgacaaagtctgtccaccaaatctttttaccccacccccaccacacacaaagaaaccagaataaatgtggcactcattgtcaaaattaaacaaaaaaacaaactaaaaactgtaaatatgacatttttttatctctttaatttagattgagtgtttggttttatattggttgaaacttgaaagttaccacttccggtcttttccgttaacttggtttaagcattgatatgatgaatgaaaatatcaacttattcatgatttgctcgtgttcttgttagtaaatttaattataatacattattcaaattttgaatacatactgattcagaatataaaggtaagtttggaagcacgtattcatttacccatcaactcttccgcttattatttcagttacctaacacaacctcctgaattcaaacataattgtcgacccattatataaagagcattcctgaagtttctgaaccagaaagaaaaaaaaatcattaccaaaactgcatagtaatacagtaataaccatttttaaaaaaagacagaagatcagaacttttgaatttatttcaataagtttcacatttaagatcagacacaaattttatttcataacctttttatcaagctagcgcttaagttattcatgtacacccaaaatctattttgatttgtaaaagaaaaaaaaggggaagtaaacagaatgtgattactgcttggctcggaagcaaagaaggaatatgaaatatttctgcatcagctcctacatgattgtattgtatcaaccaaactagagactatttagtggcaacatttcttgctcgaagcttattcattaaagcctttcttagcactctctgatcttttctggtttatcacttggtgtgtgtgtgtgtgtgtgtgtgttgcagaatgaagataaaaggggttccacagaaaatgagaaaaacacagttgaggagtctgtgaaagaagaagtgttagaggccaagaaacctgcggaggatactaaaagcaatgagccaacagttaaacaagaatctctaaagccagaggagaagctgtccgaggagagtaaaaacaatgaatcatcaaaacaagaatacgagactttgaagacagaaattcatgtcaatgaaccagataaggaaacagtgaaacgagagtcagaagctgagaaaccttcagaggaaactcatatcattgaaccagttaaggaaacagtgaaactagagtcagaggctgagaaaccttcagtggaaactcatatcagtgaaccagctaaggaaacagtgaaactagaatcaaaagctgagaaaccttcagaggaaactcatatcaatgaaccagtcaagaaaacagtgatagtagagtcagaagctaagaaaccttcagaggatactcttatcagtgaaccagctaaggaaacagtaatagtagagtcagaagctaagaaagcttcagaggaaactcttatcaatgaaccagctaaggaaacagtgatagtagagtcagaagctaagaaagcttcagaggaaactcttatcaatgaaccagctaaggaaacagtgaaagtagagtcagaagctgagaagccttcagaggaaaacggtcaaagcagcgagtcaccgaaagaagaatttttagaagccatggaggcactttcagaggaaacacaaagcaatgaacccatcaaactcaaagaagagcctattgaaccatcagaaggaggtaagccaagtggggaatcagagaagaatgcttcagaaactaggactcccattgtagagagcataaactatgaggtggctcctatgcctgaggagagagtaattgaagaaattccaactgttgcaaagtctttagagaaggtaacaaaggaagctgcatcaagcacagaagagaaaagccataatggagtggagaatgcacctaaggctgttgatgctggcgctgagattcactaaaacctgaaatctgaatgagagccatgaacaatttgaaacattgcagagtttcagattgttctttggttcatcccaacggaatcattgtgtgagatttcccaattacattttcctcgtgttattcttttttttcatatatagtttgaagaaccaattttttgttcttgtcaagtcactttttttgtatccaatcattgcttatctgtattggtgggtcaaattcaccaacgtaaattgtaatttttttgtgattcctgatctggaagtgggaattccaaggacctcaatttttttttattttatatatatatatatatatatatatatatatatatatatatatatatatattaccgtcaagtaatttgtgcaaaacaagtggtgtacaaatgttacatgaatcacactgagcaaactagttatttttggttttcaaatacacggaattcttatctctatctttacatggaatttgttttacggaattgattaatcgtgggaatgttattaatgagaaataagatgtttagtaaatatttatcattatgtgaaatattttattttttaatttaaaacaaaaacattaatgaaatagaataagaggaaagtcaaaattttattctcatggaaatacaagatgtcaagattcacacccttttacatcataataagaaaatggagaaacatataatataataataaagattcctgacctaaaattattgattctgatccttataaattttaaaagttttgggaatattatctattaccttgttgattagcatattgggaagtataaaacttctttgaaaggtccttcaattttggactgattcctttataagataatagtattaagcctcctcttgttggccagaagctctagcatgaatttggtatacacaagtatttgttcaagtgtcttaaaaaaagggtatttatctgcaacttcttaaagatctataaaaaaaatcccattatgcttaccattttgctgctgcttcattctgattctgaagaatgataacttaatgacatataagggcagtttctccttctttagagcaacaaataactttttaacttccaattccatcgcatgcctctttttctaaggtagtggttcaatgatctttccactcctagttgttataagattaacatactcattattactactaaaattaggattcatgtcatgtcatgtcattggacaaggagaaacctaatttatgtctctaaaaaaattacttgtctatctctccctctccctctcttgtctttcggccatcattgtatgtgtctccaagtcttctggccatgagtgcaccattcgggagacaggtgttaacctttcgcgtaaaacccaaaatcaaattggcaccatggaattagtactgtcagctcaggctaagtgggattagcttatcatttactccctccattctaaaatgattcatgttcatactttttaatagatatttaaatatatattaaaattttatcatgtaataaataatattatcttgaaagatttaataatatattattaaaataaaaataaaaataagaatattaataaaattattttctaataaatgttaattcttttagaatatttgtgtaaaaataccttaaacatgagtgattttgaaattgagggaatatcacatttttaatttcggctgaactgatttaacagttggctgaaatattgttggtccaatctaattcttacatctagctaattgggtcagattttttatatataaataataagcatataagattatttttatataacaaagttaataaaatatttttaatcaatgtaaattaaataaaaaatttagcttgttgtttatattataaaatataaaaatatgatgcagtacagaataataaaaattaaatagaatgcgtgaattgtgaaatgctagcaaaatatttttaacacactttttatcattaattattttttttgaaaatcacaaaattgtatgatttcatttcttatttaataattctattttataattttctatcaattttaaccaatataagaaagtatcttactggcactcatattttagtaacaataaacaagtgttagaaattaaaaacaaaactcaatgtacacaaaatattaactttaaactagacattaacaacatgtgcagtatttaatttattatttatgattttattatttataaaaaaaatgggccaaagaactggctcaagacacatgcatgaacacccacattcactgtagatttaatttcttttactctccatcaatacatttgtagtgtttgaaattttaaagcccatttatcttaaaaaatattttttgtttttacttttaattgcaaagttttcaccttgttttcaatctattttctgctttcaaaaatttatacagaaatcagtgaaaataaaagaaaatttataatcactattttatgtacaaaattttaaaaacagaaaattaaaaataaaaataaaaataaaggtgataggtttgtaaataaaagtaaaaaaataaagataaataggcctataatttttataatttcgtgttaaattcttgtttggtccctatatatcaagttgtttttgtttcaacatccccttaattttggatgtttttgttttgtccttataatttttggtgttttttttttgtctatataatttttcccttaaaattgacgatccaagaaggaccaaaatgaaacaaaaaagttttacaggataaaaataatatatatatatatatatatatattataaaagaatcaacagcaaaatcttgtttgattgtcactaaagagttatttaagtattaaatttaaagttaattttaaaattttaatttattttttatttttatatttgatttaaaagaaattatctgactttgctttaatcaacaccactactatttttttatgttttttttatctgtaattttttttgtgtgtataaaagttacaataaaattaaaacttatgacattatatatattatccaaatttttcattaaaccaactggactaggtattcatcaccgctactattattacttgttattattatagttgtgtcactgtcacatgtcaatattatgattaatgttatcatcaccactatttatgtatatactaaacaccacatagtataatcttgtgattcaatttgtcatattatacttattttggttttatttataagagttaagtttgaaatgatgtttattttttattataagattcaatttataatattttttatattaattatttttagactaaaaatattttcattaaaataagagaaagaatatactgataaataattagaagataggaatattaatgacaaagatatatttgaaaaaagttataaaaagataaatttatgagtataaacttaattaatcatttttttaatcttgatgaattatataattggatcctatatataaaaatataaagaatactatttttcaatgtgcatcaaatgtactcttaatttcttatttatgttaaatgtttatgagaattttttttattataatattattaatacaaaatatttattaaccttttattaatgaataatcttgattgaaaaatctgactaactaaagtttaataagtctcctatctcaaccacatttacaaaaacgttttctttaacgttaaatgtcaaaacatcacccatttccactgccaatcctgatcattatcaagttttatactgattttcaactgcgggagttgtaacacacccatatatttgaataaccaacccaatacaaaagagagaaaatttaaaagcctagctagttcctacgatatgaagccattacaaacctaatattatcggaaagacataattggcattgactcgtgtttctgccgagaagaggttgtcgtcggagattctgcctttggattttggaacatctccacaggcttaaaaggcttaatatattattaacatatattcgggactatttcaaactatatacagttacttacaaattacaaccatacattttatgcgaattaaaaagtacttgttacttatatatcaagtgtcatgacaattgtgatttgtcaatcactccactctaacccgatgatgcctcctccaagtctaacgaggcttttggcatttgctctctgctctttccccacagaacgcagtacagtccaatgaccaaagcgatgccacctaaaagactggtcaaacaacaaaagcaaccacatagttaatttgtatataggtacttagcaatgtgcaattaaagaagaaacaaaatttaagtttctttatttaattaattaaaggagaatactacctgctataaatacaggtgctcttaagtgaacaactgtacaaattactttagaagccattagttaccatcggagagcttctacctatgatgactttaacttcttactactttttctgaataacacgtgtataaactatataatgtgtgatgttgtctcaccgaatcttaggtataacaaagggaaaaattgataaagttgttgagttgaggtgaaaaattgagcgttgtatagtataacaaagtgaaaacaaagtgtgattggaaagtgtaaaaagttatgcaaaattaatttttgcaattattgaaaatagcttggaggaagtagtccttacaccccaatactctttagtccttttttttcttcactttctcttttgttcatatctttctcttcgttaatggagtatatgcactaaaaggattgtcaaactatcgttttactaaatgtgatgggtgacatgggaaaggaaaaataaaaagggagtaagcattgggatcagggttgaaatagatgaataaccttcccaaagttatgatctcgcccaagagaattgcggaagagaagatggtcatgatcaaagccagtggtgttgccatggctagaaacaccggtcctttcttctctataacccatgtttgtaagtaatatgttacgccagtcaccataattccctagcacaatatataaattagttcccatcagtcttacaaactaagcaggcctaaccattaagtaattaaatttatatagtgatttttgctttcataaaaaaatattttttacttagaaaaaaagatgatcatcaatttaattatgaagaattaattagagaattacacaatacgctacggccgggagtctgacattccaccccaacttccattgctcaatgtctctttctacggccaaggcaatgcccaaagactgaatcgagcttaagaaacactgaagagttgtgaggagcaactttgaagggtacccttttatgacataagtctggtcaattaattaacaagaagaattttaattaatgatatgaataatattaattaggaaatataaggtgtttcagatgattatgagagaaagaaaaagaaaagatcacatattcaattcctctgctaataaaaactaacaatactaaaagttaacatttgttaataaaaaaatgaatcatattaactaggatatgatgaatcatgaattggtaacaattaaggtacagggaagaaattaaatttacctgtagcacaagccacattccccaaaaggtgttggagaggagcaagaggaagcaaccctttatccatgacccagatgcaacacgacccagatgttgttggtttttatggtaccctaaaaggtgataatggcttaaaagttccaaatgaggacctttatagaaagcaaggattgctgatccagtcaagcatgccactacaccaaccaatttagcaaccccgggggcactctttactttcaaattttctatcctgaaataaattaaaccaaattcttatgtgaggtataataacggatttagtgaagattgaaacacctaataaaatgtctcggtttaaattgatccattttgttgtggttgacacttaaccacttttatgatgttttaaaacacgttaagaataaagaatcatttttaggacgtgaaaattataattgttaacttctaaaaattatatctgaaaggtgaaaccaaacaacctatttagtaggatcatatatattcggtattgcatggacatagatatgtaaattaacgcacgtgtctacgtacaacatggactttttcatcttttaagaaattgtcgtttcccttgacaacaaacaaggcacaaccatgcatgatagcataatgtggctgcaaaacctgagcacaaacatggaccttgttagctgctactaactggtccaatatctgaaagttactcactacgtgcacaatacattccgaaagctgaacaatcaaaatgagtgtattcactttcagagttagaaacgccaaaagacctagtcagagcaacccacaattgtactaaactaataaatgttgtcacaaaattagcatgaaattgaattttagcctcgtgaccccaaagtccaaacttcatattctgaaacaaaaaaaggcctatccattcaatgaaaaaatgcagtacaatttcaagggtcgtttgtctttgaaagttgaaagtttcgtcacccgacatgaaggtaccatcaaaaagcctaatttatatccgtgtctaactcctaacccctacctgtctattaccttaattatatacctgaattcaagtctttgctttgtagtactgagaagagaagtgaccacataattacattttgctaggaaaaatctcctctgtaaaacatgggcgactttcttttttagtagcaaagaagatattttaatttaatttgagggagtacaagtgttcttcctggcattttttaaacttatccttctcacccagaatattttaatcgctagccactcctatatctcacgtctgtttttaatcacatgtaaactttaagagagacaattgagtgcaaacacaattagagatattttggtagctagacatcaaattctattcaacatttaaaggacagaagagaaagaaaaaaaaaagtataataggttatatatgataggtgttgatttttgatataaaaaagatatgtataaattagtactcttccgattatctcttccttttaggcaagggttacaattttgttccattttagtttttggtaacaagatactttgctagatatacaattgtttgtgtttataagaggacacttacactaaagttatgatttatgaaccgcttttaggtgcctcaattgtgttgttcataaagaatccatgaatcttaatcaccagcaaaatctccactggtgatcgaacaatatttgattttagtatttgacaataaaagaaacgaacacttcttttctttttataaattgcggttttcagatggacttaattaaagtccaatttaaggttgagttagggtgggaaagctaactataattgaatttaataaaatacaagcaattaattatatatgagcaatattctacctgagtatgagcgccaagaagaaggtgatgactggaaggcaatttgtggtagcagcagctaaagtagcagaagtgtaaataagaccaataccatagatgtccaaactcgcagtaatcctgaattaaatttttgataacaaccaccgacagttttaatgaatttaaaaaaaaaaaatcaaacaatagcatcatgtgaatcacattttaattgaatatataacgtaaagtttaaacctagctagctttatatttatagcagtactctccaactttggtatattaggatctaatcataatagcagcaattgaatatatatgtggacataccccaggaaagaaaggaaaaagatcttgcagaaggtcacgaaggacaaagggggtgcagttttcctgctttcatcaatcaaaaatcgaatcattagctagctagacatgtatatacatacatgatacatgtatgtaatatatatgttcatgtgttgatgttagttgtgttgtacatgtgcataccattcaaagaagaaagcgaaaggaataaggaatatggtggctgcggtttgtctatagaagacaaagacgaaattgttcatgccatggtcaaatgcggcttttgagagcagaaacatgccagtatagatggcttctatgaggattgcaactagatagggcttcttgtttcctttcatggtgtttttgggtttgatttatgacctaatttaggctccgaaatcgaatgaagatggttcacagtagttgattacacacaatcaagttccaccttttatgggcaatggagatattggaaagtagtgaagatcgagcacactgccattggctcttgatttgtattatggggacgtgtgtggtgaagatgataagctgttttacatgttcggggaccactcctctctgtactactactatgtcttagacgctgtcaagctttcatgcatttaatttcgtagtgcactcgtactcctagaccctgtatcaacaaagttaatgtcacattttttgtttttcactcacgtgcaatttttgtttccaaaatcatttttatacacctcaaatagtaatactactatatattcaacattttagtaagagagacaaaagaaaaacagaaaaaaaataagaatatattattggaaaaaaaactcacttcaattagtaataacttcaaaataatatcattgatattcttggtctatatgattattgtcgtaattggaactgaatttaaatccggccggcggtcatgaaacttacaacaacaaaaaagttaaaaataatttgtacaattttattaatcttaaactcaacttctaaaatgatattaaaatttattttaattatattaacatgtcatttatcatattattcctatagtaagcgtataatcgtgtgttggttactatgtttgtccaaaatctctattatgtttattttaaactatagtattcgtgtacttcaaagttatctccactttctaactcattctttatttttttttcccctttcacgtcattcataaaaccatctcgttttttaatttctctttcctttatatctatgaaggtgtatgttggagtacacaaacatcaattttcctagttcgcttttgcttaacatcctattaaggggaggggggtggttgcactcacattttcctattcacattcctttctagtaattattattattattatttaaaattgatttattaaaatttaattaataaattttcgaataaatatattaacgttttaatttatctattttatttaattatttaacaacttttaatttcataaataaataattttagttaagtaagtgcattttattataaaatttggtgtcacgttaactgtttgttatatagtcacgtgtgcctttaaataaaattaaaagtatatgatagtattaaactagctagtgagtaatcaaattaacactaattagaattagatggtggttgagctcacggatcgattttaacttttaaagaggcatgacatgattagctttagtcattacacatacgtacacttctcataatctgttagtattacttcggataatgttagctagtattcttaattaattagagtattaattaaaaaattaaaagaaaatatttatcataaaaatcatatgtctgaaaaattaataaataacatatttttatatatctcaataaaaaaatattttaagtttcttaaccattaatatcataatgcattgattaacatttttctttatttacccctgcgatgaaccccatgtattccttagagttagaggcagctcttatctctttggaggacacgaacggaaaacaaaaaatatagtcgttttctctgaaatttctttactcgactggcgagaattaagtaaactggattcctacttttctaaatttattttttatctttttaactaaaaattaatatcaattttaataaatatcatgcaaaaatcataaaaaaaataattgactgcattaattaagagcatttataattcatagttatttaaataagtttttatcttaagctgtgagcttgtataaaaaaacatcacatcaaatactttaacgataatatttactaattaacatcttatttttaagtaattgcattgcagatgttctaaaatatttttaaaatcagattggttattgaattagtattagtttaaggcttaatggttcaattgtggttgaatcaattttatatttttaatattatattgtattttaaataataatataatatagaattataaaaaattataaattaatataaatgactaaattatatatatattataagataaaaattaataatagttgaaaaaaataattgataatcatatgaaatatttaagtgtgtatttgatttatctgaagaatattttagattaaataaaaaattagaaaactaaaaaaaatggaaaaattgggaaagatcgatttaatactaattctctataacggttcaacatcaattaaccggttcccgattcaactaattcaagtgttcactctgatatatcttttaaaacactagacttctaatcatgttttgagccacataaataatgcagtctaaccatagccatataagtagcggatttgacatgaaaaagtgtatataggtgtatatattgctagaatctatccaaatacacactaatgatatgtttaatagattaagggtccaattcatttaactcaaaacaactgaataatttgaaaattagatgaaaagcaatgaagaatttgttaaaacaggccaaaatcattattaaattaatatgcaaatttgtttgaacttattattttaacttcttgcaatttttaattgttttattcaataataattaacaaaaaaatattgtgtattaactgaaaaatgtttttcattatgaaatatatcaaaagacgggcctttaatttcttatatataaaattggatattactgatcagtgagattatcacgaattatgttgatcgagtttgtgatttcttattaacttctgtgaatgaatttaagtgtagtttatcttgttacttttattttacttataatgagttcaatcattgaactagatgcaactttaactttagaacaaataggctttcactttataaacatatacgtcgcgtacctaattgttaatagtgatcagtcacaactttaaatttttcttatacgggtaagaattgatttattttaatgttagcggcgtctgtttcgagtcatgcaaatttatttcttggaaatatatcatttatgtgtttgatataatttataaaaattattttcagaatctatttctaggaatatatattacacacatgattttctctctctctgtttcgatataaaaggatgggaatccaatattctcatgaaaataaatgttattttttaaaataacctcccaaattcactttattttatttttaattaaaatatattttaaaatatttcaaggaatgttaagtggttttttttgtgctgaatggaatgttaagtaattaagtagttaccaaacacgttggtggaaataaaattttcagtcattttattcacagaatatcattctcaaaaatataatttagttcgttaaacaaaaactccgttagtgtttatatttaaacttttgtcatcttcctttcttaatcaagttattagctttagtggaatggaaaaaaaagaatttattttagatatcttatttattcatattcaataaaataattaaaattctcaccccttccatccttcttcgaccaggccggctctcccttttgatacatttatgatttttttttttccaacagcttttcataatacatatctaacatgtcgctagttttattggaattaaattcaagtagtcgaatcatctatatgaaaaaggtcttcggtttaataccggattacttttttttagaataagataggtgtcatttttaatttatattttaaaatttaaatttgtttgaattaattaagcttaagatttttacaattttaaattccttttttcgctttttgtatataatttttatattttagttgaattaatcacccacatttttatattaagttttaaaaatatattattaatttatattaattcaaaattatttaaaatcacattcatatatatcaaaattaacataatatatttttaaaatatataaaatataaataatttgattaattattattattattcaattttaataaattttgacaccagtaattaaagtaatatataattataaactttaattaaacagttgaatcaataaaatttataatttatataaaattattaatagtgtaatattctcattgaaatatgatcagttgacacctttagtcttatttttgtcttataccacttcacaagcataggatggtgtttggtgtcaaatatatcttaatttgtacttatacaacttaataatttttttgtataatatgaaattaattaatcaaaccacccgaatcatttgatattatctttctatgatgtgtataaaatttcgcataaattgacatttattaatatgttatcttgaacatttgtatatattttaatccctaaaaaaacatttatatatattttaaatagctagcataatgtctgtcaaaataaaataatacaatcaatcaatgatatacatttgaatgttctactgtttacaactccgcatcggtcaaaagtgataattaactaaattcctatatttttcataatcttgtatgtaaaattagtcgttacctactttatttttttcccctacacatttttttaaatcacattccctacctaacagacaaacaatacgtccatcttaaagtactaaaagttagtcttggctctgatttgactatatattgacctaggtctttcactaacatacaatgtttgtcttgttaagcacttacctcctaattagggtaagtaaactacttgttccaacctgtaaaactattcttgttaatctgcttctagaagcatgacataagaaaagataaagttattgcagtaactaaaagcatttctcgatatggtaacatgacgttaaatttgtatccccgtattttagataaatgttttaatatgtacttgttgaaaaagaaaataagaaaattaattaattaatttttttataaattaaaattagctcatagtcatacaaaaatttaaaaaaaaacttttgaaaaatgttaattgaaaaagattttataatttaacttatgcataatttacttttaatttatcagaaaaacttattttgttttatttaattttcttttccttcaagtgtttattgagaaatttatgatagagtcttaattcattctaattcaaaattaattgaatctaactcagttaataaaataaaatgaataaattattataaattacttgatatttgtttttaattcttataaataaaaaaattaattaaaaaactagttcattaatagccccacaaatgcactggcccttaattcctgcggtatgattattatttttttctgtattcctcctcgtgtaacatttgctaacacgagaaaaaaggaaagaaaaaagccggaggctagctactttatggcaaattcagcaacgagtctaaattacggtgcttgagtctttttcacacgtttgtgaagtagcttttggacgtagatgaaaagcaaagagatggtgatacgtcataagtgcctagttgcttttccatgcagacatagatgggatttgattcataaattaatatttcacaaacatatgatgaaattttaaacggagaaaaagctgcaacgcgcttcctagaggaccatttcttatggaaggaggatattcccaaaatggctaaatccatattttggcaatactttggattttggaaccataaatactttcggctacatttatctacttttatcaatctatggcatttaaaaacatgcatctaatgccatatactcctaaatcctctcaacaaattcaataattaattaagctctgaagcagatatattttgtgcgtgtattttgtagttttatatactcaaatttgatctattccatattcaccacccatatttagaatctatattcatgtatggagtgaattaattagttcctataaaggttatccgtaagaaattaatatatatatatatataacagaaaatgaaattatagttataattatttttaagaactaagtttaggtacttttcgcgttacatattttcaaatcaaaattagaattttatttttaattgttttaaactaagtcagaaatcatgtatatctttcaaataattggataaaaaactaatatcactcgtgatgcgatactacagttcatccaataaaagttttcacatgaaaaaaataaatacaattcttctatagatcattttaaacatataaatgcagttgggtcttataccattgcatcaatcctacaagttaaattagaattttactttagttgtacatgcaattaaaaaggcttaacaagataaatctctaattctaattagaaaacagcataaaaaatggcaaagagatcgactacccttaaattctaatcagtgttatgatattaatcttttagttgaacaaatagatggagttccccgcatagatgggattccctctccctcaaaaagtaaaacaaagaaccttgtttcatctcccgttatgtctctttgatgggaattgattagaggttataacaagaaaaggaaaaacttaggattcctgatatgtccctttactcaaatcacgcccgctttaagcaaattatgatacatatgataaacctttttattatttttgataattatgtaaaacctttttccagtgtgaaacaaactgcgcggttaaagctaattagtcaagagtcatcaagatccgttgttaattataagccatttattcgagttgttaaaatggaataaagcgacagataagtagcacattgagcacatgcatgatcaatgatggtagttacttaggaacatagttttttttttttttttgattggtacttctgaacatagttgagaaccccttttctacgaaagatattcatagtccacagtccatatgaattataccacatgcaccctttcttctcttctacgcaagtggcttctctaaactgtgtatgtagcctgtttgtttttcttggtcctacgtactatagatcgatctcaacacaattaaaaaaatggaaccaaagccacatgcaacaaagaggagttcaattattaagtaggcttgtcgcctgttaacatcaaaatattaaaatttcaccatgatagcaactagctacaatgaacatgcatgactttaaaaggaattatttcaattcaattaagcacttcactcgtcaaattaagtccactaaccaattgtttaatgcaaagtttgcgcacttcccacactattcgtcccttttcaaattaattaatgatcaatgtgcttgatatagtagatttctaggttggattgctccattgtcctttatccttgctccctaattataggttatggtatatgcttttcctccattcccttgcaacgttaatcatgtgggtgcgaatactggcgtgacgaaccctacgtgattgtcctaaatctaaaagccatactctacatagtccagacataagaggatctttgatgcattgaatcattgatataggacatgaaaatcaacgcattccaaattaagattttgtcaatgattgaaggcaactgtcaataatgcaagggcaaaaagcaagtatccaattgtattatatttgattatttgcatagctagtcacatcttgtcataatattctgtttgataaattatatttttggtcattttttttttttacaaaaattggtttgatctcttaaaagtttgaaaaactttactttgatctctaaaagtgtcattttgtgtgactaagttagtcactttatatttttcgtattcattttttggtttttcgtaattttaccataatcatttcaattcattacaaaaatcatactgaattctggtgctaagtacaccaaattaattattttattaattatgaaactgtaaaaaaatataaaaaacacaattttcaatgcagaaagatgccaagacaagctcagtctaggaaaataaaaagacacatgtattgaatttgcaattgcagccgtaacatagaaagtaggatgtgaataatttatggattgggcaattcagcttcaataccaccatgaccatgcatggatatatatgtggttgtctcaaggccaaggtgtcaaaacgttttgaacaatttcctttttgtgtttttgaatttgaccagagatggtataatactaaatactaatggaaactcttctataagcaattgacaatttgtggtccaagagactacaaacataatctatgccgaccaaattgtatttgccaactgccggaatatactaatactcatacttccatcttccaacacggaaactgattcccttaattcacatgttaaactattctctccggacttggatataaatgataaaagtttcttatttttttttaaatataagtaaatctaaattatttatttcttatttaatgagattatatttaaaatttattttatttaataatgttaaaaaaatatgtttgatatcaagtttcatgaaaaataatttaaaaaatatatttttaattaaaaatgacataaacaagttaaataattttcttaataagtataaagtatattttttttcttcttataatcgagattggacgaagtactttagtgttcctatactccttccgatctcaatataagacaaaataattcacataatttaagaaagttaattaattacatttaattacactaattacaattaaaagtaaagttttctccaactcacccttcattgcaacttagtatcaacaataaaaataagtcattaaaattaaaacctcaattaaatgaataatattttttagatagttacattaaataagataaacttaattcaaattttattattgaaaccaaaaaaaattcttatattcaagaccaaacaaaatatatataaaagtttcttcgtgcttatactctcttcattctttcttattcacttttatttgaatattctctttttataaagtggtgaatctcaccctcctaacatacatatagtatattttcttatgcttttaaattttaatataaaataaatggtttaacaatatgtaattgattatcggaaaatatgtattttttactcaagttatatatatatatatacacacacacatatatatatatatatatacataatcttcaaaacttaaatatgctcataacatatattttatacttttaatatcaattgaacaatttaacttagtttttaatttatctctttcgaactatcatttttaaaatctttataaagtgaatttgaatattttttaaacaaaattagcaacgattaaaaataacaacatacattatttatcataataatataatttatatatttagaattataaattttagcatataaaataaacacttatattatgtaatgcataggctaaaatactagttattctatatttttctaaatcattctttatacttttaattttttcattaaatgcttctaaaatttagactaaaatgaaaaatattataaaaaatttaaatttgtaatttataagtgtaaaattatagctacattaaattaagataaaaaatcataatttttattttaacccaatttaacaataaaaaacatgtaagttaaaaagagagaaactataaattttgttgtattaaaagatttaataaaaatattccttaatttaatatcattgagaaatttattaattttatagtattaatttgtctattgaatcttaatttgattttgtgccgaaatggaataaatatataatccagatctaaaataaaactaatctttaaaaataataatcaggagaatattatatacgaatgtaaatctttacattaaataactaacgtacaaatttatttgatttttagtgaaatttatgaaatcgaaaggttgttatcatgtgatgttccacttttttttatactgatgtgatgttccactaattcacaataaatatataaaaaaaagaaacattaatttcagcctcgaaaaatactcctgactatttgtaataaaaaaaaaaaaaagagagagagagaagaatactcctgattagaatgataagtacttgtaatgttgatttggtcctgaaaaaggttgagatcaatttaattcttcaaaattatataaacattaatttagcccattattaataacaaatagctcaataacgtaatgctagtagtaatgttaattgcatcaatgacataatgctttcgtgtttagtccgtgtaaaaagtaatacattaataattgctacttctttcaaaaaaaaaaaaaaatactactattttttaatgaagaacatagctcaaatttaggatctagctttaagtcatttctattttcccactgaaacagtcgaatgtaaataactaaataaagaaccaaagcaatacaatagattgaatctcttcttttatatatataacaaaaagaatacattcaatccctcatttcactttgtataggtgataagaagataaaatagaagagaatgaaagaaaaagatacatgatactattatttgaattttacaatttaagataaagttcattagaaaatgatggaatgaaattcattttatttcattatttacaatcatttttctttttctccaatttgggaggaatgtaatagaatacaaatattttattatagacctttttaactttattatgtcgtacgtattagttcctgcttctcacccctctttttgcatttatattttatgtaattatgaccaaaaaaaaatctaatgaatgaatatatatttaaaatagtatttttgttgtgtattacactggatatatatttatttgtatataattataactatatgctttaatagataaaaattttaaaatttaaaattatattataattaaaattcatagtaataaatattttaaaatatataaatcatattttgagcttataacaaacaattcaaattacaatataaagttatcttccaattgaaactgatgagcaattaagtaattcaagtatgtggataaagtaaacgaatgatagtttaagatgattaagagaaatatttttcggctaattgtagagatagtatattaaatgcacctcccaaagacagaatgaagtaatgataatttttaattgaaactttgaaagaatagggagtgggaactacattctccaagttaggaattctaattaatataatatagaagtagattacttttaaaaacaccaaaaattaaaacatgacagaatgcagatagtctccgaccagaattcactccttatccttactaatctaccttcctacctacaataaatataagggttttgataaccaatattcgacattaattaaaaaattaaaaaaagaaaatatttattatataaatcataaaataatgtaaaacatatcatgcacacgtaatttttcacctcctgataaaaacatttatatttcaagttttttaatcttaggacactgattagcatttccttaaatatattttccaaagaaaattccttcttggaattggacccaaagagaaatgtccccccttttacatgctatttatttgaaaaattcgtccaagcccaattcatgttagcaccgaaccaacctttaaaacagccgtatatatatttatattttcgtccaaatggatgcctatataaactggcgaaattccgaggcgatatcctatgagtttcatattttgacttgggttataatatttacatacgtaatttgctttaaatttctaacatatggattcaattgcttttttcgtttaccatccatcacaactattcatgtttttgggtgacaataaaaaaagaatgtttgaaccaaaacataaaataaaataaattgaaaatacatttttttcatcaagcagaatcttttaattagcagctaatgggttcaatcgattcgtctaaattgtttataatttgtagtatcattggataaaatgatattgcaaaatcatacaactttataagccagtatctaccactgaacataaaatgtcatctccacaacttcccctttggaggtggcacatgttaattacaacttcctttcccagtttcacatgatcaagacaggctaaagaattatttgaagtctaaataaagtcttgaacaaaaattatattaagagcttttcaatatataaaaaatatttttcaaatctgcttaaaatttagtaatcttgtactttataatgcaaaatcaactattgaaatttagttttaaaaaaatacccattaaatctaataatcaactactaatgctgtaaattacagttgaaagacacctaaaattctaaaatatatattgtttgaaaataaagtaatacatatttacaaaagtatccttaatttagtatcaactcttaattactagttttttaaaaattgtttacaaatttctggaagcccacaaaagtagggccttaacgacccagtttatactaccgtaatgttcctcctaaaagaaacagctgcacactcggccactcgggtgatgttagcaaccgaaacaataaaaagtccaaaacgtacactttgacgcaagggaacatgatgcgcacatgaattattaattgaaatgcgctcctcttcatttgttgagatcagaaagatcagttaactttctacagttactaaggtcccaggccggacaataatttatcatagcaccaactaaactaccccacgaccctgaccctgaccctgacccgcacccgtgcaaattaatagtgctagaaagtagtcaactcttgacttggctttggatatggcctcaagataagaacaaagacaaaaaccaagctaaaaattccttattggagcagcaaatcaaacattaaccataccctcaggctccacccaaaaaaatcaatggtttaaatctccaaaaatcatctcccctccctaccatactcgttaagatgctgaaatcatcatgtgtgctccgcaactcacccacatttcataaaaatcatagtttggcacataaaatattatggtttttttttggtttgggaaagcggggttgatattaaataagtaaacataaaaccataaggatttttatgttggggagtaaaattgtaaagggatcaagcggatttttaggactgtgcggcatcacccacccacaaaaagcctttttacaagaaagttgccacgtacattatgggtcaccactcaccagtgccttccctgaccagtgccgcctttgttttttccaaggaaggcattcttgggttttggtaactcgtggagatccatcacttgaatcgttctttgctttttggctggacacccccacccccaccccaacacagacaaaatagcagtcagtatacatggaacaaagtaccaagtactaagtaacgaaagaaacaatacttagtacgagaatgtaaattaaatgaagtaaaaaaaacttcaccatttgcagcctctttgtagttctcttgaagccgttttctcgctgaagcaaatctatccgggtcaaaattgccttctctctgtctctgcgatcattcaaagacgagtcaggacaactcacacacacactgatgatcctgcataagccctacacaatggagctaagctccacatttattgctcattggttttaattttaaatgtgttagtgattatgaagcaacaacctccaaattttagtagtagccacatttagaaggtcagagactccagaaaggttataaattcatatccatacgttttgaggaggaggaggagcaggagtagtgactgatggcgatggttttgggggagcttctttgcgaggaattgcttttggttttcgttctgcttcaatattgttgcgctgtgatgacccagaactcccatctgtgtgagcagcaaacatgctattacatcaacaaaatacaaacgaaaagaagaagcttggaaagagatactatactcactgtgtggatttggcgagtatgaaaaatcaggaatctgcaaaaggaatagaatgttataaagccaaattgccaagaaaaacctctttggtcaataagattttgttaacctgacggtgcccattttgtaggattctctgctgaggcgagtcctcatcagctgccatgccaaaaccataaatgcatcatcaacattttcagttttgtaaaatccaaaatccttcattcacatattccatttaaaacctaacaaattttctcaaacgaagattaagattacccatgacagcagtgcccgggtctcccggggccttcaacttcacccattcatctacaatttccttccacttcctgcacacaaacaaaatgaacgtaaaagtcaacgaaaaaaacaagatctccagcaaaattcatccactgaactgttgcaatgcacacaagtatgaaatatcaatcaacattcattcttcatatttaaaaaatagtaataataaaattcatagctagttccaaaacctgacgagtaacttgaccaatctcttgacatcattagacgaatgcttccgcaaccgattcacatacctcccaatgtcagactcctacggaattaaattaaacccgaaattaaaaacagtaaaccgaaaacaaaaacaataaaccaaatgaatgaaataaaagaagttatacttgtaacgcttggaatgtgatatccatgtctgctagattctgcaacaacttcaccaacgaatcttcggactgataaatgagaaggaaaaacaaaatcagaaacacagtcaacctaaaaaagagagtcgtaaattgtgaaattaaaaaggaaaaaaaaaaaaaaaaagacctggtgagggtcttcgagttgctctttaatgtctagaatcttcttctgctcgtcgtcgagcaagcctccgtaaggatccttttcctcctccgcggagggactgctctgcgtcctgatttctccggcgtcggcgtcggcgccacagttccgacactgcggcggcgccgaactcgctgcgtaaaggcgctccacgattctgtctctccggcgcttcaactcgtcggcgtggtcgacggaggccaccgcgatggcggcgtccatgaaggcccaaacgtcgacgccggcgctctccagaatggatcgaaaatcctccgaatccatctccgaaccggaaaaacgaaatcaacctaaccaatgccgagctggtgtgagaacgcggatccaccacagaaacaaacaaaaccaaatatctattctcttttttcggttttttttttttgggggaaaaactttagaatgagggaaactcaccagaatagaaggaaaggaaaatatattccgcgaaacttttttttttttttttatgttgaggaaattaagtagtagtattaattattattttcatgcgcgtgtagtttgttttgtttgccgtaggagaaaaggaaggagatgaagggacaaaaggtgaagagaatttgagaaatgagatgagaatgaaatcgcctcaaaatcataataagtatttcgttttacgtttaattattccgtcgactgattatttactaaattttaaatttatatttattttttaattagatctctaagttaaggattaattaaaaatacagatttaaagatctaataataaattagagatctaattaaaatttaaaataattagacatgcaatcatattaattaaactttttttcttatatttgatttaaaagtatatgagaagggatttatataataaaaaaaaggaaaatatcaaaataatgacagtctgtactgcagcttgggagagctaaaaacacaaatacacaatgcctccccgagtctttcttttggtcaatgcaacactcaacttgggccactacttttgccgctcccgccttcctttgcgacatttcttcaaaaggcccaaatttgaactgataacaagctcctttcctaagataacagtttaaattagggtgtgattaaaaaacaattgcgttcaatgtaacctacattagatgtattattagttttaaatttaatggcttaggtcttttttccttttctgtttttctcttttttccccaactccactccaactatgctttgaaatattgcattcacctctgacctagccaataacgtcagttgtaaggtctctaatgtttgtgtcaccacctcacatcgaaaccattgtcgattgtaccaacctatggacatttctcatatccccccaacacctccaactccctcctcaatcatattcgttaattgttgtctataacgacctaaagcttggaaaagaagacaaatgtgtaagtggaaacaaaataggagccacgctactataatataaaaacgtcattatttgagcatcataattagggtttttcgatttgaactcctcaatcgtggggtttaagctttccactaatcactgtgtcaccaagtgaaattagtaaaacaaacatttctatgattttctctagtcgtataaatagtaattataatgcatgtgattgtgtatgtagatctagtttgccaaatgcgaaagtgtatgtctataggttggggttgtcaaggataaaaagaggggtacacgcctctagaaaattggatggagagaagaaacgggggtaggacagattaaaaataaggagaaattaaaataaataaataaataaatctcaaccgctgaaagaaatactcacacttaatgttccaacatgcttcaaacaataattgttaatgagatatttttttgtagtgatcaaattgatcacagtcgattgaaataatttagagtcagtcaaaatattttgttataatgatcaaatttaaagtttggatttttcttgttgaaaaaaaatatgaaattaatattttggaatttttactttattaattaattatgttcctttcacccataaaaaagtttttcaaagtattttttatgtttataaatttagtatttagtactttttatgataaaagtgagaagaatgaaagaatatttaaacagaaaatttatgtaaagatattttttcaaataaaattacaatttattatatttttatataaaattaactttttgtattatttcaacacacggattattcacaagctttaggctataaaacttattcttgtcttgttcaaataattttatctaaaggtaaaattaagcttgattgtttattaaaagaaataatattaatagaataattaacccataagttgaaataattcataaattgcttagcttattatcatgtttaattgatctaacattctctaagcctattttttcttctgtttattgttaattacaaagatataagtctattaaagaaattcctcaaataaggtatatataagaaaatgataattaataatgtcttaaacttttaaataacaaataaataagaatagaaaaattgttctaaaaggataaatattaaagcacggaaggagtattgtaaaaggtttgggttgtaggatcttattaatttaagatattgattaaaaagtattaaatatactataaaagtatttttagttatcgaaaagataagtatcaaataagttgatactctcaatacaatacatatattttaaataaatattacaatttaatttattagttaatgcctttgaaataccagtttatattatatattcctcaaactttacaattttatcaacacccctccttataattgatgtcaaggtaaaaaaatgctaccttcattcttaaatatatatttttaaaatattcttaattactcccatatcaagataattttatttttaaagatatttttattgatgaccaacacacattaattataattaggtgaaaaataattgttaaaaaaagtgataggatgaatttcaacaaatttaatgttattaatagtattaataaatttttaaaatgtaaattagttaaaaattacttatactttaactttgttcccataaaagcattatatttttataaaacattatatttttatgacagaactatttttgtattgttaataatatgtttgatctctggtagaattaattattgattaaattttatttatttattatcaatttttaaattaattaaaattatttttatttgatgaatcagaaataaaaaatattattaacaacagttttaaaaaaacagttaaatcattaaagataaaataatcatttgaatttaatgactcacctgactttgcaagccaaacactcaagcagtaatgaagagatgggattcgccattctgtagtcggttgcgccctaattaactggcacgatattcaaaacaacatttataatctcaaccactaccattccaccggtttctatttttcaaaatttgtcggatatttcaatgcattcatgagtatatttaaaaaaaaaatagttaaattcatctttaaggttctgtttggtcggagagaaaataaaaaaaaaaaaaatcggaaaaaaagaaaacattttcttctgtttgtttagagaaaaaatgaaaaaaaaagttattttttagttacaaaaatttaaatttttcctttctttcattttaattccaattcaaattttaaaatttttcttccattttctttctttcctaaccaaacatagggtaaagtatgaaatgctaataaattatttgatgaaaaataaaaaaaaattaatttaatttttaaatatgtaataaattaaccatacaaataatttaataataaatttattccttaaaatataatttattattaaattaattcttaaaaattataatctaataacaatatggtttcataaatttaatatcaagattaatttattatattttatatattcataaattaaatttgtaatttttattttttaagatcaacttatcatcatccacactttcaaatttgactatttattattttataagaaaataagtgtatatttcgatacttaaatatgatatggctttctattatataataattatttaaaaaattattttaaagtgagctttacttgtttgaagcataatactgtataaaaaactgacaaataatatttaaaataattattacaaatatcaataatcaataataataatcgtaaaaccattaaattcttttatacttttagacttctaattaaattattccataaataaaactaactttacccgcatttatttttacaaaaaatatttaaacggaagaagtaatataatatatttaataattttaaatataattataatattaaatttaatatgacgtatttaataatcttagcatctaaaaatgatagaaaactcatttgaaactctccacttttacaatatttaaatttacagttttattgtactcgttgtttaaatcattatatgaaaaggttttatgttcattattgtgttgtacagtgaatattcatcattacattttatcaattcataatatatatatatagttaatttaaataatttttttatattttaaagctattttgaccattgaatatgatatatacatgttattattgtatataatgtaatattcaaatggtaaactcatttaaatttttaataatttttatattatacataattaatataaatctaagatgtataataattctcactatattatacaaaatatgtaatagttttacagttgagagaattggaaaaaaaatattttatattatttttaaaagctataatctgtataattaaataatgtaccactacaattacacatattatattttattattccttttaaaatatgtaattttattattaattaaacaatttacttttacatttattcattttatattaagttaattttaataaatgtacgacgtataatatcaaataatatttttaatttttaatggaaaattgattgaaatatctaacaaaaatatcactcttttaagttttgattacaattaatatattttgttataattaactaacattgtacaaatttgttaagggaaaaaatatctacatcttacaacttaatagctaatttagtaataaaaaaaacttaatagctaataatacattttcttctcccaggtagtattaaacagcaatataactcatatttttttacagaatcttgtttttttttttttttgttgatacaacacttatcaattatcttgtagttatagacaactcactttatatacgtattaatgtaataaatgatatactagatattaaaacaataatttatgttatgtatcatttgattctaatagtttggatctagtttatttaatttattattttaaatttttcaaatattgtttagaaaactctaaatattataaaattgaaaaatctaattttatttataatataattataaaacaattgaattattttatcattttatattttaaaatattattgtttttattcatttcattaatatttattttatgtatataataaataaggaaaattctttgacgatattttaaattttttattaaattgcaattgatatttgtttgtggggtttgtggaaaaggaaaattctttgacgatatataccgactgtgccattgcatttcactagcaaagggaaaatcaaatagagtgtctactagaagaaagaagaataagagatggcaaaatttcaagaaccggaacttcccgtcaaagcttttggttgggctgcttcagacacttccggcacgcttgctccttttcatttctccagaaggttttattttttatttttttattcatcactttgatctcattgtttgttggttcattttattgatctcactcactcacttcacgtgcagagaaaatggcgttgatgacgttactctcaacattctcttctgcggggtttgccactctgatctccacactctcaaaaacgactggggttacaccacttaccctgtcgttcctgggtatccttctctctcttctttatcattcttttttttttattattattattattataaaaaaatcattttaaaggttacgatatttttttcattgttgactttttcttcttcttcttcttctctcaatcattttatttagcccccaaacatagatttggggtagtaatataaattatttttaccaatgtgctatctgacatccttaagtttatccaacaaaacaaagaccacgctcttcttgatccttgaaccgacaacagttgtggcttggaatttcgatcttagttgttaattgacatcatttttctttggatttgggtgttttaacagcaatgggggaaacattataggtagagggaccgaacccttcataaaataaacacctaattctaaccgcacgttgtgttttagacatcacctcacatggactctgtgtgtattttatttatatttactttatcatttcacatcatattagataggagacgtaaggttgaatagatgggtaagataaaaagggaaggaggaaaatgttaaagatattttcttcttattaataaaaaaacaattgagggtgagtgtggcacggtgctacagttgggtcttggttacagttggttcttggttatgagtttgaatccaaaaatagtttattttttagttaatttgttttaataaaaactaataattaatatttgttgataaataaaaaaaacattatattaggaaaacattatatttgagtttaccttgcatttacttttgtttttgtgtttttcaggcatgaaattgttggtgttgtgacaaaagtcggcaacaatgtgaaaaacttcaaagtgggtgataaagttggagttggtgtgatagtggagtcttgcaaggaatgtgaaagttgccaacaggatttggaaagttactgtccccgccctgtgtttacctataactctccttattatgatgggacacgaaccaaaggtggttattctaacatcatggttgtgcaccagcgttatgtgctacgatttcctgagaacttgcctcttgatgctggtgctcctctgctgtgtgctgggatatctgtgtatagcccaatgaaatattatgggatgacagagccaggcaaacatttgggagtggcagggcttggtgggttaggtcatgttgcaatcaaacttgctaaggcgtttgggctgaaagttactgtcatcagtagctctccaaacaagcaagctgaggccatggaccgactcggggctgattctttccttgtttcatcagaccctgcaaaaatgaaggtaagtgagatacaaatacaagatataaagagtttgaaagaactcgtttcatttgggttctggtttttgacaaatttactggtgcttcataatgcagttctgtaggaattttgtaaggataatggtattcttatgttgctgttgggtgtctctggtagctagtaatttgtgatttgtttcttactaaaatttactattttgcaatgggagtcttttattttacttattgccatatttcaatagctatcatcaaatagtagagttactagcaagagctaaagctaactaccgtagataagtgacaaaggtagtggaatagagagttatttgagactacctaccattaccctgttgaatagaaaaaatcaacattaacaacctttaacccaaattaatcgggatcaatggtagatacgaggagtttgaaaaaaaacggtaaaagcaaagaaagggggaagaaggaagggggagataagtggaaaatgactaaaaagggaccatctggaacataaaaataacaatgagtctaatcttccaccaagtttatagtttttctccattctgtcctaagacacatcgtccgtcaatctatatcttactccattaaatcttgtttaactaactttcccatataagtttcggtctacttctacttttctttgtgtcgagctcttggtgttgaatagaaaatatagtatacaaaatgttccaagtgactttttgcagttgtagttaatgttagccgtgaagtgtgtctcaatcgacatgagaaaatctcacccaagatgatcaatgggatgggatatacactattggagcactttattagaatataaaaacgaaccttggtttgcttctccatgataatcaatagtaaaataatggattattttactattgattgcaattgctgatgatgatgtcattgtaaatttgctcgtattctatgcaggcggctttgggaaccatggactatatcatagacacaatttctgctgttcattccctgattccactgcttggtctgctgaagctgaatgggaagctagttactgtagggttgcctaacaagccccttgagcttcctatctttccattagttgcaggtaagcagccatcaattatctccaacatggtataatgtagttttatatgttattagaagtactaacagaaggtgaacagaacctgattttaccacaagttgttcctcataatagcccaatgttaaagtctggttttgggtagatggcatgtattcaaatttaattaatagttgcttgtgtcttttctcattttagtattgaatgtcatacagtttaattcaaaccaagaatgagtctccaacccgcacatctggaatgaaacatttcttgttgtagcttatgttctatacttaaaacttggagcaggactccctagtttcatagtaaataataatagtgcatggatttggcaaatgaaatgttttgttatgtcacatacgcaggacggaaacttataggggggagcaactttggagggatcaaagaaactcaggaaatgcttgatttctgcgcaaagcacaacataactgcagatattgagctgattaagatggatcagatcaacacagccatggaaaggcttagcaaagcagatgtgaaatatcgctttgtgattgatgtggcgaactctttcgcaagtttgtagaagccaccatggttctcgaactctttgcatgtgtggcctttagatgtctcagtattttggaagtgggttggtggtataagtagtctattataagatgttgaacttaaaagacgagaacatctgctaattaataatactttgggttttgaatttatattatgttttatgttgatgaagtcgttgaccaagcgtttcaatttttgggactaaaaaatctaaattggtcgttcgaattttacaattttttgcgaccaaattatttttttaagatatttaaaatgccattctatttggtcttcaagaggattatgatagtaatataaaagaatatactattaagttattactttgtatttataagactaatttggtgatgttatttttttaaaattttttattccggcaatatcttaaattcttaatcattagaagattatataagaattaatgttttgtccgatattgctattattctttctttttgtttcatgctacgcggaatagtagcatacgtctaaatccaaccggcggctatcgtcggattttctccggatttagtgtttctgaatgtaatggactatagagcatctcagaccagtaaatctttttacaattacattttgttattttataaaaattatcacattataaataactatattgaatgttttaaaaatattaaaaaatatacaaaattattctatgaaatgtgtgaagtttttctttctttttgactgagaaatgtgtgtaaggttgaaatatatttctgacatgaaattttataaagaactttggtttgtacattcttaggcaaataaaaatcagtgaaaatgatgttttgtttaaagaaacaatttaacatcatatcggcttttttgcgaacaatggttagggtggtatcaaagagtgaagactattctaaatccaaataaagctattaattattacaaaattcaatgatagaattataaatcacttattaaccaattgccatgattagaagatggatggattaagagatgacacaaaaaaacagatgggttaagagatttgactctgtttgcaggcaagaacttaaccaaacatgatagtggataattcgaaaactgatggattaaaagaactaagcctgtttttttcatgcaagaacttaactagacgatgaaacagtggatgttcaattgtcaaaagttaatcgaaattataattgaaatatgccactaaagttagaacgataccactagccgggcacgcatatcgctcgggactgtccaaatcattgcccttacggattatttgaatttgatttattaattatttgtttaaatttatttatttaaatttatttaaataaataaataaatttaagtttgaaattagatttaattcattaaatgaatgcagtttaaacttttgacattaaaaatttgtgaataacttttatatatatatatatatattacaatttttttttataaaaacagttttgtctcttaaaaaaagttaaactaattattttttattttttaatttcacttataatatgttaaactgattttgctgtccgtaaataattatctagtattaaaataatttgtcatgaagaagaagatagattaagagagttgaatattcgcatgtaagataatagtatcatgacccattcttaaattatgatcaacgtacaagctataatttccttaacctgatggcctgctgagagtaatatactaattaatacaagctataatttccttaaatcaagcatttttcctcaacgtacaagctatatgtttgcattgccatttaaattacatcaacatgaagtctgatgaaccttcatcgtagaagtaacaaaagacttacttttgcaaacggaaattggagttagtaaaactataatctaaacatatgctaagacacaaatagaaaacaagtaaagggtgctcccaacaaatccaacaaagtccctcccaaaacaagccaatccatttattgattcacctttgtttgatatgtataatttacacctaataattataaagtataaaatttattattttaaatacccattcaaatttataagcatgttggcctatatgtgggtcttatataaaaggaaaaagatttttgcaaacggagatttttgctaacagactaaaaaaaatttacttatgcctacggagatttttgcctacagacataaattattgtaggtaaaagtcgaaaaatacttatacctactattgtttgacgtaggtaaaatttagtaatttgtacttaccattatttagtgtaggtaaattcattaaaactaaaaatgacttctacctacaactactttaagtaggtacactccaaaaaacttttacctacaaaaatctagtatagaaaaaattctaaaaaacatatacctatgaccactacaaaaaaaattatccatgtctatggaggtttctgcttacatacataaattattgtaggtaaaagtcaaaaaatacttatctctacaattgtttgatgtaggtaaaattcaaagttttgtatctacttttatttagtgtaggtaaaactcaaaataacttaacttacaaaaaaaatgcctattcttatgaaggtttatgcacataaattattgtagataaaagtcaaaaaatatttatatttatcattatttgatataagtaaaaagctcacaactgctgtccattacacgtgttagtgataattttaccactcacgaatttcaagtataatattttaattgcaactcaatatattatttaaaaaaaatttgctaacagactttacaatatattgttttttttttaaattgaaacttaatagcgtagtgtagacccactccagaacccaaactctagaatcgtagaaagctctcatctaaggttcattcatagtgccgaaatttagggttcttcgtaacaactctggaatcgttaacgcaactcgcgaatctagaagcattctttttcttcttcttcttcttacaccgcgttctctctccgacgatctcagattcaattttccgttctcaggtccctcctcttgcgagaatgcgttcaggagcaggtcgtagaggaaggtcgagaggagtgtgtaagaacagagcttgttttcgaggtgacagagagcgcacgagcgactagtgcgagaggatcgtcgagtagaggtagctcgctagcgccggctccgactcagcgtcgcggcgcgcctccgccttgatatgttcccgttaacttatcaggtgagtcactgtgattgtgattgtgactttgaatttcatgtattcgttagtatgaatttatgcatggcttgctttcagttgatgatgaaatccattctaatgtcgatccttaaattttccctctttattccttaaatttctgtttggctttgttgttgtggtggcttcttagtttcatttgtgaaaacatgaatctctctgcaggtttccatatttcttgccatgcttattagtatcagcttttgcatttgcatcagcaattgcttgcatttggcttccagtaaatatatgggttcatcattcacatatctctaccctctttaatttttatcacttttattcaaaacatttttttttctaaacactttattctaaacattagtatgattacatatctgaatctacattcttttatgcaattgcacataatttttttatgcattgacaagaggccataaggtaccttcctccatggcttttcctataaacttaaactggtcgtattgagtgtacttcacttatttgaatttccaaatttgtaatcttcagacaaatttagataaaaatcataatttagtgttgctctagttcgtatagcaagggttagcttccacctcatgtggcaactactttgatttagcattttatttttgtttgttttaaatatatcttgttatttggcatgatatatatgcaggtgttatccatacctctcttgcaatgttatcccctcatgacaatgttatcaggcttcacactggacatagtgatcaatattgcctccattctgaagcatgtcttggttgtaagtgaagctctttccctgtatagccaatcatcagtgatattgaggatggaagtgaattgaattaattggcttcacaaaaccttaagaatcattttaattgaccgaaaaatgttatttttgttttgaacttgcctaattgtattattgttgctggatttaggaggcaattgctaccagtttattcgttctgcaaaataaagttgtggtaaatctttggttcctttcatcagctttcatttatttccaaaagttaagattgttttttagagaattgtggcacatatggtatgttgatttggaaaacaggaaccacaccaaagggggacagctaatagtattgctaaccctggtatgtcagcattcaaaacggttggtcctgctagtgccggtgcattgtaagtgtccattttatttctttagcatttgaaatttatccactgtatacgattaattatatagataaatcttaatgaacttgcatctgaaaatccatgctatatatgttcatatatgacatcatgacatggtcctatcatccatgtattctagatttccaaaattcagaatttcagacttattggtgattcaataataggcatattttaggcacattattgaaaaatttaatggattaacaagaggcaatggtggataacatttcgaaaatttaggcatacaagtagattgtgccttcagcatcaaggataaacctatgaacacaattaagggatttaatcaaagctatacaaataattatgtacagtatagatgctacataagatggcactgtcgtgttcttgaaacattttatttcattaatcatgaagggattttcatatgaaaatattattatttagattttagaatggtttttcaggacaaggacatactataaaaacctgaagtgtactgagatcaatattgcttactggtcaatgtagattatcttggtcgcaaaagcatataaatgattctttcctgccaggtatgttgattaaataatttgcttgaattggtttctatttcatatacagaatatgggaatccttaatcttagtattatttctagttcacttattgttccttaatagaaaagaacataataggccatttctattacaacatagagtttggcctagaaccaaaccaaagaaagaaaatgcaactttcgaatgaagagtttgaactttaatttaacctcttatatatgcttaagttcaatgttttcttttgctagttatattgctggaagctcactcttttacatttaactgcaggcacccatattgtcttccttgccctgaatattgttgaaggacttggggtactgttaatgttcaaaccattcttgagtgtaataccattcttaaaaaaaattattttaattaagttgttttaagaattctatttcttaaatattattcttaaaaaaataatttaattagatataaaatatttttatgccaaatgtcatctaaaattaattattttcacgtattcataagttaaaaatctcaaaaggagcattcttttttcttccatcaaacataatgtttgtgttcaaaccattcttgagtgtaaagaattaaatatcattcttaaaaaaaattattttaattaagttgttttaagaattctatttcttaaatattattcttaaaaaaataatttaattagatataactacttttctcttctcatttatgaaagggatgagggcgagcatgatcatcggcgaagagagcggaacagaggttgttaaatatttatggatttaactacttttctcttctcattttttgatgttcttaaatattggataacaggcaatgcaagttcatcccgagttcatcccgataaaaacccaaacgatcctcacgctaccgaaaagcttcaggtagcttgaatccacaacaatctctcaagtttactagtagaatttttattattattactataatttagttagaatgcactcatctgattgttgattgcctaatatagtaataactactttaaacaatcttcaagaaacacggcagctagtaacgtatataaaccatcttcaagaaacaaaatatcaagaaacaaatataaagttgcttaaaaatcagtcttagattatttagttttattttaaagttgattgaacaaaatattaagttagtctccaattctctgttttcttttataaactgattccaattgaaggtgtgatactgtatttgattattttaatccatatatgccttgtagaatatttgtgttattgcccttcatatagttttattccaattgaatactaaaaattccataatgtgactgttggtctttatctaatttctttgagattgacccctataccttgtgcatatataaacaccaacacttccagaggcacatttggaaaactagagttgtgtggtcactatctttgttcttgaaatcatgttcttaaaatttaaatttttgtgagactcacttctgatttaacaagctccacttataatttttattatttaaagttgtaattttaactatttttttatattccagaataacctaacaaattttttagatacaaatttattttggatacaaattttttaggtgtatcaacaattagttgaaaagacaaaatcaactcctggagctctggttgagaacaacaagttttgtctttctgttcattttcgttgtgttgatgaaaaggtacaaactaaaagctatgaattttgggtaatcgagtgtgtatatatattgttaaggtaaacaaacatgattcattataatttaggtgtgggtagtataaggaggtttctttttaagtgaagccatgaaattcatgccagggaaacaaaactatttatgttctttgttgtatattatgtagcagataacacatgtacttctccaaacacaagatgttggagttcaaatggtatggtatttagttatccttttcttttcatgagcattatgaggcctaacagcgagccactataatctttgcttggttcattttgtctttttgatcagtaagtccacaactagctcttgcaactttagcataccttggtaatgacagcggctataggcttggcttgaacatgaagaaatcagcagtggcacgcagtggttgaatttgaattctaaaccttttagtggtatataaactatgtttataatcacataaaattatgtttttttatataaaaaaatacataaaaccatgtatgttacttttggttttgtttatgtaatttatctttcattataataagataatttgtatagaaaagaatatgaatggatagcaatagaaagcatagctagaattttatttacttgtgtttttctttatgaaatttatctttcaccataataattaatttatgtcctctgtacaagataatttgtgaagaaacaaatatgaatggatagcaatagagagcatttctagagttttatttatttattaatatataacttttacctacaactgaaaattataggtataagttctcggcttctacctacagttgaaggctgtaggaataagttcatagcttttacctacagttgaaaggtgtaggaataagttcataacttctacctacacacattgtaaattgtagataaaacctatagtgacggacaattatccgtcattgtacgccccctcaaagttgacgggcaaaatgtccgtaggacaaagtctatagtacatttatctaagcatttttaatttttagtgacagtttttgtctgtaggcataggtcattttccttgtagtgacacctaataattataaagcataaaatttattattttaaatacccattcaaatttataagcatgttggcctatctgtgggtcttatataaaaggaaaaagatttttttacatccaaaatatacatgacacctaaaaacagaatgaaaaaaagagaaaaatataaatataataggtaatatgatgtgataataaaagagataaagatagttgatgaaatgtataaaataagtgagtgttaaaatatcaccactttctataaaataagtcacttaagtaagttttcagttagatgaggtgctgatataggttaaagtaaactctaaaatttgcttgatcataaataaatatattaaactcaaattttgtaattatgaatctgaccaagcttaagactatcaaaataatttaagaaaaaatcataaaagaataatatataactaagcatagattatttagataagttaagttcaagccttttttttaacaagaaaagctcaaattttttttttaacaaattaaactcaaagttttgattagctagactagtttaaataaataaatcaaatatatatatatatatatatatatatatatatatatttactagttaaacttaaatctagtattaaactatacttcaaacatactacctcatttgatacaaactctcaggaagtcaaagtcggtatgcagatacaaatgtgtgacgacaatggaatatggtttggaacaagttaacttcgttagatgtgcttagcatattcttccacttataattattctgcaggctatacctagtactatatatattccacgtactctctgcatcactgaatcagcaaccactaaaatcaccaaattccaagcttttccactttagaaaaagacatgggtgctttgtatcagatagttcttctgaacattgctatttattttgcatcagtcatgcataccacatctaggagcatccaactgatgcctgtggacttaacactcggtttcactgaactcccactcaacatttccaattttaaaaatcaaaagccttataatttacccgtaagagaacgctataggtttaaaaacggagtacacaagctgtgggtgtacgccacagacaaacctctatcctcacatagcaagaccaaccctcgttcagaaatccgcatagaggtaaattaaacttaagaaaaatactaactagtattcttagatcattagttaataaactaaaaagagaaaaaaaaaattaaaatacataaaattacattatttgtgacttttttttatgttatcacatgatctttataataaatatatatatatttttaagttctttaaacaatgttctaaaagtagtcctaatgatctctttgatttgcttaaattaaatgtacacactatgtggcttctaatatattcattatttatataccttgcagggctacgattattcatgtggggtatggcaatttgaagggcaaggttttgtgcctaaggatacttctggggtgtgcattatgcaagtgttcggggcacaccctaaacgtgccaccacttttatgcttgatgtttataacaattcgctcgtgtattataataattctgtcctggttccaaacatatgggacaggtggttccagttaaatgtgatccatgacgtggaggcctccaatgtgaagatttatgttgatggggttcaggtttttgaagccccgggccagggaggaagttcccattatttcaaatttggtgtctacgcgcaacgtgatccttcttgctatatggagtcaaggtggaaaaatattagagttctaacaaagtcttcatgattgtacgctttggatttatattaatttccttgtatatccacgagtttgtatctctggttttcattattcggttattgaaataaagtttttacctctagcttcacatatgtctgattttagttatgcttgcttggcaaatatatgtagttatattaatttcacacacccaactttgagaaaaaaacgattctaattctaagttagatcaattcatagattaatgaaaaatgggcaatgcacattttcagaatattattagacgaggtcttaaaatactatatacaggaaaatgacataataaatgggttctattctatctttagttacacaaaatgataagaataaaacaacacattcatttcattcccgtatgttggtaggcgtagcgtagcaatctatgattcacataattacaatacaaatttccctgattatcagaagaattttgttataagtaaggatcaaacataactagtgttctaagtgcctatttctaatcaaaatcggaatctgatctggataacatcaatttttttctaagtttagtcattttacttcttcacttgacacattttaattataagttatatcactaaggggcgattcattctttaagagcccttacgatttcttgtgtatttacctaacggagtttggtgagtaaaaaaggtgtaactaagtattaggaaagaaagggaaaaaatattgtctaaacttggcagcaatattgcatgggaaactaacgatcacagaatgtaacctgcatatgtattattgacaaatcatcatacttattctcccgtcaaatttaaactaacatacttttaagattcaaattggaagaaactaaatttattctatagatacataagataagaccattcctcttacatgggaaaaccatgattcactcttaagagaaggcaactaattatcaaattgaatatttgtttaataggttgggttggcaggtccatcagcaacaggggccaaagctgggcttgaagcagcagcatcacaatagccacgtatattgagagcttcaaggtgagtgtagcccaaggaagtgaggatttcgggccagcaatcatgggttatgaccgtaatggcacagcaacagttggggccaatatcagcttgaccattgatgaagaaatgcataatctcattcgaacatgattttagcaaaatgaggttgctccagcactccacatggttctgttttgggctcttcattgccaagtcccttgttgctgttccatatgcaacaaagcatgcaagggccaacaagaataatccatgtttgagaaccataaaatgaaattgatgcttttgtggtgacaattccaagatgacaagcataactgttgtttctcaactacttatatactattagtagtgcttcatttctctattactacattattatttatttaatcaaagaaatgggatggttaattaacgtaagtaaggggtatttataaaactgtaactatgggggatatgaaaagagcataattgccttcggccttcattttgcgcaacctttgaatttcacttctaccaaccgttagagaatttaattaatttcagctttctttggaggcttcctctcttcttcttaattttattttcatataattaatacaaataaaattaacatcgatattaatacaacaagaaagaaagctacatttgctttggatggtttggatggttctgagtgaagttattagtagggtgtttcttttggcccttacatgttttgctattggctcctgcctgaaggtgaaaagacacttctgtctctcggttcaaaattcttcatcccgccctcttctttctttcctctacccgcgtcccgggccccactttctctgtgccttctccattccaaatccttccatctcctttcgcttccgttctcccccttcaacacccctttgcgatagtaagttttttttttttttttgcgagtttgtattcaatggaattgtgattatgtcgtagataagtctacaactgaatcctatttttaatgtgtattttttatttacttttgaatatacaatataattacaatttcattgtatatataaacaaagactacaacgaaatcataattttgttgtgtttcatcaaaatgcacaagtagaatcatgatttcattatgatctttgtctaagaacacaatagaatcacaatttctttgtatattttaattttatttatttatttttagactaatgaaaaaatattttcttttcttagttaaatataattattttttaagcaggattattgacttatttttccaaaaaaaataatttagatttgtgatgacttacatgaaaatgatattgtacattgttggatgcaacccccttaaaggcccctcgcttgaagggaaagaaggcatcatagagtgattgcatcagcaccacgtgatgatgcaatgtaaaggcgatgccagcttctattaggatccttggattgccatttggaggacctcagagctattcaagagagtacaagtcatcaacaactcctacaacaagctttgcaagtgttgcatgagggtttagcagttgggtgcaactcgaacacacggagacctaaaaagaagttgacaagggtggcaaaggaagttgatcatcgtattggacatattctattgttgttgttgttgttgttttatgttttaatgtagtatgtataaattttttttgtttttatataattttttcgatttatgttgtggttgatttttgtgtatgttcatcaatggtttaaacaacatgcatttagtaatataacaacaacggtctcttcatttaattcataaaataaatatcaaaaactaaagaaacattgatacaaaattttcttttaaaaaaataacgtacaatttttataaattaaaaaatgacaacacatatttatcgtgcattagaacaataatttcatcaacaaatctttgtttcattggtttatgcatcagaacaatgatttcatctggagatcgaccaatgttttttgtaactcaatcgaatgtttgttattaaattccaaaaatatgaaaaatattttttaacatcatcgtcgtatttaagttctatacactcatattcaacataaccattatctacataaacaggttgatcataaaaaaaggccaagtaaaactatgctaattccaatggtgtccataattgttttccttaaagcatcaaacaacatgtcttcacttattctaacgactttaggaccactaggacaattaaacaatacttcttcaaatgatgaaataatgtcaccatcgtaatgcacaacactctccgtgttttcagcaataaagtgaatatcaaccaaagatgttgagttgcatcacacccctattgctatttatattagattatgtactgtttcgtgagtcataccaacaattaagactgcactgataaaataaacgatttagattgtatccatatttaatatagttagtatgtgtatcggaaaaaaatagtgctcaatcattacgtacagaaaaaaaaaaagggttaagtcaattcaattattgtagagttcaatcaataaaataaaaagcattaatttttcttttcaatttttaaaaaagacaaacattataacaaaatcacaattttattgtgtcaattggggtatgaatatacaatggaataatggtttctctgtgcacgacctacaattgattcatgattccgtgggaaagatattttgagaataaaaaaagggtcaatcacttggtggggcctaatagtaataggagtgagaccaatagcaactccgttcgtatctcttgtttctggactctgggtccttaagtagtgacttggacattcggcccgatccatttaaaaactggcccattccgagaaacaggacacaaccctaccacatgatatttagacatccattttaaaattgacacgtcattaaaagtaaaatatatttttttctctctctgcattcattccttctatcggctccctcacttaccccaactctgtttgttcctccctccccgccgtacaatcccaccctcgccgccgcagaatagctcagtgaatccgaagctgtgtgaatcgcgtcgtactttggagttccttgacgggttggattggagatttgggaagtaggtacagaacgagaatgtgggtctgcaagtgcagttgttggagatctattggttgcatctaacaactcatatttaatttaggggtgtgtttgtcttttctcctagagcgtagtgaagaagaagagatgagcgtggaaaatgatgttcctgggaaagaggtaaacgtgctgaagggtcacgagggtggcgtgttagccgcgaggttcaacaccgacggcaattatgttctaagttgcggcaaagaccgtaccatacgcctctggaatcctcaccgtggcatccatataaagacctataaatcccacgctcgcgaagtccgcgatgtccatgtcacacagtactctctctctctctctctctctctcagaatcatgcatattcggaatgcttcaatttgtagggttttgtactttgaacagtcatggaatcatgtaactgcattggtttatttagggtcaacactcactagttgagttcatgataattcattgattatttgcatgctattattatcagggacaactccaagttatgttcctgtggtggtgatcgacaaatattttattgggacgttgcaactggacgtgtaattaggaaatttcgtggccatgatggtgaggtgagctatccttcttctatttttcactttttccatttctccattctttattaacttcactcacctatttgcttcaatgccattttggccttttataagtgtttgtgcagaagggtatatattactatagtttctgattgataatttcttcttctgcaggtaaatggtgtcaaattcaatgagtattcatctgttgtagtctctgccggctatgatcaatcattgcgtgcttgggactgcagatcccacagcacagaaccaattcaggtggatttcatcaaaatcattctcttgcgtatttttttcctctaacagttatctattacatgcaacagtactctatttgtttctaccttttgtcttttattaatcaagtgatgcaattgacatgcagattattgacacatttgcggatagtgtgatgtctgtttgtttaacaaaaactgaaattattggaggaagtgttgatggaactgttcgaacatttgacattcgtattggcaggtttcttgcaaacataacttcgagaccatcattttgtaattcatgtttaaaacagtctatcaagtaacgcagtacagtgctgttggacacttttgttgtggccataaaatttgtttgcactgtgaagtttttactgacgttctattttctattcaccagagaaatatccgataatttagggcaacctgtcaactgtgtatcaatgtcaaatgatggtaactgcattctagccggttgcttagactctacattgcgtcttttggacaggtatgtttattgtatttttggaaaaattattatgggtctttatccctctgcaagtttcatagttctttcttgtgacaggtccacaggtgaactgttacaagaatataaagggcacacgaataaggttagtctgcagatgcctaaaactgattttagcacttcctattttttaatgttctgcatatagcattgtttaaagatacaggaccaggtgcaagctcccaaagaatttgggatacaagtggagattcactgacatttatatatctgcatttatggactagtatttattggttcctgcaattgttcattcttaaaagcattttcttgtgtgatttaacttttaagtaactttacatgttacaaactttttaattatccatttttattttttttgaatatttgaccatttctatccctcagtcttacaaattggattgctgccttaccaatacggatgctcatgtaactggtggctctgaggatggcttcatttatttttgggatcttgtagatgcatctgttgtttcaagattcagggctcacacctcagtggtaatttcttttcactagttaattctttctggaagaaagttgtgcaagggtgatactaaaaggacattatagaccttttcttcattaataatttgtcttgaatcatgaatatggctgcttcaaattttcaattcctccttaagcctcaacaaaggaaaactggtgccttgatacccttttacaaaaattgctgtttaataattatgaattttcatttaaaccatatatgatttatcacacttgttcattatgatttaattgatttctcacaatttattgtgcattgtgtcgaaagccccgcacgaaaattgttatcacaaacacttgatagttgaaataatatggtaactttcttcctaaacgaagattctctctcaacttcccgagcagttattcgatggtactttggtcggttgctgattatgtttataggaactttgttatttctttaacatatgttccttatgctatattttattattgtcagtttaaagtccgatgataatgtcatcattaccttaccctatggggtgagatgctttattttgttccaaaaaagcctgcatgttgcagctgggactgatgacattttgtgttttataatatgattgtcgttttacctgtagagatgaataggtttcttttatttaacagccttttgaaggatgtgagaatgatataatgcatatggattttctgtcaggtaacaagtgttagttatcatccaaaggaaaactgcatggtaacttcttctgtggatggcaccattagagtatggaagacataagaacaaaatgtaaacactaagcttatatggtgtgtgtccacgcagcccatagcaataacaattaggatagtgattattacatgttcaattgcatatggagtccacagacacgatgttacttcaaagttatatatatatatatatatatatatatatatacacacacacacacatatccttcggcagattttgacctataatatgtgcttttggtgtggaagatggtaaacgcaaggtgagtttgttggttgcagcatctctcttatatacggtcaaatcgcacacagtttttgactttttgtctccgaaagggatagggtattgtattattcacttgtgtccatgaaaggaaaatgttttgtatactatccgttatggagtttttatcttggtttttactggtatagttggaaaactagtgcctgcgatgctcttatgtagctacatatctatgctgtgattcattcaatctttggctagtgtttttccattgatctaacccagctcaaactttttcgaatttgtgggcaccatcgtttgggaaaaaaagaccacccttttgttcaaattattgattgacgtagacgttttggactgcttatttcattaatccttggtttaattaattttttacggttaattgatatttttcattttagttaattataaaggttttattagtttatttttaatgctcagtttttatttgttaaatgtaaaatcggtgtgaacgattaataacagacgattgaattaagacatgttgaacctagttgtcttttccgcttgtcaatttacttcgacaagtctatataggcttttttgttatattaacatttttgacaatataaaacgttacccacattataatcatagtcacaatatatgtgtaaacttctagaaccactttacagtagaccctagctcaaaaattttgatcacttcgtcatgttaataatttatgtataaatcacccgacacgtcggcgatgagccaccacgtgtgatttgtgtttctgtttggaagcaaagtaactcaacaactcaatagttgctcttgcatctgcctgaatgtgagccaaatttcatgtagccaaactagttattgttcctgtttttgagtattttatagtctcgctgtcgcactttcttggcaagaaggattctcttgtacatgtgacttgcaattataacaataataattacaatagtggcagttattatcattatcatcgtcatgattgcatcttgtaaataaatatttaccaatttttatgttgaatagaaaagtactatttcagaataaaaatgtcaaacgaacacgatttgaacatctattttgtctaggtaaagttttttctttctcaggaacgtattttaactaaatttggctagttatattctgatgcttgtgagagacaccgtacagctttgatggtgctggtgatagaattatgtaatgcgtatgatttccgtatctcgcgaagatatgtttgatgcttcagtatcaaatgtatgctacatatatttatacgaattaaaatatgaacaaataagtataccctgcattgcgtaagtatttataaataaaatgtaaattgaaaatattttaagaaaatataaataatgaaagacgattgttactgtttattatagatattaattaagaagttaataaaaataaaattgtcattacaatgaataaccaattaaagaaaatattaatttaattcgacactataaaatacgttcgaaatttgttatgtaatgtaaaattacaagtcccttagaaattaattagtaatgacgtatgtgaaatgcagaggcattaggatcttgaattcaatgcatgttatattcctcgtggtcaacacatataaaaatatagtttgatggacatgctataccaatctaggttatgcatattgaatagagtattgatatactctaaaaagtaggtggtctgtccaatttaacatttcaatgaaccatgtagagagaaagacttgtatatggcgttctccaataataattataataataataataataatgaaggccctttacttgttgtggtgtagaacctttgtatttttatttaaagcaactcgaaagaaagaaagaaaaagatatttttattttttaaaataataaaggacagaggggaggagcgagaaggtagcagcaccgacacttttgctaggtagccaacgtccaacaaatgatcgatatatctgaaatgactggtccattatgattatgtagtgtaatgactcaattttaatattattttatttttttcctttgtgaaaaaatgataaagagaatgaaatgaaggaaaccccatttttcagttttgttgtggccgtaactcttaattgagtagtagctagtagtagcagggttgcagttataggaaagaaagcattaaaaccaaagaagaacaaaagagaggttgtaatgaaattgctaggctggagccatttattcaacatgtcaaatatctttgcccgacattgtgtcccaacccaaatttattttctctataaaactcttttagtttttagatttggtgtgtttagggcatctgtggttcacagttcacttcccacccaacacaagcgaacacattgccagctgttacctcttgttcttcatggggcccacactaaattatgatattggaacttgctcggttgtccctggccccacctccctcacatgctttttaacgtggcttcttgttattattcttattacagtacaagaccatggactaacctaattattatatgagttttgtaattagcacaacttgcctttttccatatacacaccttatttttcaggtgatgtcaaatatggaggatggaagattaaaaattgtcctataggaaaaagaaattggttagtcttaacttttttgttttttaacattgaggattgacttattttaatattatccgtgtgttatgccaaatgattaaaagtttgctaaaagtttgattgaagtaaaaaaaaaattatcatcatatgtgatgaagacccacaaatcaaattaaagttcaataactattaaacaatgcttcttcgtcttctttttattaattctttcttttggttgctttgttgaaaacatgaaggccgtactagctttaagattttcttttcttctcttttctttccgtaggaaaatgcccttgtgaccattagcttccgttggagtagagagacccttttgcgttaccataaccattcacgttggacataggcaaacgttaacattagcatttcattaattgaaattttgcatcgacaaacgaataacaaattaattaaggtgggatgaaggtatcaatcgagtcgattttatgaaccaaaatctctgctcttcctggtgccatgccttggtttaaagagttttatattcttaattaactaaaaataatatagatttgacttctaaaataattattatgaaaattaatgattttaattttataacaatttatgattgaaaacattagtgtatttcaattaaatttttgttttaccttatttcttttaaaaaaatacgttatatggagagattttaatcttacaaaatattttagataaagtatatatatatatatagttataatttaaatatgtttatattaatagttagatattgtgtttgcctccattaatataatattttttaacgacccattttcttaccttatttattttccttttctattataaatttcgttgagaattttttactttatttgtgcatattttctgattgtgttatcaagagctagtacttgataagactttttgtatttggttttttatatttttatatttttccttattttttacaattctttattttaatttgatgagtcaggttgtaaatcaactctctgaactatcaattcatgataggttaaactaaattgaatgttttttacatcataaaaaaaataagctgaattgggttaactcattttttaaataatatatgataaacttacacaaatcaacggagttatcttcgaatgtattgtgtatagatgaattgtcaatgttattttaactaaattaatgactttatatttagattataaatatataattatgttaaatacttataataaaaaaaaaactttgatgttataatggtgtcatatatgactcgagtaagaatacctcaagggaaaattaaacgtgtcttataaaaaaattaaaatccacgagggtggctccctagtttttatttccggttgttgtagaataccttgatgaaacttaaaagaacaagtgtttattttagccattcaaacgtgtaagatgtgaagttacattaatcgtttatttatcgaggatgtgagatataataactaatgttacgtgttctcctattttaaggatcaatttagcattattttatagtatatgtttggaagatcatagtagcatttacttcgactttaagtaaagagtgtaatatcaagtatgtagtgtaatgcaaatttatatttcaatttacttaaatttcaaataatattaaaaagaataaaagatttggaaatatataaaaatatatgtaattattttaaataaattatataaataatgctaagacagagtaaattttaaaacaataaaaactgttttgaaagtatgagaaatttatatttgagatgaaaataaaatcttatactataaatttaaatttttttaaaaatgtggaagaatgaagaatcactcccaaattattattttttgtgaaagtgtttattttttaaacgtggaaatgtctctcattgaaccttcttattttttatgccacatgatgacttcattgttacttaatgtttattttttatattttttaaaagtaaaggattaattaattttaaaaagttattttatgttaagatattattctctcaaattttattgtctatataattttttcttttcaaatctctaatatttataccctaaaaaatttcatttaattttttaaaaaagatgccctttcgtccataaatccaaacttcctgtttttctacttatttgttgaaattatatatatatttattgttttaaataactgtttgtatatttaaaagaagttgaatataaaaaatacttttatagaacacttgcttgttttaatataaaaaatatatttcaacggaattaaagctgagattataaaatattttttaaaaaatcaatattaaggggaaaattgtaaataattaataatttactacaaagaaaatagtaaaataagatatataatcacattcaagaacaatgacttactttgataatataaaagttatgagttaaaaatactttaaataacgagctcccttttttcttttttcttttttctttatcatttttagagtatttttttcactcaatatatgaaaaggtaaaacattcatttgttccccaagtatatatatatatatatatatatatatatatatatatatatatatatatatatatattatgttactaacaaaacagttgaagaatttgtggggggtataatgtatcatattaggaataaacctatacattacttgggaatgaatcttaatattcaatcttcaaataatttaataaaaggtttcattaaaaaaagttataggtttaaatttcactgtataataaataaataaataataataaagtcttgtcttattagatgagatcaaatatacaaatcatataatatcatttgtaaaatgacaatgagataagaaatacatatttataacataaatattcgctccatgtctctcgtatttatatatgcagtcgttaattaaatacttataattttttaatattttgtggatatccatagacattttactaaaaaaataaaaactttgactacaattttttttgtcaattttgccaatttcttttaaaaaataatatcaaggtcaattaaaattattcaaatattctacatagtcactctacacaaatatactaatcaagatactttaattctgttcttaaatattttatcttagttcctaaatgtttctacttagttcctgaatgtttcgtattagtttttgttgacgtcgatgcaaaaatatttttttgttactattaatttaaactatgagaccatttcaacgtaagacctatctttaaatttttaagtgagttttatttgtacgtattattactttttttttttcgtttcaatttaaacatctcaaaagaatccaacatctcctacccaacaccaataactctacatccttacttcttagtagcaaaatgaccaaccaattcatatatagatattgattctcatttaggaaccgagtgcttgtttaagagtgttacaatacttctccaacacttacccaccaataagcaccgttttcatgaatgaaatatatctctgttcgacttgtacagttgtacttgatatgaaactttaaatttgattactgctaatacaaacactagacgccacgtagaagatcactaagaaagatactaaataaattacaaacaaaaacataacatttgacaatcacaaccagggttactaacaattactaacaaaataaaaggactacttttcctgatagaatgcattattataataaaaaacactttaaaagacaaaaaaattaaattttaaaaagttgatgaattaaaaattcaaatgatcatacaattctatcttccagaaatcaacttaccaacatctcacacttttaaagatataaatttgatggttactcgaaactaaagatacgtaggttatatgcataattgtgaacttgtgaattgtgatactcactttaaagcgggcacgaccttaggcctttactttacgggattagtaaaaataaaataaaattcacgtattaattaggatttttatttttttggggaaataaacatgaagtgccttaatacggtgcatattctaatgtttttaattaataaaaataaaagtatagatcatactgattcatggcattactacgaaggtaatcatacgcaaatcacgatcacagttgttttaacgtgaggtggactagctttcataaatcgacgaaaacgacaattttatttatttattattctattaaaatatcaccaccgacagcaggcactgcccatgtggcataaaagtcctaacaattattctaataaaaatgccgaaaaagaaaaaaggaaacaaaacaagaagaaatgaagcatcacattatcttattcatttttaggctaactaacaaggcatgttttatactaaattcaatcaatattttactcagttacttttattcatttactttcgaattgattcaattttatttataataatataattaaagacttcaaatacatagtgtctttaacaattatttaaaacatcaatgttccttttaaattttaaaatattaaatgcttctagttttatattatgttttaattttaattgctcaacttacatttctaaaggcacattttataatgataaacggtgtattttggtcagcaagcacagctggaaattacgtataagttcttattgacttgagaaaagttgaaagtgaatgtgaggtacaataatggatgggttggctaacccacgttacaggttaaaacttaaaacaactaataactaaaaggttaagaattaggccagtggacccaaagtcaatcaaatatagatctaaccacccaaacccttcttgcacacacaatataggaaaattataaactctaaatacgaacctattgtttaattaccttgtggaatactcaatttttggttatcagagttttttcatttgttttgtttttattgctttaaataaatttgtaaagtgaagtatcgtagacaaaatgcagagtcggcctagcatttccgtaggcttaaaaaaaagtcaagattaggtttttcataaaacagtttattaaattattataattttatttgacacttatctttcagatccttagaatttttttaaacttgatattcaaaataaatttatactccccacttatttcccacgtgtaatagaatgtcaagaaaaaaaaaaaaacagattaggggaaaccaatccgttattattttaattataatttgggagcatttataatgttaatagagaatatgttagatgtaacttttaaagtaattattataaaaattaagaattatattataaatgttaatttgtaattgtttggtggaataaaaaacatttatactgtgatgtgttatacttaaattctcaaaatattaaataatataaattgtatattttaattaagattaacatgtattgaaaagttaatcaaagaaatcaatagaatatttgttaattaagaaagaaaaagataaaatgaaaaacttttttttaaggaaaaatatttatttcaaaaattgtcaattaactaattaatattttgttattattctgcgaggaaattaaataatgttaataacaaatacattttaaccttatttatttggaaagctaaagtaagtgtttacttattcatgggtcagctttgacaacatgtgaatgaattattttttaataaaaaataaccaattaaatttaaacacatttatatatattttttaaataagttacttaatattgtttcagcttcactattgtaattatcaagaaatctaacacgtctttaatttccgtgaataaaaaaaaacagtttcgtaatttaatatgattaaagtgggcattaatttgattttagttaaatgtgaatgtcaactttaaactgttacattctcaaattagtttgtgttaatcgcacgtaaggctcttttgtttttgggtgtttgtttcaagtggcagtaagtaattaaaaggtaatcatgttcttattgttttaatggtatgttagggtcaataaactattgtcatgctacattttattagtttccggcattttatgatttgatgtaatgtaatacatttgatttattctcagtcaataatttatatttatgtgcatctcatttttttcttctaattataatttcaatacaaaataattttgttaaaaataatgactaatttttattaaagatcacaaatatacataaaatagatatctttctcctaacatagtttatttaacatctaaagcttaactaaatttgaattccataccacttcattaacagattcacagttacttatgtgaattgttggttatgtgtgtgcatcgatctcatgctatcatcacagacatattagtagtaaaagtatgcctgccgatttgataaaataaataagaaatagatgaagcatgatgcatagcttatgaaagaaaaaaaaaaaatagtagtactcagaaggaattagtcaataattgaagtaaaagaaaatgattcataagaattgttcctgactatacattaatttaaaacattttttattcacggtgtttgctatggaaatttttttctacattttttttttgtagatgcatagttgataacttgatgcctatattcgtagtggaaaaaaaaaaaaagaaaaccaagattaatattatttatttggacggttgtgattcttgtagatttagttcgatgctgtaattttaggaagtacatcgattgcaagtttgaacttgttacgcagtcgaattgttgttcttcatcgtctttacatttttcaaagtacaatggaagacgatggagtacaccaaatgttgcaccgaaatagttcagtgcttgaatttaagccatgtatgtaatcggttcctgtatttttttttaattattagattagataatcaaagtaaagcaaattaaaattattagcagaaaatgccaataataaaatgtatcataaataccaagaagctacaataatttctatttccatgtcaacaataatgtgaacacatctacgaatgtgtcatgactaggaaaatgttcataaaccatgcataaaaaaccgaaaagaggatccaagcaagagcagaaatgaaaagactcagaagaggtcgttacatttacaacatagacaaaacactagagtctggggcaaaggtgtataacagaacaaacttacagacatttggaaaatcttgtttaaatttataaaagtaattcataactattttaatctattttaataagtttatgaaaagattattaaaataaactattttataacttatcaaatagtaaattttacgattaaatttatgaatattttgtatttatagaaaaatcatttaatacgtatttaatgaattaattttgatctaaagatactcttaattcttaattacaaaaagagatatactccgcgctatacttatgctgcaaaaactatacaataatgtttttaataaatattatggtgaaaaaatactacataatatttattcatgagtatatatatatagggaaagtgttaatggtatagttgtaaagacataatctacgcacgccgcgtgagttgatcctacttgccagttccttgccaacccttctctctctctttcctcacactttctccaatctaacaagtgccagtgaatcctgatctgacccccaatcactccaaatcaatatataaataaataacctaataattcgaaaagtgtaaaaaccaaaaagaatggttttccaattttaattaatacaacagcaaattataatcctaaaacaaaacccggttccttcaccgacgaaattttaacccttttttttcttcctccgaattagacattaaattaatgtaattaacccaaaagagaaataaatcaattttgctttagcattattcattcatcaccagactccaactgggccccacctaccacctcactctttactaactcgtactccttcgtatttttatttttatttattataatttcggtgtgttttttcctccttttttataatcttagctttgattacttttcctctcgatctcactgtcccccccccccccctctcttcttcctcttgtgttgttgtatctccttctctcttacgcgtcttcatttccaaacacacaacacacaactctctctctctctctctctctctctctatatatatatatatatatattgttcgtgttctcagcactttctctctctaaaagattaggaccagccgtcggtggctgccttctgaaggaatcaaagtgcacacactgcacgcacaaccccaacactctccactttctctctctttaaagaagggaaattgtttttggtgtttttcttagttttgccccgcaattggcaattgcgtgtgtgtgggaagcaaaaaagaagaagagagagagtgattttggatcttttggttttgtgtgggggaggtggggtgtgatgtggtggtgttgagcaatgcaagcgtggatctttttcttctgaaacagagaggggttctcgatttgtagaagaaaaagaagaagaagactttgtgagttcaagagttagtgatgcacaccggaggaagactcgttgctgggtcccacaacaggaacgagtttgtgcttatcaatgccgatgagaatggaagggtaacctctctctctctctcttttgaactgcatagggtttttgggacttttttgtctaaataaatttgtgctttatttctcttccgatctctttttctacgccaaaaaagtgtccatctttattgttttttgcactgtcggtggtctctttaagcagtctaatgcggcttctgtggttatcctgttcttatttttaaattattagcttgtcgggtggaggtgtttttatgaacaaaatgggttgtgagttaaaaattggatttttggttttcgggggataagcttcagatttaattgatcgtggttcggtttgagggttgacccttctggagcgtgtttgcaatgtgtgaacattgtgtgtgatttcgctcgtgaggttagctgaggattagttgatcagtgagggtggaacaattgccaattgttttatcagatattggaagatttgatgttgatgtgtgacctgattagctttgagaagttcagtgagaggagtgtgtgaataaatttgtctgtttccctgcctatgtgacttgaatttgtacaacctttaagttgggtaggattttgttaatgaggaatgttattgggtgattggattgtttagtttctccaatgattgtaaattaggtgctaatgacattgttgttctcttgttttgttgttgtttctgctcagattaagtctgtccgagagctgagtggacagatatgccagatttgtggggatgagatagagattactgtggatggggagccatttgttgcctgcaatgaatgtgctttcccggtttgccggccttgctatgagtatgaaaggcgtgaggggaaccaggcttgtcctcagtgcaagaccagatacaaacgtatcaaaggtgagattggttttgtgcttcctctctttgactctggtatcttgttactgttgtggaaattttctcacagtgttaccgaagaatgaattgcaggtagtcccagggttgaaggcgatgaagaggaagatgacactgatgacttggacaatgagtttgattatggggatgttgatgctttgggcccacaaccaatgtcggaatccttttattctggacgccctaatactgggcgaggtgctaataatggatctggtatggcgacaaacttggaacatggctcacctcaaaattctgacataccgctcctgacatatggggaggaggtagtatattgttgaatttcccttttggtgtgcctgattttcattctgtgtggggatcacttcacactggcaactgattctaacgaattaccgtttttgttatttataggatcctgagatatcttctaatagccacgcgctaattgttccgcctcatatgaatcatggaaacagagtccatccaatgccttataacgatccatctattccatgtaagtgctgtacaattatctatttctgcattgttaaattttgtgttgtctgtatatattctcaccctggtccttcttttgttatagtgcaatccagacccatggcccccaagaaagacattgctgtgtatgggtatggaagtgtggcttggaaagaccgcatggaggaatggaagaaaagacagagtgacaaacttcaggtggtgaagcatgaagggagcaatgatggaaattttggtgatgattttgaggactctgatttacctatgtaagtctccaattcaactttttattttgcttcatttaagttcctaattatgctccataattagagtggatactagtgcacctctttacaacatcaaagccatatcattttgcattaggaagacatttcagactccaaatcaatgtaattgcaataggtggttgttggatacatgcatgcatcttagccatgaaatctgttattgttttgttagttaggtgttgcagtatatgcatgtgcacttgaggcaggaggatgcaagtttaactagaatggaacaattatatttctctaatttttctacccgatacttttgctttgtgtattgacatttttatcaatatattataacaggatggatgaaggcagacagccactttctcggaagctacccatcccttcaagcaagataaatccttacagaatgattatagtactccgccttgtcgtccttgggctctttttccattacagaattctccacccagttaatgatgcatatggcttgtggttgacatcagtcatctgtgaaatatggtttgctgtatcatggataatggatcagtttccaaaatggtacccaataaagcgagaaacataccttgatcgtctgtcgctcaggtaatcgagcctacctaccatttctgttgattttttatttcttgattttgcatttattctgtacccaagtatatctcattctaattttcatgcttaaaagtcctactatgttgctcaagattggctttttacattcctgcaggtatgaaaaagaaggaaagccatctgagttgtccagtgtagacgtctttgtcagtactgtcgatcccatgaaagaacctcctctgattacagcaaacactgttctgtctatccttgctgttgattatccagttgataaagttgcatgctatgtctcagatgatggtgctgctatgcttacttttgaagcactgtctgagacatctgaatttgctaggaaatgggttccattctgtaagaaatacaatattgagccccgggcaccggaatggtactttggtcagaagatggactatctgaaaaataaagtacacccagcatttgtcagggaaaggagagcaatgaaggtgtcaactttttctttttaagtaatttgcttcttgtgctaaaagatgcaatcatttgactctgctaatggtctttttcattttggctgttacagagggattatgaagaatttaaggtgaggattaacagtttggtggcaacagcacaaaaggttcctgaggatggatggaccatgcaagatgggactccttggcctggaaataatgtgagggatcaccctggcatgattcaggtaagaagatatatcagtttaacaaacatcaaaaatagtgtttgcatatgatgttgttaggcatctcatggatgattttgaaaactttttttttccctttattttgttttctgttaaatcaacaagaatttgggttttcttaacttttgataagttgtctggggttgatatttgtttcccctgtataaatacattcctctgcctgatgttcaaactaatttgcattatagaatgtaagcaatcatgcattgcaagtagacctgcttatgccacctttctgctttagctagaggatttggattctagtcatcacatttcactgtcttgtgagttagaaatgctaaagttttatttttttttgtattttacaggtcttccttggtcaggatggtgtgcgtgatgttgaaggaaatgagctaccccgcttggtctatgtttctagagaaaagaggccagggtttgatcaccacaaaaaggctggtgcaatgaattctctggtaagtatcaattaacttttattttggttcaggttcagatgatgttccattgaccttaaataacttgtttttgtaatgatattaaatatgtgaaggtgcgggcatcagcgattatcacaaatgcaccctatcttctgaatgttgattgtgatcactacattaacaatagcaaggcacttagagaagctatgtgttttatgatggaccctcaacttgggaaaaaggtttgctatgtgcaatttcctcagagatttgatggaattgataggcatgatagatattcaaacagaaatgttgtatttttcgatgtaagttttctcttcccctttactttacttgtttgactgcttttcttttggtcctttagtatgacagcttctaactccccaattgaaaacagattaacatgaaaggactggatgggatacaaggtccaatatatgtcggaactggatgtgttttcagaaggtatgcactgtatggatatgatgcacctgccaagaagaaaccaccgagcaaaacttgtaactgttggccaaagtggtgctgcctatgttgtggctctagaaagaaaaagaatgccaacactaagaaggagaaaaagaggaaggtgaagcacagtgaagcatcaaagcagatacatgcacttgaaaatattgaggcagggaatgaaggttaggattttggaccatgtggctgtccttacaaatcaaaatacatactgtgagaaatttccttaataataatactaaataaattcttttccaggaaccaacaatgagaagacatctaatctgactcaaacaaagttggagaagaggtttggacagtctccagtatttgtagcctccacactcttggataatggtggagctccacagggcgttagtcctgcatcacttttaaaagaagccatccaagtcatcagttgtggttatgaagacaaaactgaatggggaaaagaagtaagtatcatagaaagaaaattgttttttaaattctttttgaaaaattagtcttctcattcttatatttcttctcttgttcctaatcgttggcttgctaccaggttgggtggatatatggttctgtgacagaggatatcttgactggatttaaaatgcattgccatggttggcggtctgtgtattgcattcctaagcggcctgcattcaaggggtctgcgcctatcaacctttcagatcgtctgcaccaagttcttcggtgggctcttgggtctgttgagatttttttcagcagacattgtccaatctggtacggttatggtggtgggttgaaatggttggaacgattttcctacattaactcagtcgtatatccatggacttccctccccctgcttgtctactgtactctaccagccatatgccttctgactggaaaatttattgtacctgaggtatgcttatatgtcttttgactggaaaatctatttgtctgtcagtgaagaaatccctttcatatttttccttgcccaactaaggaattaaaacaaaagaaaatgtagtatttggattgttgagattaaggctaggatctggctcctctgaagtgtaggtgaactttagagggaatagtgaggggttgttggaaaatctagagtagattttataatctaagcctttgatttataatcaatggttataaagctggattttcccttttcaagtgcactcaccatacaggagctaaattcataatgctatatgtgggaaaactagaatgaaattgatttggagcatctaaatactcgtatctgttgaccttgccatcttgaaactattttggaggttaaggttggatttagtaatttggatgttcttgtcagaaataatttcggcaatcatttataatataaaataggttatgatactttgtaaatcggtgtaaataggtaaatcaaaattattattaaatgaagataaacgaaaaaaatcatattactgcatcatttgtgttcctgtaattttaaatagttggattttactacaaataataaaagcgctaggtatagacttgttgggttactaacatcaatatttctgtctcaaatgcagattagcaactatgccagtattgtgttcatggccctcttcatatccattgcagcaactggcatccttgagatgcaatggggcggtgttagcatagacgactggtggaggaacgaacagttttgggtgatcggaggtgtatcttctcatctttttgccctatttcagggtttacttaaggtcttggctggtgtgaacacaaacttcactgtgacgtcaaaagcagccgatgatggagaattctcagaactctacatcttcaagtggacatcactcttgatccctccaatgactctactaatcatgaatattgttggggtggttgttggggtctcagatgccatcaacaatggttatgattcatggggacctctctttggtaggttgttctttgcattgtgggtgatcctccatctctaccccttcttgaaggggttgcttggaaaacaagatagaatgccaaccattatattggtttggtcaatccttctggcctccatcttgactctcatgtgggtcagaattaacccgtttgtgtcaagagacggccccgtgttagaaatttgtggattgaattgtgacgagtcgtgaataaagaaaagctgaagaaggttagttatttttcagctacactgcagtcatgttgaagaatgtagcacatcatgcttcacaaagttgcacgaattttcggatggaagttttatttttcgggtgtgtagagattaaagagaggaagggggagggggctgacacattgttaccttgtaataggggtttttcatttattctttgattatattttctgtgggttttagtgttattctctttacagtttcatgtattataagaaagaggcattgaatgataaattattccctcttcataatgggggatcctcagtctcaagaaattagttgtcatattttaagttatggtttttgttcttgtttaaaaccttttgggacatgggctatcttcatttgtaataccgtcaaaactatggatattcttgttcctcagatgtgtttttgtgtttttattatttgacactcaggaacctcttgggttggattcaattattgaatgcttggttggcactagaaacatgtgttgtggagtttgttcctgcaagtcgctttttcaaatttattttggacttttgtgatctgttgtatcttttcctgttcaaccccaccactaaaaatagtaatgttattgcaagccgagggatagctatttgactatttcaaattcaagatctggtaatcaccattggcacaattattaggtttgctaataacttctaagaaggaaaatcaaagtcacgaaaaggttagcaaaattcttctctgcgagaaagcaattctaatagtgaaatgtcttggctgctcacttttaatatatttaaagtataaaatagttttatatcattaattaataaaatagtctaatatgattgttaagatattgtaaaagttaataatttattatacatgctgatttattattaaagtgtaaagttgtttttacaatgacatagcatagcctattttctgttaacattggaattcagatgacacgatccatttagcgccaagttcctgtgattattttcctcattttttatgggagagaaatgtgcctgaactcaactctgaatactattttgtcgattactcatttattggataacttgtgccaggataaaaagaaagggctaaaatggctaaaacgaggattctgatttaaatcagtgagcattcgtactgtttgtgaaatacagtttggtctgtaatgggccaggtcaaccattgggcccatttttattttcctttaactatttaggcttaaaatgctgatctaaagtccaaaatgttgtgtcagaaaataatgactaattactgaaaaagttgaatgtattactagtatagtggaggttactgttattggtaaaaacgataattaaattcaaatatttgagtttaaaattaatacaaaaacataaagtctacaaggtttgccccataccaagtccacttgatccaatctcatcatttgcataagtccattattgatgatatcaagtataaaactttcacctttttctttgttgaaactattcttcatataatacaacataatttacattaaatgcaaaataatttaaaattctacttattgagatgatatcaagctacttactggttagttttttatataatgactaattttacgtcaattattgatttattgttagcagtctcaatggccaaggagaaggtgcgagtttttatctgaaagtaaaagtaaaaaaaggtaggtgtgtgtgagccagggcagattatgagcatcggatagttttctgtttcactaaatctaattgggctggcaccgtggtctatggtacgtagttttggtatctgctaaaaagtaatatctatacttgaaaaatcgatcatttaaaaatttattcaattattttttctctgttaatttaaccaaacatgcccacttttagttagctctggaacgaattgcattagggaatgatgaatgttatgttttctttttctttttttttggcaaaaattattcgcaaacaaattatggcctttgttgaatgcacatgatgatatcagtcccttgcaaacaatatttaatttacctagtgtgagcttcgtgtgtgtgttgtatgttctgttgtataacgcgtacacaatctgttatttttattttattttatttttttgtgttgcatagcacttcttatataatcattaagtacatggtcaaattttagatatataattacgttaaatattcggaaaaaaaatatttttttagttataataattctatttaattcgaacataattacttacaataccaaatacttgtgggctaaagtaaaacagatacttctaattgaaagagttgagaaatcgggaggtgataatttacacaattgctttgcttccacgttccaagcttcctgacttgcataagttaattatatgccttaattttaaggaaagcgcgtgacagaaagaaaaaacaaaaaaaaattgggagagccttgttgataaaattaatgtttgattaattttaataaagaaaacaagtttacttagtcaaataaaggttcaggcttcagacaaccaaaaccttacaaattgtgaccttgaatcaactcttccactttttttttcccctttttctccccttcctttccaaaaacaaaaatacgttgggaaagtttttcagcacgtaacgtattctttaagaaacctgagaaagatagaaaaatgaaatgaatgacgcggatagaagaattcttggtaatcatttttataaagttcgtttattggaatagtttatgttataatattaaatatttatttaattaattaatataaaatgaaagagtctaaattatatataagaggcaaaatcatggaagtgtttaattaggagtttggataaagagaaaagagtcaaacatgtttaattaggcaaaatcattattattattggctaaaagaacttgaacaaatttgaagttttccaagagtttcagaaagtggactctttcctgagaaaaacaaaaacaatcttgtttagaaaaagaagaaaaagaaaatcatttgaatagtaaattctacgtatctctatcaaggtgtgttccaatttctacacgggcagcgaattagccaaatgctgctgatctatgacttgggtcaactcaactcaagctcatataccacgtctactctataattcaatttctcgatgaaagtaatgataaaaagaaggatatgaataatcagtatttttaaaatataagttaaaaaattaaaagtaaaaaatatttattataaaaattataaataatataattttatgcattttaataaaaaaaaagcatttttttttagtttcgtatttagtgtcctaagataccaacaaaaaaactgtttaggactttgggtgcattattacccttttaaaagaaggtttttttcttctaattatagtacccgttggatggccgaccaataagtcaaagatgagatcacaaagatcaatccaacggttacgagtcgtttttgaaaagtacggaaacattggacgattctgatttatgcattaaataaataatataagattgtcagcttcatagaaccaacctcggagtttctatccagctggtctcgttcttttctaaattaaaacccacaaaacacgctaaatgctaaagtacataataatatggtgataatttgttgggctgtagaaaaacacacgcatattatcatcattaagagtgggttctaagtgcatgcgttaacataaatctctaatggcagaagcaccttcttctcgtaagagtgaggtcgtgaaggatcactgcttggtgataactgaatctgacgtggatgcggcacagaacctttcaggaagcaagaggagcagaagcatggatgaagaaaagggagaagaggttgatcagaggctaagtgatattataatggcgaaaatacaagagatttttgggaatgatatagatatagaggtttttccaacgaagaagcaaaggagatatcggtctcttgtgagtatttacatggtcacaaggccggttaatgctggaaacgatagattaagggtgaaggcatgagaagtgatggcaaagttagtaagggtaattaatatatactaatatatattaaaccctcaactatagttttaataattgttaactgggtcagtcccagatttttgttttgtagaaaagtttctctccatcgcaacttcagttgtactctttctatatagagaaatgtcccagaagcagtagtgttgcgttttgtcgttaatccgttagatagtgcatgttgatttaatattatcgattgttgatgaagaatgatgcaaattaagtacgtatcttgatttggcagtttgtttaaattcatccacctgaagctttcatatatacagttgtccaattaacgcatttcattttctcttatcaattagttcattctatggtgaggctgtgaggagaattgctttaatttgggttgtcatcaacgagtgaatgtttaacgtaattttgtagcttcttccgagagtaattaactggtttttgttttcgttttggtgtgtgtgtatacttgtgtaagacctatgacctatgattcttctaatggtgatggaggaatgaaagataaatttctcaggtctccacagtctccacacatgcaaatgcaatgtggtgtttgttaatggatcgaagctagctagctataaaggattgaatgtgcaacacattcatgataatacttagtttgttgacttgtattaattgcaaaatgcaaaggttcagaagtttggttttgcgcacacaatttttgaattgtccactgcttccttttgtctagacttaattcagaaataataaagagtacttggatagtaatgaaaactgacggagatcgatccacacttggtcatgctaagaactcttatatatttgcatcttgtaaattaactaggacttttgttggtcttaattagatcgtgtttcgtctcattttcctaggggagctaattacagaagaaagcacatgagatatctcgatcaacggcaagttgttatttacattgctcgaggaagtatcagttgctgcatttatatttaagctttccggcctttcccacttcgtcctcgatccaaattctaaagagcttcatcttcaaaatacgtagtattctaaattaatcagccagtgctaaacacacacacatataaagtacatgacgtagttatgtgatcacgtattaaataatcttaataatttatgtatgattatatactttagagttaagttttcacagctttaaaataagaattatttttattttatacacactatatttatataagaaggataatattgcaattcatgctttgatattttacaacgcatttttataatttatttttctttccttttttttctctctttctaatagatatttcactttatctcatatatctttcttttgttcttcctatctttatcatttccaaaaattaatctagaaattctattattcatgttttctaaaaaaaataatattataactaggagatagaaagaaagtggagagagaaatataacaaagatagagaaaaaaatgagttatcagaaaaaaaagccataaaaataagttttaagaatatatatatatatatataaataaatatataaaagaaaaaagttataatgagttttgcaaatataagatatgttttttcaggaaatattagttattaatcaagtctatagatacttcacatagataattaattgaaattttcaaagttatacattctcgaaaattcgtatattcttcttgttgatcgacggttattacaataacaaataattttgtcatatatttaatgccaccaagatatgtttttagatgagctaaatgtctcttcaatatagccgtatctctttctggaagatatgttttataaacataggaaaaagaaaaaaaaaatataatatacccttcagggttaggtgtattcaacaattttttgaaggaaaattaagtcgctgataaaaaagaaaaagaagaaggaaaattatgtttggtatgagtcaggttactaaaaaaagaactactgattgcctttattgaactatagtaaattatatttattggcgatcttttatgattaaaaacagaaaaaaaaaaaaaagatgagagtctatggatcaatttgaaaagtcaaatgacaaaaaagaaaacattgcattcattagctaaattggtcacaaacgtatataaagcatacaccttttgggatgaatatcccgggagtaccaattcgtgagaacaagtcaacaagtatcctggacatgccgactcaaggcacaaggatcacgactcacccttaagcattgagtctgttgtacatcattcaagatggatatctcgggaataccgaccttagcaagagggttgacttgccctgtgtgtgcaaagccacagctccatgctagaaggacttgacatcccctaaggcagagattatattcaaggtgcccaacttacagcaatgatatcaggagcagataggaagaatgaaacgatagaaggtacagtacaagacagtactttgttaatgtggcaacaagataaaaaaatcactgcggcttgacatgtcaggaccacacaaccacacatcctatactgtgtacgagaggaacagaactgaggaagcacaggagcatggcaaaaagggaccgataagactgtgcctagtggatgtcaatgtggaggagtaccatgtataaatatagaggtgaattgtatgactcaccttaggttcatggttagacggaactaggaggagacattgcaccctttctccttggtcttctccgacgtgaaaatagagatacactcacgtatctataaacacagcctaagtactaagaagggtaacggaaattttcctggtatttccctaaatagttaacgtaaaacttttgctctaataaagttttaggtatgtgcttagtataattcttacaagaattgcttcaacgccatataatctttgagcttagtttaacaatgacacgaatgattaataggaagataataaaatgcagaccagtgagcccccctcctcccaagcggagacattcttccccttccaaccttcacgtggttgtcttgatcatgaaaaccatataacaaaatgtctaactagctacccacaatctctggctcttctatgtatgctgatgtatgaggacttttgtatatatgttttctatcctaatatttatttagtaaacaataattttaatcaatagttcataaaaatcatccaaccaccattttgttctgtcacgtgttgattgtatgcgcattttaaaaggatttgtctcttctaaagtgcaccagagtaaagtacacaaatcttgacccttcattataacaaatggctgaaattaataaacttcaattaaatttggcacatcagatttttgttttcttaaccaaatattgaattaaaattaaaaaaaaaatcattgaattctgtaaaaatgaaaaagttattgaattaaaatagggggaaaataaattatttgccaaactctcccaaatcaacaccgactaggcaccttcccactgactccatcttcatctacgtcgaacaggaaaacgagttttgccattcctacatgcttctgattcttgcaagaattgcactgtattttgtaaatgaacccaagaattaatctttttttgtacttaaaactaagctagctaaaagcaaaaaataagtcctctgaaagtacaagtgtcacgagcaaagtatttaggtagtgaaacaatcatatatacttgcttgacaccaaagcataaaacaactgctactccttatccaagtccaccgcttggaacagataaagtgaataaaatataaggtgaattccaagcttgagaacatagcttcaaaacggaaacatctccgcttcaaaacatcagcacgataagcatagtaacttggtgacagattttctttttgctgtttgaatctgttgaattttttgtatcaactgcttatagctccttttatgatgaatgtcaaatctttttctgttcacgaggatgatcaaatttttgtgatcaatcaagatgtatgattaatgaataattctggacctgtgaggtggagagaacctaaatacggaggcaacgacgatgggttgaagtttagtggaggatgatttggactagggtgttcagggagtgtgagaacaaatttgtttttttttttttaatttaataatttattttttcaaaataaaaatctgatgagtcagttttaatctcaactatttattataatttaggactaagattagtgcactttactctccaaagtgcatggtgcactttagaggagtctattccattctaaaactatgtgctttacgtcaattttttattgctctacacctctcattaaaagcatgggccactgttataatttttttccttttatatattaacaatattgacagtactagtagagtagtagtattatatttcttggggtctagggttcaaaagtacgaacttgggaaggagggcatccactgaaagcatattagggtcacgggtgactttaggtgtcattatggcattatcgtatattaaaaaaaaaaaaaaaaaaaccttcacattgtcttcgtaggaaaattattgaagttccataaaagcccaaaaactttaaaatcacaaaaaggcaaaaatagaagatattctacattacacatgatgaaacgccatggcatgattgtcaaaatgcatcgacatgcgcaacggtaaactgatcctaaatgtcgccaacatcaggacattatcatctctgtaatcatacatctaatacaattaatcaatctataaactagaacttaatggatgaaaactaagaccacaaaattatgcatattgtatcttcaggagcctcgaggcatgcatgaactttcaaacttcccctttaaacttggcttcgtacgactctggttgctgcaaaacaaacaatctcttgaaataaatatagaagaaaagttttaccatataacattaggaactataaatttaaaggggagaaaaaagaaaaagggaagagagaacaaagacattcaggccacacatgatatcatggtaatgtgatcatcggatatgatgatataaatactcttacctaataagactacaggaattcttatattctaacccgcggaactaagctctcaatcttttacatataaatacactaaaataaagaaaaagaattgagaaatatacacaaaaccatagcgttatagacatcccaaacattgcaggagagactactgaaaaacctgctgatactaagcctcacgtaacgtagcccaaggatctgaactgaaatatgttgatgcaaaaggataaccggtaggatggtattcgaataagagggcacctacttagacatctgaaaaagataatataatcctagaaaagaaatacctcgagtaaaataaataagttcaactccgactatttcatgcatctgaggaaaagtatatgaaaattcctctttatagatccctttccgtccttggtgaccggttgatcatggattcaaattcaaaatcaatctttttgcatatgtaaggataaaactgtgtataatgacctctttcataccttccgcataacgaggagcctctgggaccgggatacattagtattttttttaatgcgaagtattttattaatccttctgtacagaaatgtcatcttgttctcaatatttttgcaaatatcattaaaaacattaacaaaaaagaagacgaccaaacacctaatttattatttattattataaatcacgttttcaagtccaaaggcaagaaaggtggaactcatgaataaaaagattaccatgaagacagctgaaattaatctgcgtgcaaaccatctcaagtgcattgcatgttgagcagcacttgctgcttccactgtatcaaaccgcaaatacacaaaacctgcactttttctgtataggtgaaaccaattaatgaattgtaactcacatgtaatgtggaaattaattattattattttaattaagtaaaagcatgcagtaaaattattcatgattattgaagtgtgttgcacatttatgagcttacttgtcaacaaaaatatgcttcactcggccatatttagaacactcttcctctacgtcatctttaatgtctatatcaaaatctggttccgtctgcattgcaatgtttgccatcagtactttgttaaatgacaaatcacatggtggaagtatataatcagataaccacagacctcggtgctcggatcgaacatattctttaaaagtaaacactcgctggggtttcctacaggttctaccactggattaggcatgacttgcgttggtagaactggtgcaccaataggcaagctgatagtctgctgagcaggaactgagccattaccaacaggcaaacctatgctgcaaagttgaaaactgtgaagataatgaacagatttacaaaaatgagcaatattattaacgacataccttgcagggtcagcgccagccagtctctgcataagcaatgctcttgaatgagcatttaaagtctgcatagcaaagcaaggcacataagcaaggtcttcattttgaataaataacattgttagtataccagggggaaaaacaacaaacaaagatgtaggaacagagaagcttcctaaaaaaccctcagacccgtccccaactagaaagaccgtccccaacttgaaagaaaagttgtttctgagtgcaaaaagagagtgaaaatacataaaagaaatcaatcttcatctaattcgataagagggaatcctgacagcacctgcttctaaactatgtccagaattaacttaaagtttatgtgctgatgtgcaaatcctctcagcactaaacttcaatgcaggtcagaatcaatccataaacatatacggtgaaaatcattataaatacttaagaaatacattagcaaataacacttccagcctatcaagcttctaagaatctggaaaaataaccatgtaactaaaatgttatacttataaaacttcaaggcccatttgtttaagcaaggaaaaaagtgattctatgatacaacatttttagagcttttgcttagaagataaaattttaacacctgaggaaaaaaaaacaatttttttttttgaagagtttgcattgatgattataatttttttaaacatatcttttaactgaaaaaaggggggtctttttctttaaagcacaaacaacttcagtaaatttgcgatattgcatgatgaggtatagatttaaaattttaaatgacacatcaccagtttttgaatattttacataacggaagcaaacttaccaatccaccttcatcgtcatccaagtctgcagattttgcagttgcatcttggcttgcaacatgatctgttacacatgaaacctgaatttgatgctcaatatcagtcacaaacaaaagaactgacagaattatcatcaacaaaattgaaacaaaccagagaaaaacaaattgaacaacacatatttctaccttgatagtccttccagcaatctccaattttccatttaaactctgagcagccttggcatgttctagatgagtaaactgtccaatgaatgcaaataattagataacaatgctacctaaataaaaaattctcgaagttaagagttagaaacgaacttgaacaaacccaaaacccttgcagtgtcctgtttccaaatcaagaggcagttggacaacctcaactggaccaaatggctcaaaaatctaaaacaccaaaaacaaagtatatcaaatgatgataaaactgcggaaataagattcaaattggtgataacctaccaatacactagatccagataagagaaacttaattgaatgtttctaaggagatatgaattttgtaaagttattggtattcaataaaatcatgtgcatttgtgttcctaataaatgtagcaaagaccaaaaagaaatatgccgaaactctccatccacgccacaacagcaaataagacagcaacaaaagtaaaatacctcccgcagctgactctcagtcatgttgaagtgaagattccccacatacaattttctgtccacagctccatagggcccagctacaccagccgctccaccagaagcattagattgaacaaggttcttttcagcttcagaaggtttcaccattacaggttgcccaagaagaagttggccagaaagagcaatagccattggcactgacatcgaatcataaaattcaatatacctgcatcaagttttcagaactaataaacaaagttgcaacaaaacttacaaagcatacagcaaagagatgtagggaaacaaaaactctagtgcagacagctcaagctgagtttcatttagcctgtcataataaacattaaaagctaaagcatgtattaattattaaattgacaattcaatcaggagagaataagagaaaaagatatgagaatataggaaggaaaccatcgagaccaatgtttttaaaaccggaccagtcattgaactaatcaaggcactgatccggggttcaatgttcaaccatggtcgaactggtattaataaaataataataattcaataaatgcataaaataatatgaaaacacaatataattttataaagctaaaaataaaatataatgctatagattcttaatattcaaagtacacaagaaattcaaaccaaaatctaagtttcaacaatacacaacaatgttcattaatcataataagtttaggtttatttttcatatttttatggaaaacaaatcaaaataacattatattaagcagtttccaataacccgttgtaaaccggttttctggtctgaccagttttcacaacagtaattgagacaggaagaggcagaattagcaacagtaatagactttggctatatatgtatacatgggaaaatccaatcctaagaaaagaaaccatatcaaaaactggcagctggccttgctcaatatttcacttgtcatataatagtaaaagtcaaacagaaccaaatccatgagcatctcatctagctacttatagccattcttctaaaaaaaaaatacagatagatagaaaggagagtacaatttcctccatatcaaccttaccaagccccacaaccaatacaaggggcttccaattaataaatggaggaaaatgaactaaaaggggtatcagcatacaaatgaaatcctcattgtatggcatgcagaggaagaaaattgggaataggaccaaacagaaaactaggattatgtcatctaccttgagtgcgcagcatgaattgattaaacatgagtgcaaggtattcccaccatccctcatcattatcgcattgctagtccatttaaagatacagttaaacatgattcttggaagttcatatcctaataccacaatagcacatacatttaaacaataaattatttgacaataaaacacatacccaactcctttagatcgtcttgagttcctatccatgatcagacggacatctctcacctaaaatgaaaggaaagaacattaaacttgacggacgaagtacctcatacaaaggcaaatatatgacattcaccctaagcatgcaaaccaaacaccaaatttgtgacgttgaaaatatcatcatgtaatgtaagtatgtaaccccatattcattcatcgcacaaacgaatgtcgagacataataaagttgctctcctacttaaaactgaaggcagaggacaatatactgcaacagaaaccaaatgtctcagaataagaagcattcagtatgcttgtaagaacttttacattgtatataattgttatcactcatcatgaatgagaagcaacaatatactaaatacaaaacataaaatacgataatattaatagtttaaatgacaacagaagtcaataaagttccaatggagacaaaatggtttgataggcaagtcatcacagttccaatggcaaaagtacatcaaatttaaaagcagctgaccttgccagcttttgaaaagaactcatacacatctctctctgttgcttttagcggcatctgaaaccaccacagggcaaatagccaatcatcagaacaagacaccaaatatccaaaaatgtagaacttatatattcatataatttaaaacaaacaaaaataggaacctccaatcaacctggtaggcaaaaacagttctctgatccctttctgggtctgcctcaggttctgcggcctctttcttatccctaaatctcctgcaactcaaattataataaagttattaaaaaaaaataaaagagaagttcatattagttaatttagaatcctgctaaatcttaagagtcagactagccaaatgaatgcctatggccccaaggtgataggcgcttaaaacttaaaagtatacaccttagtaaaaaaaaacagagatatgttaatgccttgcagtaccatagcaatgatatgattgatatacattctcaggccacctcaaggtcattaacggaatgagaattgcaaacagcaaaatcacatactagagtattataaggagctgcagttattcaactacagagtcatctagcttctagtagaagttagttagacagttactgttagactctaacaaaattgtctatatattctgctttgtaagtctcgattacttgggttaatgaataacattttactccttcattcattactttctctctctctctctctctattctctcaaactaggaaatctatgattgtatcagagcttagtcaatcatcaatggcaacaaactgtgtttcttcttcttccgcttccgcttttctgagttcaatttcacacaagcttgatgatttgaatttcttattatggcaacagcaaattgtgcctgtcatcaaatctcacaaacttcaaaggttcgttatgaatccgcaagttccattacgatttcttactgaagcagatcgcaatgcaggaatggagaattctgcatatgagacgtgggaacagcaggaccaggttcttctcacctggttgcaatcgaatctgtctatacatcgattctgtctcgaatcatttgttgtgttcattcgtatgaggtctgggaacgaatccacaattattttcacaaacagacgtgagccaaagcaaggcagcttcaaactgaattgcatgcaacgatgcttgaagataagtcgatgcgcgagttcctgcttgggatcaaagcaatttccgattcacttgcctctgttgaaagtccaattgctcttaaggaacacattgacactatacttgaagggcttccgcaagactatcattcagtaatctcagttatcgaaagtaagttccaatctcttcctattgaagaaattgaagcactgcatttagctcacgaagctcgattgctgaagtttcgaaaaacatacttctgaaaggagagagagagagaaagaaagtaaggaatgaagaaggagtaaaatgttgttcattaacccaagttattgagacttacaaaggagtatatatagacaattctgttagagagtctaacagcaacagtctaactaacttctagctactatcttctactagaagctagatgagtctgcagttgaataattgcagctccttataatactctaatatcacataaaaaatatataacacgaagaagctaaaatgcataaaatctaccctcaaacgatacaaatcctgtcacatttctttaaaccaaatagagctcttattcccaactcaatccctcctttcacttgaaaaaaaaaaaatgaattgtatgaaggacaaaacttaattatcgttctttaggtgcttttggtattgttctccaatcaaacttggtgttttgctgcggtaacccacatcgtaaaggtttccattaaagctcaacatagattaccaacgaaaaattccaattctgattagagaatcgtaccgaaagtatctaagacactgtatctaagttcagtccttgcgtaaaataccgcacagttccaaccaacatgaattatagccacaccattagtcttacaaccatagacaaaactttttaaaaataattttgtaaacatatttcaagtaaaaccagtcgctgaaaagtatcaactacatagcacatactaagaaaaacaccaatccagtacaaaggaaaaatgcagatcacatcaccaacgcacacttacttatgttttcttttatttatatttcaccatatttatgagcatccattcaaaccatttacaaactaaaaaaaattaacccaggttcacaaagaaattacacaaaacacaaaggaaagagcaatttaccggccatcgcgcatttcgaaatctcgctccctgtctctatccctctcagagcgactcctgctccttgtggatctctccctcgcctctctttccctctctctctccctatccttctctcttctctcgcgctccttttccctatctctgtccctatcacggtctctcctatctctatccctatccctatccttatccttatccttatccttatccctcctctctctatccttatccctgtctttcctctctccgtctctctccctgtcgctcctgtgacggccggaggaacgttcgcggtcacggtctctctctctgtctctgtcgcgatctctcttggaaccaccgttctcgtcgtcgccccttggtctcttgctctttctgtcatcggcgtcgagatcgtcgtcgacgtcgcggggcttccggtaactcctctcgctcttgtcggtgatgtccttcttcttcttggaggaaccattatctatgtcttcctccactgtcttctccaggtattcgtactcgtcgaagtccattggttcctcctccttcttcttcttcagctgaattccgaatttctagggttttagggttttgtttactctcagtcttcccagaggataacagctgttgcttcctccggtattcgtaacagtattatagaagctttaattcacatccctactaaaataaatattttcaattatattatgattaaaatttataatattcctatcataaaaacatatataatacttaagataaaggctagattatggagtttgttttgatcttatattttaaatttcctttactagtatctatctcagttataattttgacatatttttaaaaaaatttatgtatttaaaaaataattgagcttttgttttattaaaagtttaatttatttttttatgatttaaatttgatcaatttgaagagtttttgtaaattgattaatatggttaataattaaaaaatgacaaaaaaacaatatttactagtttatacgtgtctttgtatgcataattaacatagtggtcatttttaactgatgtaataatattaaaaattaaataattccttcattgacttaaaaaaattatgtttaactttttatctgatttttatgaatttaaagttgattgaggaattttcttatcatatttcgaacaatattattaaaaatcaaataatttcattaaaacgtgtgataatcaaatactttcttgtgttacataattcaaattattttgattaagagattcatgtcatattttttatgcaagcagcatattaataacttgatttattacataaaaggaacaaatttgatcaagttttaaagttaaaaaaacttttttttatacaaatataacatgatttgctcaattattttcatctagacatttattcactataaaatttaggacattttgattggaatacaacaatatagagtaactcaatcaaatttgggattcatgtaactatgtgagagaaatcaagcacataaatatttaagttctttgtcaagaattttttaatgttttaaaaatgtataagttaaattgtaatttttatccttctaatttcataattttgcgattttgatccttttcttcagaattttggtttacctacacaattttgcttattttacaattatattttggttattaaccaataatagtaatcaatagagtaattaaattaattatatattaattaaaattcattaattattaaaatatcaaagattattaaaccttaacctctttccctcaattatatattactcccattattttttaaaaattaatttctatttgagcatttcccccttcaacacttagaattccgaactatatgtgttagcacaattgatttttttttttttctaaaatctatctgtgtggatatttccatttcatgtattgaaaaattgaaagagtaataaaagtgcacaaaacatgagttgaatcaaatcactgttttttctagcctaaagattatcgactatttttccagtgaaatagaggttcaaaactccatatagcatgaattgaatcaattcgttattcctggctttttttttttttttttgtgaaaagctgtaaagtttttaaatggttagtttttttatctgcaataattcatatattaaaagaaaaggcttgtacgggaaatgctacaagaaaagaaccataacgtaaagaagccaatagtcataaaggcatagttctcctttacctgagagacatccaagacctagttgtgaatatcaacagcaaagaataaaaatcatcttcccctaataaacaacactgaatcttttcctatacaatcatgtgtgtgattgtataagggaatatacgattctagagaacaaaatcagcaccaactagtgacactctcaactatgacaatatctattgcaattaactgtaagaacgttaacatttataattgtatgaagtagctccttggactcactcgccattgtttgtaggagtactcaaaattattttcaaatgccctaagtcatgtccataatgtgaacaaaaagtttgccacattctttctttatccatttgttttccttcaaacacaatactattcctacatctccaaatagtccacacaattgcagcccaagcaacatcccacctccccttagtttggtatccctacaagctgtgaccattatgccaaaaatgagcccgaacacactgtggtagtgttgagttgatttggaataaattataccattttctccaaatgtcatgaaccatattacatgtgaaaaattagtgttgtaagacaatgcacatgtagcatattgatcttcaatttggatattcttttttatgagattaaccttggtaggtaatcctatcataaaacaatctccaaatgaaaaaaaatcaccttttatgatattttaattttttaaaaatgcttaataagtaaagtcatacttagacctcaaatttgcaaaaccaagacgagaaagaattgaaagctttcaagagacaatatgtagcactacgccaatttacaaattttcgagagtaattattattatgttttgtttatttgattttggttagataattgcaaaagattaatatgtttcggatttttattttcattttccattaaatactttaatttattattatataattacacgttattttttgtttttcgtactttaaagtttcatagtaaaaatgagaatggagtgtgattgatacgggtagtagttacctgctgcccaccatgtgaacaattatgaatctcgtgcccatcctgttatccacgcgggtatccttgaagcggatatccgccaatttttaaatattgtaattaaacgtacagattattatcaaacaaaagataggaaaaaaaatatcttgtaacacgggtaattattccatactgttctattcacggtaaccctcatcacacatcatacctatcttcaatcgctattaacgaatcgaacggtcctcaggaagcagatcgaagccgcgccaagaaagatggcgccgatgtaataaacaaaacagatcacaaaaagcgcttccttctactttatttcaaaaagagcgtggtcccgcagcacctagcgtaacccacgctcccacatttcattcaattcaagttctgaattccaaatccaacgctctcgcgggaaaatttcgaaactgcacacatttgcgagggaaccctcattattcagccggcaaaaaaataaaaaaactttcacataccccaacccaaccaacccctcagcacacaaacactctatttatactctcgcgcctgccccaaaactgttcgacgaaattctccactgagagatacagaaaaccgagaaaaagaaaaaaagacaatatgtatgtggtgaagcgagatgggaggcaagagacggtgcattttgataaaatcaccgcgcgtctcaagaaacttagttacggtttaagccccgaacactgtgaccctgttctggtgtctcagaaagtgtgcgctggcgtctacaaaggcgtcaccactagccagctcgatgagttggcggcggaaaccgccgcggctatgaccaccaaccatcctgactatgcttctgtgagattcttctcttctcttgcgctttttttttgtggttcctattatggcttaaaggctgatctgtgtggttttgtgtttggtgcagttggctgcgaggattgccgtttcgaatctgcacaagaatacgaagaagtcattttctgaaacgtaagtgtgatggagaactgtctctgcgttttgttgttatgaattgttctttaccgtgggtgaattgtgactgtttcaggattaaggttatgtattaccattttaatgagaaatctgcaatgaaggctcccctgattgctgatgacgtctatgaaattatcatcaaggtatttgttgctgtttgaaatttggtttgtgtgttgtttatgttctattggattacccacttaattgtggttttcatttgtgaatgtttcttatgtgtgatggatctggtgtcgtataggtttgactatctgattgcagttgatttatgtttcaaaattggaagatataggcctttgagtggttttagtatagttactgattattgactgttatactctgtgtgtgtggtgtaattctatgcttttaagttttgtttggctgttgttctagtatgatgtaattcacttttgtattgttttctattttgttgtagaatgctgctcgattggacagtgagataatctatgatagggactttgactacgattactttggtttcaaaacccttgagaggtcatacctcttgaaggttcaaggaaaggttgtggaaaggcctcagcacatgttgatgagggttgctgttggaattcataaggatgacattgattctgctgtcagaacttaccacatgatgtctcagagatggttcactcatgcatctccgacacttttcaatgcaggaacacctaggcctcaggtatagtttctgttaatgctccttccctccatgtctcccttttttgtgagcatgtggtgtgccttttgtccttattgtgtaagattactatggtgaccttatgtagttggatatgtttatgtgcattggcagttgagtagttgcttccttgtgtgcatgaaagatgatagtatagagggaatatatgacacattgaaggagtgtgcagtcattagcaaatcagcaggtggaattggtgttagtgttcacaacattcgtgccacaggcagttacatccgtggcacaaatgggacatcaaatggtattgttccaatgctgcgtgtgttcaatgatactgctcgctatgttgatcaagggggaggcaagaggaaaggtaaataatcattacactgtgttgataatttctacattgtaattttcatgaatatttataaattgtcttacattttttgtgtttcttgtaggtgcatttgctgtgtacctggagccatggcatgctgatatatttgaatttttggatttaaggaaaaaccatggaacggtatgattgatgagcctttaaaaaagtagcaattttggttcccattatttggttttgaccctagttttatttcatgctagttgaagaatggttctattttattgatatagccacatgttatttattcaggaagagcatcgtgctcgagatttgttttatgctctttgggtgtctgatctctttatggaaagagttcagagcaatgggcaatggtctttgttttgccccaatgaagcgccaggtttggctgattgctggggtgaagaatttgagaaattgtacactcattatgaaagagaagtaagtttgctctatgtatgttggccctttttaatgttttgcatgttttgaatattccttttgcttattattgccttgtttttctaaccaaattcatgtatacatagggaaaagcaaagaaggttgttcaggcacagaatctctggtttgaaattttggagtcccagatagaaactggaactccttacatgctttttaaggtggtttacaaatgcatgcttaacttttgctaggtttctatttcagtgcattttgtacttatttttcattgaaacctcttgctttttctatatcctaggacacttgcaataagaaaagcaaccaacagaatttgggcaccatcaagtcatcaaacttgtgcactgagataattgagtacacaagtccaacagaaacggctgtgtgcaacttggcatcaattgccctgccgcgatatgtaagagagaaggtaggacatccctggcatacttcatgtgttaggatcacatatgtttggtttcttggtagctatagatcaacttgttattcctgatttaggatgtttatctacttgcatagggtgtgcctatggaatctcatccatctaagcttgttggaagcagaggctcaaaaaaccgatattttgactttgacaaactgggagaggtacaatttctagttattcttgaactaaacactatactggttgttctttatgtgtttcaatatgtattgacattatcattatatgactgataattataggttactgcattggtgacaacaaacctcaataaaataattgatgttaattactacccagttgataccgctaaaagatcaaacatgcgacaccgacccattggtattggagttcagggtcttgctgataccttcatactactaggcatggcatttgattcaccagaggtaaataacatttgtgggactgctttttcatctacaatttaagctagatgttcatcaatttgatagtttacctggacatggggtgcaggctcagcagttgaacaaggatgtatttgagactatatactatcatgcactaaaaacttcatctgaattggctgcaaaagaaggtccctatgaaacatatagtggtagtcctataagcaaggtatattcttgttaaaggcttttatacttgtgcctttttaagtgtcctgagctatatttataatgcactggaaacgcacgtgtatattcaacttaattttttaggcttatgattagaaatgtaaacatccacgatgtttgtatgtagtggcttaggtgatttttgtattgtgcagggaattcttcagccagacatgtggggtgtgatgccctcaagtcgttgggattgggatgcacttcgggagatgatatcaacgacgggtgtgagaaactcacttcttgttgcccctatgccaactgcatcaactagccagattcttggcaataatgagtgttttgagccatatacttctaatatctacaaccgcagagttctaaggtttattgccataccatcttattaattattatagtttgatatcttattgatctatcttgcttgttaactgtttgtctttcagtggtgaatttgttgtagtgaacaagcatttacttcatgacttgactgaaatgggactttggtctcctacgatcaagaataatattatctatgagaatggttcagttcagaaaatcccagaaataccccatgacctgaaaatcatatacaagtatgagatttgtcattttgttacttacccaaacttggctctaagatgtttatgctaaactcagtttgaaattttcaggactgtttgggagattaagcaaaagacattggttgatatggctgttgatagaggatgctacatagaccagagtcagagcttgaatattcacatggatcaacccaactttggaaagttgacttctttgcatttctatgcgtggtcaaaggtatatagaccttcttccttgggtctaattaatatcatttttcattggattgtatccatgttgtctctaataaaggattttgtatgtttggtagtatgtactttgatgttaaatttaagtttgctttcacagttgcatcttttagtgataatgaatttcagcggaacattgaaaaatagataaatctatacactgcctacagctgtgtttatttcttctgcattgccttttatttctagatacactactaggtggacttcacattattagaaactaggtctcttatttgggaaatttcagaccaactttttgctgattgatgtttattgctttttgttttggcatgaaagggtttgaagactgggatgtattatctgcgatcacatgctgcagctgatgctatcaagtttactgttgatacctctatgctccatgtaataagaattcattgtcatcaatcttccttattcatgtaattacacattttgatattatgtttctattgagagtgcaggaaaaacctaaggcagaggaagaggatgataataccaagatggcacagatggtgtgctctttaacaaaccgagaagagtgcttggcttgtggaagttgaaagcattccaagttgcattttcccggattgattttgggcctaaaaacccttaagtgcaagcctcaaaattttgttttaggcattaatgatatgtttcaactcatacatgacaatcttaagcattctaaattatctttagagctttgtatagtacttaatggtgttaatttcatttgtacctgtttatgtattatatgttaaatagttgaaagatgtcatattggtagcctgtcaagtgtccagtgagattctttatttcctacatttaaatgttaaaattttcatccagtatgttaattatgttatggactaaaaaaaatatactacatttattaaaatagttaacatctcattaaaattttagagaccaaaatgggatgaaatattttggaaggatcaattatttagttttttttatttatttatcaattttaacttttttttatcgtaattaaaatcaataactcaataaaaaggataaaattataacaaaaaagagataaaaaggctaaaaagctaaaatgaatgaggcaattaaactgaaaaaagtatataaatcaatatttattttacctatttaatttgatatattatgagtatcataaatttctctctagaagaatttgataaatcatatattattaaatttttgcgatttgattgaccaatataatattttaagaaatttcaaaccttaatacattgaaattaaatacttataatataagtatttaaaactaatatagtaaaccattcaaaatatatgttttattttactttttaaatgctaagaggatttaagtttgagttagttagcaattatttgtaaataggaatgttaaaaaatagagcttgagtttgtaaaggaaagggcatgaatgatgttccgcctcaagttaaaatttgacacctgtcaatattttaaaatttattttctttttcaaacgtaccctttctacagcatcagcacgccgatgcctcttcatttcacattgcctgaagaatgaagaagtcgttgacaacacacattctccgaggcgctacttcgcccatttattcaccgtctccggcatctccactacattgcttacggtaccgtgaactacaccatgctcgtgaccgcgtcgccgctcgcatcgtacgtccagttctaatagatgattttggaaaacattgtgatacgcgaagggctcaggacccacgtcactgcgagcttcgcgacgggattcgtggcggcgaacccgatggacatgatcaagacgagggtaacatggcactttataaggggtttccgattgagttatgctaactcaaaatcgtccccagatgttcttgtaccaaaattggtttttgacttttgggtaaataaatggtcgtaagttgtaaccttttttgagttcggtgaagataaaaatggtcaaagtttagatcttttctacttgagagtggtgatgagtagggaactgaaagcatgaattgtagtattttttttacatagatctaaataaatggaatttctaccagaaaaatgtgactctttgtggagcttctagcaggttcaacaatggttctgtttaatattttcttacaataaacccagttcaacaatggcaaacaagtgcagcgtttgtgttgtgagatactgagatctgcatctaagcacgatgacatgattgttgagcaatgttccgcaaaagaagagtacaaagagggtaaatttagaaaaacaatgaaactttaacgaggaggtcgacgatgttcaaaataaaaagtatatacatttttcgaaatgaaaaacatacgcgtgctcttgtctagtccaggcaacagcaactgtcctatgtccagaagaggtcgagatgatgtcacacgcttccttaaaattattaaaaggagaaaaaaaaaacaatgaaaatgatgagaaaacacgttctccgttccagatcgaacaacactgaatactcacctttgggcgaggctgaacgcgccggcaacattggaacatcaaaataaaccgatcatacccattttcacaactatgctccatagtccataaaacacctgaactttttttttttcaacgttccaagagtctaagaatccaattcacatttttattcttttttcttttcttatcacgcaagtgttctgtaaattttttttcttatgttaaatatataattaattataaaagttatcaataatataatattacaattcattttaaagaagttgttattttttaactactttaaaaaaaggttataactaaatacaacctaaactaagtgaaaatttataatctagataaacttatattaaaaaaatttcaacaaaattgtattttttcacaacaacttatatattaatatacttttatgtaaaatattttatatgcgtatgataccttttatactataatttaaatatttgtaaatttcagatagacattaatatgctttgacataaaatatttatttttgtgtgacacatttttctctatgttatttttatgatttccatattaatgagttttcatgtaattttttttacataatgtaagtattttatctaagtcttaatatatttgcatgtaataaatttaactccaatatagaatatatttaattcttatgatttgtatattaacaactttcttacatagtttctatcttcatgaaatacagatatttatcatattattgcattttgatcctgtattcttttggtaaataccacatgtatcttttaggaaaataattatttagtttagttcatttcaaatttaatattacatctaatttaaacttcatattatttttatatttgatttaaatgacttataaaaccctttttggtgaatacactttttacataaaaaccaaaccaaattaaaattaaattaattgtaattgagagaggcccccattttaaggtgaaaaaaggaaaaagataaagaaagactagaaaaataatggagacacaatgtgatatgtaatatgacgataaatgaaaagagatagaagaaaaagagtgagtgaaattgagttgtaaaataatggaataacctatatttataatcactagtatattaagcaacacttttagcacggagttgaaaaactagaacactacttaaaataataatttaagaaacagtgcaaattactaaagtaaatttcacttaaactttttaagtaataaaatgaacttgcaattaaccgaaaaatattctcaaacatcttttgtcaactgtaacatcttttactcttatttcagtgtcgtgttgtttctttcacaaattgataactaataccgcgtatcgtttcacaacacgacaattgatagtgtttgatagcacaactcaacggcttcttgcatgggataccccaaatgggtatgcacggtgcgaacaccacagtttctgaatggactctatcgtgtgtgtgtaaattataccgttagatcttaagatacatgtggaatttccgtagaactatcacactagattttttctctctctctctcttactttttaccacttctttttttctccctctgtctccaccacccttcatcttcctcaaaagagacccacgacagaaagttttgtgcgcgacccaacgtcgtcgtcatcatcacacgccacaaatcaaacccacaaatcaaaccatcataactatcacaattaaacatcctaaacatcatctttaatctaaattaattaaaatcaataataaataaatttaacataaattataaaaaataaaaaaaagaaaaatgagaaaaaaaggaaaataaaataaaaaaagaaaaataactctatctatatttatatatatatatatatatatacatgttccaaatcagaataaagaaaaagaactaatgtcagatgttatgttacaaattaattataaaaaatcaactatttttatacgataaactatcacaagttactcagatcaaaatgggaaaccagatctaattatgccatggacagaatgaagttttatttttaaaaataaaataaagaataaaagagaataaaaaacacaagctccatgctctttgtggtggtggtgcggtgtagtactgtagttgactcttgactgttagtgggatggagagagaaggaaacagaaaagtaataaaaaaacaaaaaagattctatcactggtatcccattgatagtctctcagttattttaaccattaaatataaaatatactcatctaacgattctaattaatttcgcaccgtgctcgcacgatgcataccatataaggggtacgcacctcataccgcgttatgttatgtgtttgtcgtttgacctaagcaagcgttgacagaaaacttttgttgcctaatctagcttcttctattctagattggaatagtccaacactgagtcaaattgaacaataaatacaattataataccacttttaaaatactatctattagcactattcaaattccacaccaagtcggcaaaattataatagcatattattatttaattatttcttaatccttttcccctttcattatactttttaggaaccgaggctgtagcattttttcttcaatacaatatttttattatgaattaaaatcattcaaaattcattgaataatagatctatttagttggaaatcccatacatttttgtctgtgtaaaaattcttcagaccaataataactataatactatgaacaaaattagtatttgattatctgactcagtggactaaaatacccatggtgaggccaaaaaatccattgaataagatgagttttcattttatatccataatcaattttatatgaattttaatttaataataacacaaaaaagatttttccttgctcaatcatcacctaattgtatcttaacattatgttgaatattctactaatttaggatacagttactaacaacaatcatgttttctccaaattattaatgtaaatgcattcttaagaatttgaattttaaattctgacaaattaaaataatatttattttgttattcatgttgatcctattcgattcaaatgattcgaatagaattacatttagtaagaaagaagacttgtgcattagacaaataacaaaaatagtatttagacactaatttacacatttagtctctaaaaagttgtatgagactgtgttgttagttgttacttgttagagctacttgaaaaagctttctgactgataagaaaatagctacttgagaaaagaaaaaagaaagaaaaaaaaacttcgaagtctctgaaaatatagcagattttaaaaacttcgtttgatttacagcctggattattgtctgttgctaggttttttatttttgtatacctctacaaaaatataacgggttttttaatctctgtaagttatattaggtgagccaaaaaaaatctattgtgattttttaatctctacaagcaatataacggtcatgtaaataggttctccttttttgatacatgtaaataggttctctggttctggttgcaatatttatagaggtaaaaaaacggaatatataaaaattaaaagcaaaagccactattttacaaataacataaattaacggatgtataactatatattaaacttaaataatgcaatttacaaagaatacttaaataataagttttaaaaaatatttggcaagttaatgttccaataacattaaaggatagaaaatcattcttaaagactgagtgggtcctggtccctcaccttctccggatttggataaaacgtacggcattttttagcgttccgcaaagtcaatagacgagtttgatttgatttgagtttcatttaaatgtatttttttatcaataaatattaattatgaatttttattaaaaagaaaaatcaaacctgcgagttttcattttattctcctgtttattaactatttgtccaaccttacatctctatttccttttcgttttcctcttctggatttacttaaccaaaagcttttttctaattaatggatgtgtgtttgttatagaaacacgtttaataataaaagagcatcaataaattaatcaaaaaattgaacccacaaaactcgcggatgcaacttgccaatttgatataacaaggacgagaaaaggcacaactttagcgtaagcaacttgcagattcatctcatccttactgaaccaaattgggtggcaaatacagtaaagtataatggctccaatttagatactatagaaaataacgccacttgacgtaattatccatgtgccatttgcgtttcaagtcggctaattaatttaattaatctcataatatttaattgcacaagtatattttattcgagttcattttgaataagatagaattatttggagtgataaaactcatttttcaatcatttaacacaaccacatatttatgattataagttgagctgaaataatctcacactaaattcatatattttgtgttaggaaatctcacgtaatttatcttaatttttgaagtatagtttatatattatcagttgtctattgaacaatttcactttaatgtcaactgattttaaaataacatttaacattccatgatattaaactcgtagttttcagtttggcacaaccataaaaatcttaaatcggatatgataaaattctccatataaacatttaatgtaactagatactcatctcttgttaagcttgtaattaaatatacaattaagatagatcgcatatataaaataaaataatcattgtaattttatgtcggcctttcagtgttgcaacctttttctcagcaccgacctactgtgaaccgtcaagtatgttcactccacacaaacacaaccctagtttcagctttcacacctaaatcctttgacccatcatcactattaatctaaaagctccatgttttgtttgcaatttgcttcgtcaacttgttggtatcacatagctttgtgaaacattaagttacagcagggcatattgcagttcaaaacttgtcctactttttattatcactgttgcatttatttcagatatttagtatttgcctacaagtttgttttttagtttaaacaccgacgagacgactcttcatggtggctataaccaatttgaacttttcttcccttgtctgaaaaaaggttttgtgtgcgtgcgtgtgtgcgtgttggagttggctttttgaaggacgtgcatggtgaagttatatgtgtatgtgaaagatgaagaacgatagagatagagaaaagggtaacgaggttgaccagagttacagactgcatcaatcgttgtcaatgccaacgatgttttctggtctgaacagagagaaggagatgtcagccatgatatctgctttgacccatgtagtttgtggagaagatgagcatcatggtgctgattactctcttcttcatcacaatattgataatactaatagtgcagttgttgctgatgatgattttattgtaacatcaaatatggcttctggttctatgccaccttcttctacttgttcatctcaaggtagcaactctgttctcaagagaagacgggaagatgataatacaagtgatttctcacgtggaggttcattgcctgctatttcaacaagtaagaatcaaattcaataatcatactctaaattctaaaatgacaaaatctatttttttttttttaattttttggtctaagatatgttgatgggtccgggcatgtttaaagagtatgaaaaaaatttattttaatatgcttttctactacgaagtcataaaaaaaaaaaaaaaaaaacaagaattgaaggttaggtaggatcccacaaaatacccacatcttaataaaatatttatataaacatgtttataatgattgaagtttccggcagcggagacacatagtagcacacagcataacatgttacatcatagaaaagtggaaacaaccacctttttttgttttttgacacttttgtttttcttaatgttggattggattagttgcggaaagtttaagcacggtaacaagaagaacggcgaatacagtatacgattacgaatacagaacagagaaggtgaaagtagtggaggaagaaccgaggagaaaatacagaggagtgagacagaggccatggggaaaatgggctgcggaaataagagaccctttcaaagctactagggtgtggttaggaacatttgaaaccgctgaggacgcagccagagcgtacgatcaagcttcgttgcgtttcagaggcaacaaagccaaactcaacttccctgaaaacgttagtctcagacaacaacaacaacctccgttgaacttgaacccagcaccacctaatcatggggctattttgtcaattccttcgaccactgtgcacactgaggctcttcagggttcacgtggttcaagcaatttttatgagcattcttattcgcatcttcatgagtttcccgtgagtctctacgatcagattgcagtgtcaacatctactactatggcttctcatcatcttcaatttttgccgtcggcttcttcttcaactatgactatgacatctccgcaggcaccaccttcgatttatcctacgcatctaccggcatggtcttctggttgtagttataatagctcttcttctccttcggggtgatgtaaattgcattatatttcaaaagtctctcttttatgccccttgtattgtatcattgttactctcctctgttttttgcatttgcaccacgaccatttccatccaggagtggttttttgtgaccatgttattatgatcacgcaaaacaaataattcacagtttagtatctgtgtataatagagttttatttatccttccttcacgtttctccctccattaaataaatcttatatctccttctaacagttttaccactttagtatttgtgtgtagtagagttttatttatcctccatttgagacaattataatcgagtagaataaagatgattatggatcacaaaaatttctcttccaatggttaacatgtatattagagtttaagacttaatttagataaatttgtttttataaaattaattttgactaggagtaaatttgactgaataaattaatgtttgaaaatatattcatttgaaaagtaatggacataattaatgttatttgaatagcgttagtaaaattcactttggaaaaggatataatgaaaatgatgaggcataatatatctcacgagggtctgactttccttaacgcgttgcgagccgccttataacaaacaaaatattgagccacagtctgaaaaagtaataggcttaggttgaccatcatgttgttgccaagaacttgacggcatgtttttgaatgaaaggaaaggaaatatgaaagagagtaattagataattatatattttttattatttgattggagagaagaagttggagaaaaatgttgacttatagaaacaaatttatttatttttttcttattttcttctcaattcaaattttaaaattttctctccacttctattttctttccttcaacccaaactgaggataagttcaaaataaataaaaaatacatacacaacaaagaaaaaccaaatttgcaagtttttataaaagaagtaaaggaacatatactatgtttggatgagtcttatcttcgattactcgatatttttttatagaaaaaagaaagacacaagttatagatcccacaaaatgtatctttttctctcctataaaaaatatccaataaataaagaagatctttattcatcttgtttagatatttggttagtaagtttgacatacttttatctcactaaactcaatttgtcattatatttggttgcctctaaaaatactttttatacctatgtttgacactaagctgaatttaccttggaaacaacatatgaattgcttttaaaaatttatttttgttgttgaaagtatttatccaacagtaacatttaataaaaataattttaattagtactacttttatcagtataaatcacatcataataaacactccttttcatcaaactcgagttaccatcatatttaattcaaacttatatttacaaactttaatctaaatagtcagtatttttatttacactttaataacaaaacagtcaaagtttaatttgttttttatttttaaagttctgcataagaaacagaaaaaaaacaaaaaaaattatttttatgtacaaatatttaaaaataagaaacattgaaaacaaatactccatctagtcttaaatataaaaaagaaaaaaaagcatcttttttttaatctcaaatagaagaaaatttaaattaattttacctcatataattctattatttataattgaaaaccttagttagcatgacatattttttttcttatatatttaagactggaaggaataacagttttataacttaaaaatataaacaaaatgaaaaaaaaaaatagatatcacaagtaaacgcccttagatccgcaagtttctagaaaagaagcaactgacatactctggagtgaagttctataaaagcctttctatttaattatgacttccgtctgaacaaagcaatttcaatgtttgactttgaagtatctttcaagcgaggcattgaggcaaactcaccagatgttcagaaaaatttatatcagtgacgtgcgaaacaccagagaaatatagctttgtacgcaacttctggtagttgtgcaataaatttgctactcaggaccgtcaatcaaaaagactagaatgtctccataataatttgataattacgtttaccttaaggattatctcattttgatctttgcaaataaactttagagatatcttttacataaaattatttacattagattttatttcaataaccatctttatccccactgatatttgcatagtcttcaaccactaaaatggatgcattatggtacatgaaggccacaataacaatcgtttatcaaaatacagacatacttggccgaaaagattaaggttacgtctccaaatattttggaaaaaaacatctcagttcagttatacttctttaggtgattgatgagttcattagggaaaataataagatgtctataggaattaaggggggattagaaacttgtataatatccattttaagaaattctcaaataaggcgaaagttcactttaagtgaaccccaaatcattgacgtagccttcggcaacctcacatcattgcactcaaataaatagatgctttgcttgcagctagcaaattgtcattcagggaaaataacgacgtccaaatttcacaaaaaaatgtaatagaggaagaaaaaaaagatacgagaggaaaaacatcaaccaggcaaaagaatataaatgagcgaacactcaatttctagctactgctccaatcaagatcttttaggatcctgtcataagtcagtggtaaggtatgtaccagtggtatacaacaatgctactttcggtactaagatgcatatatccagctctaccctgaacgcatgagtgacagaatattaaaaagaaaaagcgataatcgtttagcgaaattcctcaccaactcagtcagtgacggttcaaaagaacattcctgaaaaggtaacttgggtacaaaatcacatcaatattgagatgcccctgcaattaccagaaacaagcattatgacaaatacttgagatgagaacaccaacagtcacgattctaccattttccataaaccagacttcccttcccgtgtccccaacgccctcttaaaacaacagaaataagaaaaatgtgagaggggcagcagagggaaaagggacaaaaactttacctgtgacagtatacgaaccttcttaaaccttcaaagcagctttatggaccatggtttccttatgtatttgatgacaactcttctccacaagatcaagcaatttctccaagtttgctgcccatgagttaagaatatcattgctatcctttgctgtttggaaacagactattcccattggcctatcaatctttgccaccagcgccttagacacaaccatatctgagagatgcttctcagcatcctgaattttatacaagtattaattaggataatcaaacaaagaaataacattttaagaaaatgaaataaattccgttgcaacatccatattcacatgcagctcaacaataaacaaaataaaccacttgaagtggtaagtgaactccagcagcaaaccagcataaaaagaccctgccaacccccaagatcatatattttctttgtaacactagtatccactggcagactaggtgtgctcacgcaccacttaaaaaatattacctcggtaacacttaagagacttaaaagcagacaaccacaaccagaataaatcacaaacctgtatactgaggcacaaaagctctgcaagtctcttcaatgtaattcttgcatagtattttgatacaacaagaatattctgaaaggtaacaaaaatgttccatattaatgttcacaaaaagaagtataaaacataaagcatatcatacaatacaataccaaccaacaaaattgatgggtgagaagaaatataatggcatcagttatttacgtgttcaattattctttgcctcagatcttctgctgctttttcacccaaagatttcccagaggccttctcattctcaaaatcactcttatatgtatcccatagagttgtccattggataacctccatggtaaccagctgtttcaaaagtagcctaggcacaacatgtaacaggtacaccaaatgacaaggaaccctaagaaaatgaacgtgagttggaaaacatgagataaaaggtaggataacatacttgaagtttggaatctcagagagattcttatcctccaaggtggaattgagaaggcttgactgcatcggatcgtagggcgctagaaccaagtaccaacatattttccttaggatctacatgtaaaagataatattcagaaaaacacaatatcacataacacagaatctcacaataacagaaaaaaagagaaggcttactggaatccacttggcagggtcttctttgacagatggaatctcatatattgccttgtagcatcggcaaatttcaagataatcattgttatgggaataataccttgaaacataaacagaaagcagcataagactacaaagattttaaaatcagtagcataaaataagtagttgaaaaatatgtagcatgaaggtacaaaaaacaaacactcatctacatcacttcatatcactgaagtctgaaagtgatatagaagcattgcaccaaatttggaaagctgtgggcaatttgctggtacaatctaataaactatgacaatttccatacactttattattgtcaaattttataagtcgttcctcaaacacacaattgatatataaagcactgaacatatcacacacaataactctgcctggggtatcatagccggtcccaagcccaggtaaacaaggaaggttgtgttaagccagtggcagtcaaggaaaaagttgttttagtgctttcctcatgcatgttttaattaggctagggaaaaagtttattttaataattgattataactacgatcaattattctaataatcatttacataaacaagtttaatgtttggatatgtttgtatttgaaataatcaaataatataggaaaacaaaagtagcaattaaaattttggcaatctgcaagtctatcgaattataaattcattgcaaattaatacccatgtaaagtcatgtgctttacctccactctctttcatttatactttgatatttagtaataaggctgatttaacccttcaacaaattatttttctttccaaaccatcaaacagagaataaaatataaatacttgacaatagtagagaaggccatgtacttcaatctgcattatatcttttagtcttgctaattggtgccctcagggggcactagttaaggaattgaaaggggaaatgttttattggaaatcatatgggagtgtatttaaaactcataagggagcacatttttccgcatctcaataaaagcatttctccctttactcccttaaccagtgcccttgtttcctcttttaataccattgaaacaaatcaacaagaatggccaacaaaatttatttccattgatatagttaaaaaggacaacacaaagctttactaatatacacccaaatgtatttaagcaaaccagaacaaatgcaagcaagagagattaacagagagtgaacacattgcaggaagacagtcattggaaatgtgccttgttcttgggcatctcaaatgcacaaattggaatgactagcaacgtttagagaagcccaaagccagaataattttcaccatttacttgacattgacttatctcaaataaaatggaaagagatactaaatatacaaggttaaggcacaatatttgcaactatatcatgatagaacaagaagggaaaaaaagcaacatgaactacatattcaattaccgaatcattagttcgtaatatatctgcttcaactccagcaaagatggtatatctgcaggggcctcttctacaacattatcaccttctttaggctttttcttttccttagataaatcggcatcaaatactcttgggctaatctttcttgagagtatttgtgcacgaacataatcctggcggtctagacataaacgaacctacacaatttgacatggaagattctgaaatcagcaactgaattgcaacacaagaaattaatggcctgctattgctgtcatcacagtaacacaaaaatattccatacttgttcgagaataaatgcaattttctcagtcttggccatggcaccaaaagtttccacctgttaagattacccattccataagtaaactgaatactaattaaagtatagaagccaacaaaacatgtgacacattcacactgaccgcaatttcttgcatcaaatcagcagcttcagctataagcccttgttcttccttaatctttgcaagtttcttgatcaatctagctctctcaatttccacgtatatctaataaatgatataaacatataaatcatatataatcacataatggaaaactataaaacaaacaaaaagttcaaacataggacacccaccttccctgcagacacactattcaatgttttgatgagttctatgcgagtttcgatatctggtgtctcatcaatatattgcatagcttgttgcaccatagctgttacagcctgcaaacatataataagctcattaataacagacaacagcaccttgtgcccttttacagaaacaattagataacatctgaactaaactcctatcgataaaggagatctacaagtgtcttttacatatctcttatcaattgcagaacacagaaaatggcagaaagccaataatctgctatatcatcatatagtggataactttgtgggcaaataatggataaaagttggcataatactaacttagatagcctactcgcacatgcccgcaaccatggcacccatagtggccgcagtagcagacagagtcgtgatagctgatctgaggatctccgcaatgcaatggcacaattgcgccgctatagcggctatttagcaacactaacttagatagcctactcgcacggaactctacgtggtagagaatcaacattctcacggccctaacatgctaattttgctgtctaagcaaaaattgagtcaaataataaactgttttccattctaaatgaacaaacaagtacggctacaattttttcaaagagaactaaaaccctaaacctcctcacgcaaaactccacagagcacttcacgcaaccacacatgaaattaaaatagaaaataataataatcgtaacgcagggagtacctgtttgagctggccacgtcgttttgacagaacgacaatctggtcattgagggttttccaggctcgtgcatcgaagcagagctgcaaaatatcggtagccgcctttctggtacctgccacgtcaccggcgagcctcatctgcttctccacgttcagcaattgctctatcgccacgtctaaattccccgtattcgcctacaaataaaaaatacacaggaaccgtcagttacagtgaccacaatcatcaaaattcagttcaggaaaaaaaaaaaaaacaaccctagagtcgttgaagggaaaaagaaaaaagaaaaaagcaactactagtagaaaaaattgacggtggaagtgagtagataaaagtaaaaaagagagatctgtaatgggttcgatccatcgatgaattgagtaaaactgaaaggggtaaggagagtgaagagagagggtaccatggctggattgtgggcgagagagagagatctccgaaggagtcgtgaaattattggaaattgaaagtggaaggaaggaaaggtcaaagaggtgagaagagaaggacgcagaatttcatagacactctttttatagtcctcaggcccaccaaggcccaacaacgatcttaattgcctggcccgatccgcctcttatgtttctgtaggtaagccacaaacctctgtactcacaaacacacttcaattttttcagaagaaaaatgtgtacttgacaaaatttcatatgcatttttaagaaaacaatgtgactaagttggaaataaaagaacttttgagttgagaaagttggtaggtttaaaggcaatatacctcttgttgttatggatggactaatgcttggaatgtttttttattattactgaaaggtggcaaaaacaccttacacaaaaagaaaatgacggaaagaaactctcataaaattttgttaaagcaagtgtctacacactccaagtggatcaaaaaaactaaatgtaatccctgataaagaatgtgaccaaattgcaaacaaaatagttgtttggatttgcctctcagtgaacatgagaaactctaacattccaacttctttgaatcaagttcatcctagttggagattctacattgcctagtgataaggccaaaatagtgtatataaacaggggaaactctcaccttaaattggatttgtagtgttgagttggatttataactcatattctaatatggtaacaaagtttattctaatgatttgttattgagtttattgtattactcgttttcaaatcacccacatatgtttaatcttgtaaatttacacttgagatgttcattcttcccatgtgaggtgtgtgtgttagatatctaacatcacttagtggtttttaggattgaagtaggcccataatccaagttttaaccaagatttcaaaattgatggtcaagtgatcatgattgctttttaaagcaaaagatcttgcttcaaataagttggccataattttctttcttttggtggaaacaaagttcgccataggtgaacaacaagttttttatttggatcatgaaagtaaaccatttattaacaaattgttcctttaggtaagaccaaatgttcaataataacctaaggtttggaatctttgacgagcttttacaaattaattcaatgtgtttctactaataaaaaattgtttacaatttatctaaaaaataattaatatgatgatattatgttacatatgatttagaatttttttaaaaaataaaacataaataaataaataaataatagataatttttatatatagataaataatagattctcagtaacaaatttgtggatatttatgaataaaaaaaatgaattaaaagattaatatttatagataacttttgaagaaaccaaaaaatataaacttgtctttaaccactagtaaaattggcatcagatgaaaatcatttacaagaaaaaacaatttgaaatcactgaacaaatttcgtaatcccactaacaaccatgttttttgatacatagattaaacataacttgtgttaactttacaaagactatattctatcttgttaactattttgttcttatatttatatctttattatatggtttataataacagattttttctctactcttacaatacttgactattttatattagacactacaaaattttattatatttcttttgtttatacaatttactgcttacatatatatatatatatatatatatatatatatattatatgcgtatgaaagtcagcgcacggtaccaacactagttttaaaataaaactagtactttttccgtctctctgcctccctctctgccctcacttcttcccctttaccccacgccacgctcgcgagtaagaggacttgctacttcaattcaagggttccacaaacaacaacaagccttttttttccccctctttttcatgtttaaacaatgaaaagcaagctcagacgatattattcactctgactccgagctatacaccaccgagaccgagtagtgctatcactttcatttcacttttctcctccctattcccacaagcgatccttcgcgacgcataattcccaaactcgcgcttaatcactttgagggcaaacaaaccctcgaatttgaaaaaaaatgaggtttaacgagagcgctatgaattggattggcgctacggttggtggcctcatgggcacagtgggtgcaatattggcattgaaagatgtcaaagtggcgattccatttaccttcgctgcagacaatagtagcttcgagaattcgctctttgttccgggcttgcaaaacctccaaaacaattgtttcctcaacgttgttttgcaggtaataaggcttcgctgtttgttgcttctctcctctttcttcaattgccaaatgaatattttgttatttctttgttgcaggctctagccagctgtttttgctttcagagttttcttcacagtgtgatgggagagtgcgggagtaaggacctggatgaaaacatgcctcttgcacttactttggctactttgctagaaggtagttgaagtagaaccttattgagggtctttttggacatttttttttcaataagtccggtttgtttaaactcttatttattaagaaaaagcgcttattttaataaaataaagagtcttttattttcttagtatgtttgtcttttattttctatttgtttttagaagcaaatcctgcatattaaacacacttttttaaatgggccttattttgaaactgttttttttttttttaagtttaaataaactgacccaaaataagttaaaacaaggtaaaatgaaataagcttcttccctaagttaaaattagcttatacatgagttaatttgtagatgttctcatttagcttctccagaagctgattataacttaaatgcattagctaatgtttacctcaagggagaatattaatttattttactttttttttcctataaattgctttttgaaaagttatccaaacagggcccgtgtatgtttctttgattgtgaatcattcatgttttacgtttgaaatctttgatggaatgtttctttatgtatgtgcagagctgagttctgttagtgcagaaagggttacactgagtcctcgaaagatgatgcttgcgatgtccaattacattccaaattttaatctaactagccagcaggtagaattgcgtgtgtcttatgattgatttagtggctgagttatgttttagttttgtgtcttgttcatgcttgttcttttgtttattgaaggatgcagctgaagcatttctccatctgttatgcttattgagagaagaatttggaggttgttatgctccaaagatgagttctttagcagacatttttgcttctaataatagaattcttactccaatacagagggactggcaaagtgagcaggagagatggcagcaactcttccttggaccttttgatgggattcttggcagccacttgacctgtcaaagttgttcatccctggtacatgggtcttttctcaatgccttatgatacacttttccccgttaattgcacatacacaccattgtcattgtttgcaatattagactggcttttttaaaaactatgacttaacagttatgtatctctgactgagttgcattatgtttgaaatcattctatagctggctagtggctactaggagctaggctatggtttagagacatgtttttgttgacttgatgttttattttgaagctgttgcatttggagggaaaaggagtgtagggtaacattacggtcacttggtaaaacttctaggaagaaataaatttagtaatttcaaaatggtcagcaatgaagaaaaatataggaattgaggttataggatggtatgatttgggttttagaagctaagaaaataaagtaaattttggttctgttctatgtgacttttgattttcatacatttagtgttcacatgttgataaatttaatgatggtaataatataaaggataaattttgaggtcacgttggctgactcagctcagtagttcacattctcaagctactttgacaagacttattagcaggttactggaatgactaaagccaattcaattactccaaacttgcaatctaagttattgatgatctgatagtgtactttctggctgcagatttagttgttgattacaatttagcttagcataaatatttatttttgttttttaaaataacttccctctatcattattcttaatgtaactatgataatgtccctttgtaacagtcatttattatatttttaactttatatttattcagtgcagatctcgattaactttgaacattttgattgtttgcctctttcacctgtgcttagtgataattccacaatagtaagttttaaaactaatttcactcatactgtagcttcaatgttatttcttttataatagaagtgctgcactcctcctgtagctccctgattattaaatgtgacactggcatatttcagggagttggttgtaccctggtggattgcctgaagcagttcactgttgctgaacatgttgaaaattatcactgcagccactgttggcataatgccgcaatcaagtatctttctataatggaaggaaatgaggtcatccctgtgtgaatatttcattcatttagagataaataaaggcagtttagagatgcatagttggtggttgcgaaatctggcaattattctttatgttgtccaatatgatttctgtgctttactcaggtagaactcaaaaagataaggagatgctctgacccagaaatctgcaattgccgaaaaatgtataatcttgataaactaccctggtcaaacaggttttcacatactctgaagcagctaagtattgcaaggtgcccaagggtatgcatactgtgttttctgatctgacatttatcatttcctcaactagcttttcttttgtagttcaatgtctgaactactaaaacgtgattgtctggttgcagattttatgcatccaattgaaaagagtttatatgaatgtctttggagagctagtcaaactgcaggtacttgaatctctaacgtattggatctgtctcagcttttgtcccaccccctcccaaaaggaaaagaaaagttccccagacataatgccaaactgattgttcttttaattaggatgtaaacttgactattattatagattggctgaacttgaacaaaagacggtaataattgagtagcatataaatattcattaaatttcatggtagaatttcgttctgatgatggtaatgcagggccatatttcttttccattgattttggatgtgctgtcattcatgacaactagactgggagtgaagacacaggaaatggatgtacaaagtttgccattaaatttgaagtataacagaagaaatattttcccaaatcattctgatctggaatctgagataagtacattgaaattttgtggcctttatggagcaacgagagagcagatcaattcagatggtgtcattgatgatggatttgtctcctctacaaatggacaggcactttataatgacactgtatctccctgctctggttcttcagaaagcattcactcagatacatatatgcaatcaattgaccaggttggtttaatttttttgatattgatgcatttattttgcactgaactttgaaatcccatatccttgcatcttgtgtctgtccataatatgccccctttaaagaagcttcacgtatctgtccatccataaatcttattcgtcaagtataaactagaattttctttcatctaggtaaatttctttcatgtcacagatccaaacaagatttttcaccacaagccatttgtttagattgtgctaaaatcaaactcaaaagcattctactaattaattgtgaggataatactactaatatggatgcctttgttttagattggacccttgatatatcccttgtatttctcccctgtggctatgcccaatacttgttgtgatgcttgtggaactgaaatgaattaaacggtattttttggtgggatagtcttaatcttaaaaatggaaagatgattaatgtgatattgacttcgtggtggaggtgctttcatattctcactatgttgtgctttgtgcaggtagatgtttcttgtagttcagttcctcaagaaacatgtttgtatcaacttgtttctgttgtggaacactttggaaaagctggaagtgggcattacactgtttacagatctgtaagagtggagtcttcagaagacgtctctgatgacttcctcaatcaaactccaatgcgttggttttgtatttcagattctcaagtgcatgctgtttcaggggaagatgttctttccagtgaggccagcttgcttttctatgagagaattccaaggaactgaaaaaattcctttattttgttttgggaagttctgggttcacaagatgcattggttgattgttctgaatcacaggagtctatgtttgtggcgttttaactcaccacaagtgatataaggaagtgctaaggttgtttcaaattgctaaacaaccttttggggagactaattataatgaaagaaaattaactacttggaatggatattcggttgtttttgtatactcagctaatcaattttgttcccttttgtggttacgccaatcaaataatttttaggtacaaaaagacggattatctcaatttctcaaccgctacagttgcagcagaaagcactaacttatgctaagggttattgaacgggagccatgcgtttggaatgtcgttttcagtataggagttactgagaataagttgatcatactgtccaaaggaaatttcaatgataaacaacttctgaccaattactgcataactgcatggcattaagtatatgtttgaatttcagttaagaatatcatagcaacattttctttctttattttatgtattggaattcaaaattatatattggaattcacaaaaatattttcaaaactgatattttttctgcttttgttttcattttcaagaaatccaattgaattttatttttcatttttgtcgtgttcaaccttttagttatgtcatgtcaaatcaatttaaatatatgaaagataacaaatgatctaacgaaaatattaatataaaatatattgaaatgtattcattctaatttattgtcaattagagagttcacataatattaggatggatagtttaataaatacatttacctgttatttatattaaaacaaaatattcgattttctttcttattttatgccttatgaattttacttaaaggagaatgaatattatactacaagcttcatgtgaaaacgtgtatgaaatataattctaaagtagtcaataattatattttttaccaattgtgtgttgtaattgataatattcttatacttaaaaacgactaatggtctatttacaaataaataactcttttataagaagcatgcatgcttttatatatatatatatatatatatatatatatatatatatattatgtttcattagaatagctttgtaatcacattttttgttaatttgatttttttttgaaatatttatatttttaatttaattttaccatgcaacagtgtaaaagtttaaattattattattgctttaaatcagactgatcattgaatggataatattgattcatagttcattagtttactcatagtagaattgaaaaaagttaaatataattttaatacgatacaatatattaaataataaattaatataaaaataattataagaaaaatgaattaattaaattttaaatagttgtaaaaggaatcacatttttttgagataaataaaatgttaagagaagatatctggtttaatatggggagatatatagacataatttgaataattttaaaagttcttttataactaggatgttatgctgtaggttgcaatggagtatatgtacgtatgtaaatataagtttgtataagtgtcactattctgaaatttcaatagagatctcgcagagtactgtactcatgcatattttaatttgtctcttggtatctttaatatatgctatccataccctattctttcgtgtaggaaagatatggagtgattttcttaccgtgtatcctagattattacaacgctataaaattgcgagaaattgaataatatatggaacaatttcctaagcatataaaataaattgtggtacaaaatttatccatcaattcaaattgtggatcggtggcttccttctggctggagtgtaatccattgagaacacttcgtttgcattatctttaccttcttttggcttaaatacgtgatcatgcgtttcactatgatgagctgtactagcatcactactagtgctatccatattgcttttttctttcagtattcctgctgcacgtacaaataatgataacataaaacaaattaattttatataacaaaaattaaaaagtggaataacatgagagagatctcaaatccaatatgtgactatgatgatatatgatctatatgacaaaatacaagaattaatatatacctctatcagggatagatatgaagtagaagaagaaagccacaagtagaatgcgtttgtttagcacaaccatcttaaataatttgattaattgtgctctatgacaagatatttgatgatctgaatatatacacaatatacaactccatttgtgacccataaatagacatatagatttagtttgcttgtagttgtaggaagttgccaagaagattataatttagtatggatcatggtggtagtttgtacattagagaaatggtctacgagggtcacatcattgtctgctgatgtctagattgaaaagatgggtatgtgtttttggggaaagtcttgaaagaaaaaaagtagaaatccatgacattcataactgtcaacctctacaataatatacgtgtatttgggccataccagttttctttataatatattgtcaactgcttcctgtaggacctgtacactatatcaggcctaggttcttgtcaaataactaccaataaaatatatcaattaaaccttaaggtcctttccgtagaatgaaaaaaataatatgaaaatgaattaaattaaaatagatataaaaatgtaggttctatcttatttattgtttatttacaattgaagggacccttaatatgctgtttaatttctaatatgtcaattaactcttgatatttctcatcacattcttctgtacatatatatagactcacccacaataaaaagaaatagaaatagaacaattcaacagatagtttcgactgtcgagtttcgagactaattaacctaatgccttgaagctttgaaattgaataataacacgagataataaaaagttctgccttttggtcttgggggctttgcatgaaaaaaataaaaataaaaataaaataagaaagagaaggagataattatatatagtatatagtatcatatgtaccacacgtcaatttttatgtttagtaacgaaactgatccaacaagcagcatactaaaattttccatgtacgcgtagtttaaatagtatttttagaatatcatactctagctgcagagttttgatttctcaagctcctctattttccgtatgtgtacgtacgagtccataaaattttgagttgcgttaacaaacagaataattaatggctagttgagaaagccacccacctctaaattaactaccagaatcataatacggcctcagtgattcgtatcaaattatcaatatctaacaggaatttggttgaggaaatactgtctgcatgtcatcttgatcttgcccattaaattgtgtctgagtgtacgggcaaaataattgtgaacactcaaatttatttgaatacttgtttcattatccttgaaaaaaattataaaaagcatccctattcttttatataaaattaaaaaaggattgagaggaaattattttgagctttaaccccccttgaattgagtacaattaacctcggttcaaattaatgcacacaatgtagtcctttattaacttaaggctactttcatagatctttggcttaattaagcttcctagtgaagcaacacaaagattaaaaatgtctcatcagatgtgtcatttctcaagaaacataatagagaattcatcagtttgttgcagtcacatctcattgaaactaaagagtcaaacacatcccatgatcatcaattttgcacatagatcacaatcatattagagctcctcgattcctatactgaaacctagctaatttttgcttaggaaactatatacctcaagtagaagtatatcttggacccccaactctcttcaagacatgcatgtatattatataaacaacaatataatgtccagtttatttaaatttatttattgaagtaaatatttattttaataaaataagtaatattttgtttcttaatatatttgactaaactgtttctacttaaaaaaaataatattttgcttattttaagaaataaattctatttgtttctttaaaaaaagtttattttaaaattattttttaaaaagttaaataaactcacccaatattactctccttttaaagttatatgtaaaccacctcaaaattttactaattcaatcatggaataatatgtggatgccacatcctcagttgctggaatctccaactctcccccatgagcttgcaatttgaagccacataatgaaccatctataccattatgcgagcaggagacaagtccctcaacctctgacatgctgggcaccctctatcttaggttacgatgaatgcaacaattcacgaacttgtaatccatcttcatgatgatgcgagtagctaggaaataagctttccaacctgctccttatgagcaccctctatctctacccacaatgcaacgggaatagtatcacagtagctaggcaattttattctctttattgtaattgagaactgagttgaataattcaaatttcatgttgatgttttctttttccaaattctttttttttatcatatgttttgctagacctaatatgaaggtgatctttttgaactcttatattcgatttcgtatatttcatatttttcttacaaaaaataaaagaagctaagaaattaccccaccaaattgttatttttgtattgcaacataaataaataataaaaaaatatagaatataaggtttgttttgtatgtggaaaaaggttagacgacgttgagttttggataataaattatgttagtgtgagatagttgaacatccttaattaatcttatacttttttaagtaaataatctaataaattatactttctaaaaagttctaataaattttgagtggtcttatttgattataaatttttgtcttattttatacataattaattgggcctttgctatccaaacggttcgacattcattcccaagcggaccttactcggcttagaaggtctaaaagacattttaaacaaatctttatatttttacatttagttctaaaaaaaatttaatttaggtgagatattttcttagccttgtagtttaattaggattatgggagttgtaactatttgattatccaaaatttattttaaatattttcttataattgatcgattttatgtaaaaatgattagtttaggtttggcgccttattaatcatataatttgatttgagatatttgaattgtgacaatttgagtatctagattttattgaaatgggtaatttaggcgcgttgcactaaaaatatattttttctaatttttttctttatttttgcttttaaacggggtatgctaactattttaaaaaaaatgttaatattttatgcatttaattctaacttaaaataatcaatcactttaggacgcacgtatgaagagtacttggattaaatatttatttatttattttatgcataaatccactcttaaatctagtttaatttttatagagcaatgtaacgactttctttggggtagtatgtttcgtcaaatccttattttatatatatatatatatatatacatatatatatatatatatatatcacattctatttaatattagaggagtgtttataacagtactgtactatctaacacactttaacttatattttttaataaagaactaattcatcaatatcaaaagtaattaaattaattaattataattaatattatgatcaattaatgcatttacttgtaggaacaggctacggtgtcacctaaattccttgtgttttgtggtcaagttttagatgataaacttcacaattaagaatataaaaataataattaatacatttagaaatgttgactagtctatatttttataattaggataatttactcatttgttttcttataaaggaccagatatatacaatttattaaaattgaattttgatattaacaaaacattttcctacatatataaccttatccgtcccttcgcataaacactcccaccaaccacatacattgtttttagacttcaaatataaaataaattctctaatttttttttcttcatttacatttttgtctaatacccattaacctctctgcttatcagaaaaaattagtaactttgagtaatcgttcaagttttaaaatcattatatttagactatatataagggacacaaaagtgagacatagaagaattaatattcaccattcaatcttactagtagtagacctgtcgactaggtttatgtgtttgcttctttttaactccatggagtcatcctacgtcatactcacatacacgtgcattctataatcatttttggcgtcgttaattatagattaagatcattctttaagctataaaaatttggaaaacagtctagacgttatcaatataagaaaattatattgtctccagctaaaattattatatattatatatatgtacgataaatttattcactttaatttatataaaaattactttaaaatcataacttatcgtatattttgattgattgtgagtgtaaaaaatcttttacactattagttgatagaaactaaggtctaatatttgttaaatatgaagaaacttttaagctctgtaaagttatactgtgtacaacgaagcaaatatatttgttgtaccttttctatatccaataaattttatatgatgatgacaacagacaatagaaataaattataattatgcgccatggtccatatatactccactaactattttatattattaatatttatgtcttaattcttctttatgattaacttaacaaatgtttcagtttattcagaatacactttgcacacacaaaaatacattaaattattagttcatatccaatttttacaaaatattttgacatataaggcatcataattgaattctggaatgagattactcgaaaagagaaacttcatcatgcttagattttgcatatcgatagtgctccttaaaaatattgattatgcttcataataaaagaaaatttatattatttttttctgaaattaatattatcaatcctcctaatcctcttaaagaatttaaataggtatttttattaactctttaatttttttctactaaaaaactgtttacttttttcaagaaattatttcttaactttaaaacagtatatataacttgcatgatatatagcataattaaccgaatccgttcttaatttgttttggatattgatttttatttcatgtttttatgaagtgatataattagttattaaacaaaatataaatcccttaaaaaaataatataaatcatgatataaaattgttctggtacaagcttcctcatttagggttagagtctgtttatccaaatcatttgagtgtgtaatctaatctccttttgcacctggggttttattgcaaatgatagattaaaaatcataccaatatatttgtgattgattgataaattaaaattgttttacattatcaacctatgcatcactattaaattctatattttaactaaagttttaattttatagttacaaacttaccatcactattaaattcttttggtatcatctatattttttgatgttgttttcaacataaaaatacaatataatattattctttcatttacatattatcataatttttcatcaagaaaatttaactggtattttaagaaataataatgttaaaataattttaataatataatataatcttatttaatcatactatgtatgcaatacatgaggacaaacactaattagttattgtcacctatatcatgttcacactaattattctatatgcattacatgaaaacaacctcacacatactctcacacacacacacacatatatatatatatatatatatgtattataattatcattgtgacccttgaatatgactttaaaatgagaaacgcactacatattttccatatgtaattttcattgtaggccttcttaattaacaaataaaacgttcaatctgcattattcgatagctagctagtagcaatcattcaattgtcttggtgttcaagatgttgccaggctcaatttactgtgtagtactgtactatactttgtcatacataacagttttttgtttgttccgattgtattattctcctagagttagattgcacataataggagatttgattaattaatcatggaggatggcaggattcaatgaatggagggagaatacccaacactggtgagactacgatcattttcagataagacaatgggcaatgtttttcatgtttggagaggattaagacaatggacaatgtttttcatgtttggagaggattaagacaatggacaagtgtttgcatatcatggatcacatgggaagagtccattggtcatctactaggtaggcctactctgtcctttaaatattgagcataaaccaaccctgatttggagggctatttaaaggctatgatagacacagtcttgattgagagaatgaaattataagcaaccaagttggctaaggcaaagctacatagcatatttatatgtctaaataggtagcattatatggtgggacaaaactattattagaaagtaaaaaattaaacaacttttgcaaatttgaagagactttctatcttagaatttataatctttggaattagtgtcactttttaatttcaagtttaactagtatggtcactgcaaatgcacttggtagatggggaaaaaattgagcaaaaatttataactcgtaaatctataatataaagtagtttttctaagataaaataaaatatggtagcatcttttattttatccacgttatatgtgaaattatatattaggtaaatcacttaaatataaaataggcttttttattcattttttattataggtcaacttactaacgcaaggcccaattagaaacggaaaagttgcgtcaaactagatttcatgaagtgtgagtttggtctatatttctcaaatctaagacttaagattaatcaacttattgaaaataggcctttaaattgactcgatctgataggttatttaatagtataacttttaaaatataggttaaaaaagttacccttaaatatgttaatgggcctaagcttataatcatgtaagcaagcttaaacctttaaataaatccacaaatatacaatcttaaaatgttacaatataaatttagtacaataataattatattatcatatctcaacatattattattgttggagatccttcatccacataatccaaatacaatatataagtgtgaacaatttttatttctcttaaattaatttttggagttaagttaaacttaaatttaagttttaacatagtataaaagtctattttgagttggtaggatgaggagtgtgttggtgattttacattatgatagaagattaaattaagttcaattctatattattgttgttgtttttattgttattgttattaacttaattaagtaaatagagccttgaaagattttttgaatgactcaaaactcaaatttttctcattaaattgacattaaaaatattagacttaactcatttagggatagtttttttaatcaataaatattaatttattaattttgttaaaaatataagtaaaaaagattggaaccgtgatctttctcttcaattcctttttttccttcatacccttaaatctctctttctccaccatcaaataaaccttttatatctcattttgaggataggattttcgtgacttgacttaattgtaaacctcttatgaacaacctaacttatttttccacatacacttgacataatcattactcaatcaattcaagccgattacattatttcttccaataattaactcgtaataaactgtggcttttaggatcacatatggcgatttaatctcttgaaagatagactataaccacctattggtctagtcaaattgtaactacctgacgtcctaatcctataaagaagaatttcatctcttatgcagatctagttgatgaaagaactaaatataaaagaaataagaaaagaaaaactcgaaagaagagaaaatgaagggaacaaaagtaaaaaaatgtattatttgaattaatagaaataaaaatgatttttttttagtttgttattggaaaagtgaaagaatgaataataaaaagaggctcgaatcggaccacgaaaagcatgacttatgagaaatttaggtaattaagatcattttgacagctccaactgcatgtgaatttatttttttattattattagggaaaaaatattagactatgcatgttggggatccagacagacccattaatatttactcttaattaccaatcgtaccatttattatcattactattagttgccctgcaggtaatttcttaatgaatgggttgttcttttgctccactgctgcaacatcaggtatctttggttaagtgactgattgaagaccttttattcgggaagaatactccgtatagtagcacgaaaacatggtagcctatgataacttattaataacatgtgtcaatgccatatggagtaaaaaaattattcttcttcatatacattattgaactttttgacatttaatttcttgtcttcacatgtcctactgagtaacccatttgttgtttatgatatggctgaagattgaagggccactcagttgtatatatataaagatatatatcattatttcatataccatcatgcatttcacagcttataataatatgtaaattaacttcaaatattcccagatgctgaaagtactacaagaacatatatataataatcaaacttctaactcttgtcctgatttaaattgttctccaacatggcaagctatttgattatatggatatgtgaatagtttcactatagcaactgagatgtcacagactttttttatcttctttacattaaataaacttcagtctcttaagatgtacgtaccccgccaataaagtgattgcattaattactccagcaaaaatgtgtataaggttagcatagggataagggtatgaaaattaagcttatttttttttttttattaacacatctaaaacaatattagtaagttttttgtgttggccgggtatggttcatactttgtctttagaagataagtgcgggggctcgggggagtcgcttcagtgggaatagggggcagcaccccaaaacttttttctagatttaatattgttgttggtcttatattttattatttgcatcttaggcctatgaataattacggtgtttagggtttctaagcttatatatttctttgtaatctgagtgctttctaacgagtgcgtgagaaaaatataaagaatagctggacgtaacccacattgagtgaattaggataaacactgtgcgttattttgttctttccttttctctctttttgctatctcgattgttgtgtgattattcgatatccaacattttggtgcctgcttaacacttttgaattttgaaaactcttctccgtatgctcccctcatattcttatggcttcaaaaaccatttacacgtgagttctgaatatatatgatttggcaacagatagattggtgttttcttaacaccagtcaataatttaagtgtggatttcctagcttcaaacaatatctatacaatatacacgaaggccctagatagatcaactgcagagtagttaagcagtgtggaattggttccttttctaagacaataagaaaaaaaacagatcttcaattatggatcggcggattcctttttgcaggtgtgtaatccattgtatccaactcatcattgctgtcttctgccccttcatgatttggcttaaagaaactagtttgagtactcttcttaactgcatcatccttaatctctcgcaaacttctggctgtaagatattaaccaaaagaagcatcacataaatgataacggactttgaatatcatatcatatacacaatattaatcttaattttctaacaatctataaaattgtaaacataaaactaaacttaccactagctgtcatggtgatgaagcaaagcaacagataagcaacaaggagtaagcgcctgtttggtgacatagccattattttacttaactcttggagtgtcttttggtatgaatgtgttatgtgtaactctgcacttgcacaagacatggcctagttgccctctttttatagtcatggaaatcaagtaattgccaataagagggtacaccattcacgacaaggacaaatattgttgcgatttaggttctaatcgatgtctcccgctttgtcttccttgaaagtgacaagactttgcttcgaaaacaggatctaagttaagagcaaaaatggttccattccttcaatgctaccaagttggcattttgtgtcccttaacacttgccactgtgaatgtgaattaaccaaagattatccacaaagaaaaataacccctttccttcttttgaggagggggagggaccccattcttcttttgtggaatacactacgtgcacgagacttttaagggtattgtatggttatgaaacaataaggactgaatcgagcatttggcccctatctcactagatacggtgaatttcaatattccttacatataaactgacagacatgaatgctacacatgcaattcatgaaacatctctttctttcatttaatatgtacaacgacatatgttatatatatttctattatttttgtactagtgtacaaaattagctacgaagtagtatcacagcatatattttattcataggctaacattcactggttattaatttagttctaaaatttacgagaaactaatctcaatacctcgcaaccttagggtgtatgttggttttccaatggttgccttcatccaaactccgcatgcaatagtagagtagtcacttaattataatgattatgatgttagttaaagtcaatgtgggtcaaattagtcaagaggtaagaaacaaggtaacattatagagtggtctgatacatctaaaatggcggatcatgcatttgattataaaatatcaaataataataaattagagttatcgaaattataattgtgtgtaccttgttggatcattattgaatcaaagaaaagtcgaaaaagatgagagaataaggtgtcagaattttcctctatattgcctatttagaaattgacaacattcaactatagaagcataatggttcatgggacttaattccatataaatagactagtaaagggacctatttaattacccaaaaaaaaatttatgcccactaagttcacatatcatggaaaaccaggatcacactaaagtctatactagtgtcaaattattcttaataacaatagatgctagaagtccaattcaatataatcacaatgagtcaatcaaaatattaaaatttgaatatttattaaccccaattaatttaaaatataaaattaattaattaatgttttcgaaaaatttataacatgtaccttagctagggagagtaacatttagtttgcgcatgctcctcatatttaactattctatcttcatatatattattcttcttaatcatgcctatttctaatctagttaaacaaaaaaggaaatcatgcattatgtaatgaatcaaaatagatgaccgacattgatggggcttcaatcattttcagataagccgttgaacactgttgtctgttgaaaaatcacccgatcaatatctaattgtggggctgcactgtccctttattgcccatacataaactgaatatttatctaattctcccgctgatccgtaagattagagataataccgatggaaaagaaagattaggaatatatattaataaatatatatatatatatatatatatatatatatattttagacattacaactataatagaggttgcattatctacattttcccacaatttcctgcaacgactagaatttaaaaccttcatcataactcgatgacttttaccgtacagttcgttctatgatgacagtacgtacatgccaaatagtgaactataggagtaggacgccatggaaacagtactcaatgtaagttttactagaatatagtttgcattttgtaataataataataatgtacttcaggtgatggtccagattgtaagtcacacgggtcggttgtgtcaggcacaaaatgacaatgtggaagccaaaaaaaacccaagcaaacgaagtgaaaccttgttacccctgaaaatgaactaattgagcttgagtaacaaattgttgaggttagaatcactagaacgagcgtgaccatgttccacacccgggctttagggtaggggccagtgggtcacatttcctccttctaatcgaaacgcgtggatgcatacaagaccaaaaccaaaaggccccattggagggaaaagtgagtggtcccaaacaaaccctagttttggttttggaccctctgggccgtcacgtgcttccggagcggctttcgcgtgatattgctttgctatgcttaatatcattgattagtgtgtggtttagaggattaggaaaagttaatcacgtcttgtttcggatcgatttcgattttgcctcttcaataagtgcttatttgctttcacttgtcgctgcgttgcgtattactacagagtaacgatccagggcacaaactcacatgttctgttgggagtccactcattatctactctacgtcgatgtgatatggaccaacttagcaattcacacaatttaaacacgtattctttttgtaacaattttatacacgatacaagcatataatttagttgcaatattctaaatattttatactatcttttaaattacaatttcatctaaaatggagactcttaatcataacataaactcgtaaaaggttaagttaagatcataaaagtcatgtgacttttttgagtgatcatgtaatcactaaataattttaattttaattaaccatgatttacacacatttttgtatttcaatgaggacgtcttaaaaaaaaacttttgcttattataaacaatgaaaacaattaatatggtaacaaaattatacaaatgattaaaattaataatcaatcattgattgcatgattacttaaaaaaatcatatgcatttatctcttaatattgatcatttaattatgaattcttttagtctttaccattaaaattgtcatatgcatttttcttattttgataattcaaatttgacttaatggcttatatctataggttatgttgagtaaaactagctgaaagttaaaaaaatagtttttagattataagtgttcattaaaattagttgttgaattaattaaaaaatgtaaaataccagaaaaataataaaattataatttgttaaaaaatgtaactaaaaaattagataaatatattaaagataaaaatgaaagaaaatataaaaaagtaaaaactagttgaattgtcagactcatctctcacatcaacaaaaaaaggattgggtgagccaactcatcaacttgtgatgggtttagttggattgaaattttcttatcccaccacgaagtgagtgtagttgagttgatccatataaaatttaagttcgtggtaagccaaattatgttaaaagttcgttaggattatttcttattcgtgtctattttcttttacattgacaattatttccctccctcgtcaactttgtgatgctatagtgaacaataataaacttaatacttaagttgagagaatattttagcaagataacagcttacgaaatgtaaaaacatatctttagtgagatgaaggttagacatttatatgcaagggtttttgtcactaaaggatgatggttactaaatcttaagaataggtgaaaataataaaccgttaattaaacaattaattaatctaagcaatataaattattttcccatggtgggaaatctaattagctctgccactgttgcctgtgacgttaaacaaagattttctacattctaaggcaacaacaaaaaaggaggaaaaatattggagtcgtgaaaaaaataaacacacactaaacattcataagtacatgctaatcttccttgaagcagtgttattaggtgtgtatttgtaatcaagttaaaatgtcgttacacacaaattcaacaatttgttagtcacattaacatgttttgtctgcgtctctcaacaattgacgcgccttagatgtgaatttgccaatctaccaatttacatgcatttgccaattatttgctagcttagatgtgaatttgccaatttaagtgcattttgaattaaaatccaaacacacactaaatttcttagtgttagagttcatggtaaccagatagtggaggaggaaaaaatggaaaaaaaggaaaaagtagttaatattaggataatactcaaaatgagtaaatcagttacaaatgagtaaaactttgacttatatagttaatcctatatctctaatacccccgcaagttggaatgtgttgaaaacacttccagcttggagaagattacacaattataccaaagtaaaataaagtctatcaactggaatatattagagatataggattggttatataagccaaggttttactcatttgtaactgatttactcattttgagtattatcctaatattaactactttttcctttttctccattttttctcctccactatctggttaccatgaactctaacatggtatcagagcaatctatccaccataatttttcttttctccgctgtagttcaccacaccacaccgcagagactccaatttccagttgccaccgcactggaaatggccataggtgtagtagttaccaattcaacttccacttcaatttcgaacttcgtccaaatgtggttctgattgcaagatttgtgccttcttccggtcatgaaacaagaaaccaccaccatcaatcgactcctctccatgtccacaacaaaatccctctgtttttagtctctgccgtcatgaggcgatttctggccaccgtctgccgccgtcatccgctgcaaaaatcaatttctgttcgccattgacaaaaatactctgatcttttcgcatcataacccaccgatcaagctctctgttcactgttgctatcatttttggtcgtgaggcgatttctggccaccgtgcaccgtcgtcatccaccacaacagttgtgccaccaaccttcgtcatgcgtctccgtcctttgtcatgagtggcaatttttagtcactgtttccaagcttcaatctccatattgttcttttgcttggtgagataaggctttttgcacacaacctgtttgcaaaaattcctcaatgaagacaaatacagttcttgttgttgatgttgctgccattaagttttctattatgcagcttaatgtttcattgatatttggcctattttggcttattgttttcagccttttaggcttgttttgatgattgtagcttatgccaatgtggtgtttaagcattgtttctttgtttgcttctgtcgatggtggttaagttctgttttagcttctgccatggatggttaagccttggttgcttctgtcttgagtggttaagcattgtagcttctgctcttgatggttaagctttgatgatttgagcttctgcttttgcttggtggttaagctttgatttgcctattttggcctttgatgcttgctttggactcttgatttgctggagcaagtgctatgaagatattagaagaagttcaaggatgcagattttagttgaagacttctaggatttatgcactatggctgcacctacactttgatttgtttctaaatccttgtatttggccgatgtattttcggcattttagctatattccagttgatagactttattttgctttggtataattgtgtaatcttctccaagctgaaagtgttttcaacacattccagcttgcggggggcattagagatataggattggctatataagctaaggttttactcatttgtaactgatttactcattttgagtattatcctaatattaactactttttcctttttctccattttctctcctccactatttggttaccatgaactctaacacttagaatgtgcaaaaatgagagtttactaatttggacataaatttatcaacttttatgtgtgtttttgattgaaatccagacacacactaatcctatcatcgtgagtaaaaagagagctaaaaaagaatgaaataaacagtaatataagatggtatccatttcatcctacgaaacattttaaaagcttcttagaccgtgaaaaagtgagagttcaaccgactaaacaaacacatccctagttaattagaatatgatatccaagtgaccaaacacacccaccgagaatgatcccgcgctaattcgaagacggaaaaaccaaacaccatagtagtgccgaggcggtaccgatggatcccatcaccctctccgacgaagaagacccttcaacgccgttcccgctccgtcccaagaaacgccgaaccgaaccggatccaaaccgcaccgtcttcgtcatcgatgatgacccaacccctcacaaatccgccacaccttctatcgttcccgagactccaatgtccgcgctattcgattccgacattgcaattgtcaaatgcaccataccttccgatcccaccgctagggtttccccccaaaaattctctggtcgaatccattttctgtcactgctatcacttcactttagctctatctctcgttccttattttccataatttgatttatatttttcggctggaactctagcattactcattttcagtgattgtataagtaaacataattattgcattattttgcaatctagaaaagaaaaataattggaattgcattgttagggtatttgtttgtttccgtgctgatatgtagctttgggttttctagtggaatttaatttgtcatgatttatgattgttgtttgttctcccccctttttgaaatgttcaatattctatgagaagtgaacttcatctgaacagcatgtatattgtttgttgttcagccccttcagggattagtcaaataatatgtttggaatcagataatgagtcggaaaattgtggaatgggcacacgggacaaaaatgaaccaagagattctagatggatttcaaattcaatggggtctggaagttctcctggcatatgcttggaatcagataacgtgttagaaaattgtggaatggacaaaccggttgagaatgaaccaagagattcaagatggacttcaaattcaactgaatctggaagttctcctcgtatctgtttggaatcagataatgagctagaaaattgtggaatggatgaacgagatgagaatgaactaagagaatcaagatggacttcaaattcaatggggtttggaacttctcctggtatatgcttgttgacaagttacatttgttcttcaccacctgaaatgatttgtttatttgtttatgtaattgaaaatttcagacaggcatatttcatggggaaatgctactcaaactgaaatgcctggggatgacctttcaaatccaacctcttcacaagtggttagtcatttgatcatcattttccgggttgtgtttatgcacatatatgtagttatttattttctatttgatttctattggtaatataaaatttgtttattctaattgtatttgcttcaaacgaaaaagtggactgtgttgtttaattctgtgcttcttgcatttttctccatgcatctgagagaatctcatactattgtacgagttttatggtcatgctgattaggaaaatgtgaacatgcagcaagaggaggacgccaataatattaaaaaatccaaagtttctgcaaagaacacaaccaaggcagtgggaaaaacaaaaatgacaaaagaagaaagaagtcgcttgatggaggaaaagaaactacagaaagaagtgcgtttcagtttatagctctggtcattgtttatacattatatcattcagaatatgatagctcatgaaaatttattcttcagcaagagaagttaaaaaaagctgctctgaaggctgaagctgcagaactgaaaaaaattgaaaaagaaaagcaaaagtgggaaaaagggaagtttgcaatgaaatctattgtggcagaaattgatgtgaaggtggttgaatcaggttcaattggaggtaggttattgatatatgaatccataagtacatgataaatttctacatagtttatttattatgaatgttttctcttaaaactaatattctcttgtttatctgaattcttaactacaaaataagttttaatgcaatttattattgtgattgttttcatataaaaccactattcccttgttgcaggacatctgcttactaggtttgctgaaaaagggcttacataccatattacatcaaatccaatcgcagggtcaattttgtggtctatgaaagttccagaacatatttcacaggtaagaaatgcctgcagttcatctgtaagcatcaaatcattaagcactgcctgtagctaaattcagggaggagaagggggagagcaattagttacatgagttctaagctggttataatctcatgactcgttgtctgtgcattactctttttggcctcaggagtagtcttgtatgtttcctcatctgcattcttcattcaaagagttgaaatggatgttttaagtttcaatcacacacacatgtatttatggatgtatttagagagggatgccatgacattaacatatgttttagtaatgacaagtaatccatcatacacacctgaattgtgatagacttttaggcctggctagtgtagaactatctttatatatctaatgaaaacttttttcagtacatccaaattagatgaataattttttgcggattcttcttttccactgataaaaatttcatttatttgcagctttccactggaagaattgagattccatatatcttgctcatttatgaggctgacaaattttgtaaccatgttatgaatgattctctttttgatcaactctctagcattcgaagtctttatccagcttatacagtttgttacctcaccaataggttattggcttatattaataaaaagtgagtgatatattacaattttctgaatacttcaattctaccagcaattagttgcatttatgttttaccgtattgtgctatgttgatatagtgtgtccatatatttgctaaatcatccccagcaccagataacttaatattgggtttcaatcaaactcccaaaacaaattaaaggaatatagtataattaaaaagttagaactactcaacaacttttttacagtataaatgcatttgagttaactttaatttttacttactcatgctcatatttattaaccataaatctcttaaaaaagtcagattcatcagtcatcacccatttgatagggccctaattaggtaatggtaaggtacccatctgtattcatttacacctctgtgaacttttttttataaataaattacaaccatataaattgttgaaaattgtatgaatgtaaaatattgtgtagttggaatttggaatattgttttaacgtacctttcttgtatgagagatatgatgctcaaacctgcaccttattttccattctaaacgtttattttaaatatacttttatgaatatgagatttacttgagttgcatgcagtaaaacttttcttttttgtattttaagatgtacaggttatctggatatttttctaaaattacttttgaataggaattccatttaaatattattgaaatagtgtaaatgaggagtttcggaaaatcatatgcaacatttgccaaaatgcaattcctttcagctaaaagtaagaaaacttagtccagacagaatgtaagtttcatgctgtgcaaggtagaaatgcattctgcacctggtttccaaatgcaagaaaaattgcaaaaaggatgctgcgtagtgcatacagccttctttacacacaattcacacatactagtattttcctctgtatataattttatttaaatatctgtcaatgatttctgatactttagttttgcccaatttatttataacctacaatttcttttttgatttcatgatattattttgttgaatctttgtttttgtgatctgttagggaacaggaaaaatataagaaccctgagagctatagttgttggagacgtccacctgtagaggaggttgaataactggccctttcattttcaaattacaaggaataggtcatgttttaaaattttaccttcttgttcaaacttgtctatcatttttgttttaaattgtcttgtaggttctggcaaaactaacgactaatttcaacaaagtacactccaggcagtgtgcagatgaggctgaactggctgaacatgttgtcggtttgacatgtagcctagcatcttgtcagtttaggtacttgatacttgtatttttggtattgtcctgtcaatctttgaaggaaaaaggctttatatgcaaaacttctacatgtaaaaccagttgcgcaaaatccattaaagggtacattggtgaaagatggaatttgacatgtctttactatatctatgttataaaaaaaaaccattgttttcatccgttttcccacccatttttcatgcagacaactcatttctttaaatttttattgaagcattaattctcagtttgcaagaacaacttaagtcctagaattgaagttctttcacgtatttggaagacacaatacctgtcttttaacactgtaaatatgttccatattcgttgtatagtttatcttttataattgaatattgcaccatttttatttatttaaactgcagaaagaagttatcccgattatctgtaaatgcaaatggagcccttattccaaaggactacgttgaccggaatttgataaagaaatctttgtggtgagtgattttgatattgttatattgcatagagaaatgcatcctcttaattacttaaaacaaaaagacgaaaatgcttaagcatttaagttcttgccaacacaaaggcattgaatacttttttcttttggtaattaggagaattgataggctgaatcgtttgatggattagtaatttttctattgcataaactctttgaaacaaacacaaggcctctgtttttattacccattaccagttgttgtttactttgtttttgatttattttgtatttatctactagagtacttcatatctgttttgtcttttcaacttgtgttcctcaccttgacttccatgactataggttaaaagctttggttgctatgcccaaggtacagccacgattcgccattgctattgggaagaaatacccaaccatgaagtccctgttaagtgtttatatggatccaagtaaatcggtatgtgttgttaagatttactctgtttgctttgaccttcttgattgattgcacattgcagtaaatttggtctctaatatgtagtctgtttggcatcttttagttgctttagttacaaataattggtgaaaaaaaaaaggatggccagaagttttgattatccttcttaatgatggaaggtgcacataaaaaataagactctgctttaattgccacaggagcatgagaaggaatttttacttaaagacttgatgaccgaaggtttgcttggtggtgacagaaggctaggcgaggtgtgttcaaagagagtatatagaattctaatggcacaaagcggatgcattagaacagatgatgtcgagaacggtgctgatttctttgaacgtcaatcatgaagagctttgtccttgtatgtaaactgtgtttaagaaagggtgtctacacttttagatgcttaatcgattttacatttaataagaaattaaaatctgttattattttatataagtgataaactattttgttatattttttcatcactattaatgaagttacagtgctggttataatcgggtaactattatgaataatattagtgattaaataaaagcaagtcataaataatgaataattattaattaacgacaacctttaaatttattactgattttttgtctctaaaatatctaactttctatgtaatgattgtttttgtacaccataatttgtacaattattttatgcaacaaaaaaaaaaacgaaaaaataagaagagaagagagaaaattaggataagattgatgatgtgatagagttataaagagaaaataatactgtaaaaaaatatttattattactaaaaatattgtctacaataaagtatttataatagactataaattgttgaagttttatttcttaaatgtttttatcacatcttccaaagggaagagtgactcaaatgattataaatacactataaaacaagcagagaaagttacatttcgtgacccaacttcttatttggttcgtagaggcttgatagattctctggatcaagtcgaatatccattgcagaaaaggacttgcgcaagggaccaagttcattgcgattgatcatatcaattatagatgcttgccagagggtatagttttttatattcttaagagcattaggatgaccctcagttttgggggattttctcacactggagagaaaaacgggggatataaatgcattcatgctcctctctttcataaagagtgaccatgtgctgcttccacttttccctgtttcttcacattccatgtcttgtgccacactcttctgtttccaaaaccaaaagcacacaagttattatctttgtcttcactatatgcaaatagctagctacaatagttcttttaaaaagaatgagtagttcgtacgagattctaagttcaaacttcattgtcgtcatggtacatactattaaaaaaaagttccttaaatgtgaaaaaatatatcaaataatttgatgaaactgtttggttggaaatcacctcttttgctgattctgaatctctcctgcttggttctgcagtttggttctttcgtgactgactcacattgtatgcacttgtttgatatacacgccctttatttttcagacccttgcgccttaatttgtcatggaaagtaataaacaacgatcaagatcagtccacaatatgaaatccaatgctgcactctagttaatagttaatatatcaataacacataatttggttcacacttgtgtgaaagacaaagcttcttagttctaaactgatagcataccttttgcgtctctttgtttgtgagcgttcctcctcgtctttgtagatcactggtaacgctgaaaggtcacatgctaatggacttgatgtgaaaaactgtaagcagtcaacccttagcatatagcaatttcaattttcatataatgtttttacggcacataaaaattctatttttttcttcaaacttttgaaagtttatacatctgtatgagacttgcaaatttagttagaaagccttgctaactttcaaatatcaagtggctaattcaggatttgatcttagtgtcaattaatcatgatgttcttcgtgttgaaaagcgaagactaaggtaaagaacaatggaacgacagtagttatcttattttatcaaaggagcacttctaatcttcattaaacgtcctcttcatcaaataaaaaatatcaacctcatttttttatagatattaaaaatatttatctttattgcaagagtttaatttcagacactattacagtcttgctaagtcattcattatcaaataaaaatacatcaaagtgcacataaagtaacaagaagcatgattaattagcaacaagctagagaagtaactcacttcactttcaagagcagaggcagcggtgccacgagagtaagagtcgagatcaagaagagcggtcaagagagcacaggcagaggaaggaaaatccttgaagttttcttcataattagctttataatgtgatggtggacggaagcttgtcattagcttcatttttatccagtaatccgctgaaggtgaaccacaaagtttgaaaatcatgtgaagctgttcaacctatatacacaaaatgcttagcagctgatcagactccaaaagcttctattagcagctttaattaatatagaatgtaccaaatgcattcacacattcataagatatgaatcagacttaaaatatgcatttgagatttcaaccatccaatcttcatcgatgccaatttatgattgtgcgaatgcatgagttcaaagaattcaggtcaatacccaaatatagtagggggacaagagaaattattatatggtctaacactatcatgtcctggacaatcttctcataacacataaatttaactacgtactccattgtccaaaggttcttcactatgcaaagataagggagagagatattatacgcagtcttacccttgtatatgcaaagaaattgtttccggattcaaacttatggccaacaaatcaccaaggcacaactttaccgctgtgtcaaggcttgccttctcataacacataattgagttttattaattttttctcgaagaactcaattatgtgtcatgtagaagttatttatgatcatagacacatcacatgtagtagtcctagaccatgtaataatttctccatgaaaagagacaaaaatagttagttactttaacatgcatttgagatgacttgatataagtttccaaaatgatcagatcaatcatcattgtgtatggtgtccaagctaaactctttcattattttaatgcattccaaataaagttttacctcggtcctcccgggcataattggtcttccaagaaacatctcagccaacaagcatcctgcactccagagatcaatttcatatccataatctgttgatcctaaaagaagttcaggagctctataccaaagtgtcaccactcgatttgtaaaaggtccttcaggtttgatagcaaaagaatttgccagcccaaaatctgcaatttttagcaccccttttttatctactaacaagttagaaggtttaatatctctatgcataactcccctctcatgacaatgctggagccccaaaagcagctgctgcatataacacttgatctgcataaattgcaactagaccactgttatcatttcatcactagctaagtgctgatccaaatatcaacaacatgaacaacataggaagtgactaaagatttgtaagtttgagctattacaaatcctatatttattaataaacaaaatcaagagatactaaaataaaagaaacaaatcatttatatgtagcctttcctagcagcaaacaattacaatttacaaacatctcaaaatgaatcttaggaataagaatataattagctcgaatgtactttcagtataaaagttatttatacttccaatccttcatagactgtgatgaatgggattgttaactttcgtaataattattttaaaagacatattcagaatgatttctaatttattgacgatgtaaaatctttttatactgagagtgtatcgaaattaatctcaggatagaaaccaaacctgtggttcagtgagtttctccccagggcggaagataattcttgtaaggtcagaatgcatgtaatcaaaaacaagataaagactatactgcatccttgatgttgctagtccttccagttttatgacattgggatgatccagagcctgcagtatcattatctctcttgccataaactttatgctttcaggatccgttgtgtcaaatcttaccttcttcaaagcaacaatcttcccagtatttttatctcgggctttgtacacattgctatatgttccacggcccgcctacaaccccagataaataagttaattgcttctccaatcccttcctctgtatgtacgacaaattattacagtacatgatttgatatcattatggtaataactcctaaaacaatctttacatgaatgtaatagagttttattgagacagtagagggaatagacacgttatagttgcggatcatataataatttctctaaacttacatgcatgtgaagaagagaaagaacaacctaactgtccgttggaagtaacaaggaattcaaggagaaagttcaaaaattggtgtaggtatcaccctttgtcacaccacttttatttttttcccactgaacaggagctaaaattatataagcaaacttaagaaaataatcttgtggcttagtatcagagaaattttccgataaatttagctagaaaatgtacacttttatataattttacttacatacagctttatacatgaatttgttaacgttaaagaattaatgttatttacatgcaactttatacatgtttaataaatgaaatgtacactataactaaggagtatctgtaagatttattattgtgactcatttaaataaatgttatttgatttaatgaataaagggcataaagataattggttacaaaggaaagttattaaaggataattgttaataaaataattatcttaaacgtattaaaaagataactgttaatatatgcagttatattaaaagataactgttgataggtgatgagagttgtatcaaatccctatcaaagaagatacaagaaaagaaagggtcaagactttgagaaagcattctgtcattaaaggatttttcccaaagaatctacgaaagcactctaccaataaagatcttccgcaattatggacaaaggtatgtttatgtgaaactcatgaattctaaaggtccttttttcatgttcttgatgtaattgttattgaacatgaattatagattaatgcttacatgtggtatcagagcatggtttaagaatttgtgattttccattattaagtttttgttgttataacaataaagtattatggtagattttgaatcttaattttctgcttgttgcgaatattattgatcgaataatgttgatagaataatatcacataattgttatttctcacttggtatgttttatgttccaatggatatcatgctaaagttcttatggtcttttcaaacaaagacacattaatgttggtgatgaaaagtaaacaataatgattgatcaccttattgctctccctattaaaaattgtatcaatgcatatttaaaattatatttgataaagttatatgcattgttgtattgtgatcgaatgactgtatattttgatgacattgaaaattataattttaacatatttttgtactttatgaggtgtttatattttggaattaaaagtaaggtggatttgttagtcaccaaagtggccaaatttgtatgagtaatttaattccaaattgtatgtttatttcaagtttggaattaagtatggtgaatttgttagtcaccaaagtggccaaattcttgatgaattgattagttccaaacattatgattatgtttcaattaccataactttgatgctatgaatggtataaaattatagtttatgttgtggtatattgaagtttattattatgggacagttaaggatcaacccaaaggatgattatttgtcgtcataataaataaacatgaatgttgacataatagatacatggctagttctatttatatatccaaagatagtaagtaatcctagttagtatatgtattaatgtcaaatcatgaaaaatataatttattggcatcattatagcttaatgttgtgtattaatggatccccaaaggtgaacattaatatgcattttatgatgtatgaatctgtgaattatgttagtatgtgatatgtatgattcaaagcattaatttttcaaattttataccttgcagtacctgttgctacacattcgtttttctcaactattacagtttttaatggactaaacttctctgaatggacagagcaaattgaattttaccttggggtaatggatttggatttggctcttagagaagagaaacctagtgctattactgatacaagcactgagtatgaaagagtccattttaagaactgggaaagatcaaatagattgagtatgatgtatctgcgaatgagcattgcaagcaacattaagtcaactcttccacaaactgaaagtgctaaagaaatgataaaacttatggaagagtgctcccaaactgctgacaagtctcttgctgggacactaatgagtaaactggccaccatgaaatttgatggttcacgtactatgcatgagcatgttattgaaatgataaacattgcagcaaaattgaaatcaatgggaatggctgtggatgagaatttcctggtgcagttcatattgaactcattaccgtctaatatggtcctttccaaatgaactataataccatgaaagacaaatggaatgtgcatgaattgcacagtatgttagttcaagaggaaaccagaattaagaaccagggaattcattccatcaattatgtcaaacatcaaggagctgaaaagagaaatggtaagaagcatgagaagaagggaagaggaccattaaagatcaatcaggtttcctcttctcaaatccacaagaaggaaaataatggaaacagatgtcatttctgtagtaaggttgggcacttccaaaaggattgcccaaaacgtaaggcttggtttgaaaagaaaggtaagccttgtgcttatgtatgttatgaatcaaatcttgctgaagttccatataatacttggtggattgattctggatgtacaactcatgtttctaatattttgcagggattccttaagacccaaaccacaaggccaaatgaaaagtttgtcctcatgggtaatagagtgaaagttccagtggaagctgttgggacttaccgtttgatccttgacagtgaacatcatttggacttatgtgaaactctttatgtacctagtatatctaggaatttagtttctatttccaaacttgataaagctggatactcttttaaatttggtagtggtagtttcagtttgtacaagcacaatcatttgattggcaatggtactttatatgatggattatataaattatgtcttgataatctttatgctgaaacgcttatgactctgcatcataatgttggtactaaacgtaatttaattaatgaatgtttcgcttacttgtggcataaacgtttgggacatatttccaaagaaagaattgtaagattggtaaagaatgaacccttccggatttagattttactgatctaaatgtttgtgtgaattgtatcaaaggtaaacaaacaaaacacacaaagaaaggagccacaagaagcactcagcttcttgaaattatacacactaatgtttgcggtccttttgatgttaactctttcaataaagaaaaatattttatcaccttcattgatgattattcacgttatggatatgtctatttgctacatgataagtctcaagctataaatgctttagagatttacattaatgaagttgaaagacaattagacagaaaggtgaaaattgtcaggtctgataggggtggtgaatattatggaaggtatgatgaaagtggacaacatccgggcccatttgctaaattcttagaaaagcatggtatttgtgctcaatacacaatgccaggtacaccacaacaaaatggtgtatcagaaaggcgtaatagaaccttgttggacatggttagaagtatgttaaataattcttctttacccatttcattgtggacttatgctctaaagactgccatgtatgtattaaatagggttcctagtaaagcagttccaaaaactcattttgaactgtggacaggaaggaaacctagcttaaggcacctgcatgtttggggttgccaggcagaaattagatactacaacccacaggaaaagaaattggatgcaagaacaatcagtggttatttcattggttatccagaaaaatcaaaagggtatagattttattgtcctaatcatactacaaggattatagaaactggaaatgctaggttcattgaagatgatgaagttagtgggagtgaaacaccacgtatagtggcaattcaagaagtgagagtacaagttcctttgacttgtagctctagtaaagttgttgttcctcatgttattgagccaattaataataatgaagaacaacaaatgaacgattccattgctcatgatgaaattattgacaatgaaccgaatgaacccattgtagaagaaccacaccaaatagcattaagaagatctcaaagggaaaggaaatctgctatttctaatgactatgtggtatatctacaagagtctgaatttgacttgggtataaaagatgatccagtgacgttttcacaagccgtgaatagtgaaaatggtgacaagtggttaaatgccatgaaagatgagttaaaatctatggaacagaatgaggtttgggaccttattgagttaccagaaggatgtaagagagttggatgtaaatgggtctttacgaccaaacgtgactctcatggtaacttagaacggtacaaggctagactagttgcaaagggatttactcaaaaagatgacattgactataaagaaacattttcacccgtttcaagaaaggattctctaagaatcattatggcattggtggctcattatgatctagagttacaccagatggatgtgaaaactgcctttctaaatgggaatttagaggaagatgtgtacatggaccaaccaatggggttcatagaaaagggaaaagagcacatggtgtgcaaacttaagaaatcaatatacggacttaaacaagcttcaagacagtggtaccttaagttcaatgataccattgtttcctttggatttaaagaaaacactgttgatcggtgtatatatctaaagatcagtgggagtaagtttattttactgattctgtatgttgatgatattttgcttgcaactaatgatcttagtcttttaaatgagactaagaagtttctctctagtaactttgaaataaaagatatgggtgaggcatcctatgtgattgggatagaaatattccgtgatagattacaaagattgttgggtttgtctcagaaagcatatatcaataaagttttagagagattcagaatgcaaaactgctcatcatctccagtaccaattcaaaaaggagacaagtttagtctcatgcaatgtcctaagaatgaattggaacgaaaagaaatggaagcaattccatatgcatcacttgttgggagcctaatgtatgctcagacttgtacgagaccagatattagctttgcagttggaatgttgggaagataccagagtaatcctggtatggatcattggaaagctgcaaagaaagttctgagatatttgcaaggcactaaaggtcacatgcttacttataggaggtctagtaaccttgaagtgattggatacacagactcagattttgcaggatgtatggatacaagaaaatccacttatggttatctgtattttttggctgaaggagctatatcatggaaaagtgcgaagcagtctgtaattgctgcgtccactatggaagctgaatttgtggcatgctttgaagccatggttcaggctaaatggttgcgaaactttatttcagggcttgaattggttgacagtattgataggccgctgaaaatttattgtgataattctgcagcagtcttcttttctaaaaacgataagtattcaaaaggtgctaagcatatggaattaaaatactttgccgttaaagaagaggttcagaaacgtagagtgtctatagagcatgttagcactaattttatgttagctgatcccttgacgaagggattaccgcccaagacatttattggtcatgtatgtagtatgggcattatgtcagataatgaatgttgatcattattgtaattattgactattgacactctgaattcaatgatgtttaagtttctgaaaattatcctgttttcaaatttatgtatacatgcatgtataaatgattattttgaaaacacaggatttgtccctaatgaagacataatagtacattgtgggacattatgatgtaaacttccattaaagtatcatattaggaagaagagctaatatagtggtacatggaaggaactatgccgatttgatagcatataaccgccatgactcttattggttttatttctgatcatgatttatgatgagaccaatgtatgaaaactttagccctatgaatgcgcattataattgttttcattaaatcatgaaatgaaatttatgacatgagccaagtgggagaatgtaagatttattattgtggctcatttaaataaatgttatttgatttaatgaataaagggcataaagataattggttacaaaggaaagttattaaaggataattgttaataaaataattatcttaaacgtattaaaaagataactgttaatatatgcagttatattaaaagataactgttgataggtgcagttatattaaacgtagtggttcagttttcttaggaagagagatatctagaaaactgaatatcaccattgtctgcctatgagagttgtatcaaatccttatcaaagaagatacaagaaaagaaagggtcaagactttgagaaagcattctgtcattaaagaatttttcccaaagaatctacgaaagcactctaccaataaagatcttccgcaattatggacaaaggtatgtttatgtgaaactcatgaattctaaaggtccttttttcatgttcttgatgtaattgttattgaacataaattatagattaatgcttacagtatctagtcaagaatttatatatatcacaaagtattactctccttctctctttcagattacataaagtttaagattttaacacatatcaagaaatgtaatgaattggttgaatttcataaaaaatattagataacttttaatatatcatttatctctttaattaattactctaactaaatattgattacggataattttgacaaaaaatatacttaaggttacaatgattttataataaaaaaatttctttaaaacatatagaatggaggaagtaggtgttaagtacctttccgagtttgtcataagaatcaacactcttgggaaccaaactagccaaaacgtttggagggatattatcaacgagccattttggccagccttccacaaactcatagcgtgcaatgttcttcttctcctttgaaacattacgaagctcatgactcttgccatcgtttgtagcaacaccctctaccttgctactagtattatctctaatttctttgtcttccaacacgtcaacgtgcttgttagatgaatgtatagtagtgattggtttgggtgcatgctgctccttgtttcgcttcaacctctcagcgttcctccggcttcggttccgaggaggatcgtatttggtgttaatgcatcccatatggcgactcgaaactgcgaatatctctgtttcagtcacaaccacggcatatactataatatactatatatatctaactataaatttaaccgacactaataataataagaaattgtctaaccagaagtatctataattttttatttgacacttaattaattctctcttacaacataaactcattttaaataaagtgatatgtctaattataattctagatctaataggagattgactctcatactttgattaaaagactcaagtgaaaaataaattaacaacaacttttgataacattataatgaaatagataaaaaaaattgttttattatttctaaagtagacttaatcgtatgagctactactatgattttattttctaagatgaaccttcttttagaaataaagaataccagcctgttagccggcacaagacagagaattgaaatatttggaattatgagtggtaaaccctggctttctccgtcaacaatgattgagtgtttgagtttgagtgtcgtatcatattagaacaccaatgtttggatttcatcagacaccaattacgatataggattaggaagcaactatgtattgttcgacatggaccggctcttgctcacaacaccaaccattaattaaattaatttgtttgtctttttatgatgtgccgtgtgtttgaccactgtttattttattttattttttaaagaaaagctcccatcatgcagtatacattttgggagaaagaaaccatagataagaaaaaaaataattaaaataataatatgatgtgataatatatatctttatatatatatatataataaaagtgatgcatgttttgatttgtgcattttttttatccaattttattcttcgatttgctatgtgtaactcccacttttctattgacgcttctgatatttttctttttgggtacagctgaggttactgatatattctttttagatattttgtctatctttttaaaatgttatcttttcactgttactgtaaattacttcactattttattctaattctcaacctcctatgtcagttatattaataaaaaaaactatattaactatatacgacaaattcaatttcaaaaaataaaaatacataaactcatacatatttgtctttccactagaatatataaagtaggttaaattaattatttggttgaatgagttatttgataatatatatatatttacgtatatttattttttatactttaattttataaactttaaggaaaaaaattattagttatttcaacaacacattgatcaaactaaatatctgttgataaaattgattttgaagtgatatgatttatatttgaatgttttattataaaattaaattaaaattaaaatttattacaaaattttaaatcaaacacaaaagttactcaaagttgttttaatttagaataaattttaaaaatccaaaatcaattataaactcaataaattttcaaacttcaaaccaaactcactaaaaaagttgatcttgaacttcgttaaaccatatttgtaatgcacattaaacataattttaaactttgcttaatttgtaatatatattttttacgttttcataatttaacagaagtattattatgaattgtattattttgtaccaaacacatttaaataaatcgtacttgatatcttttgcatgttacctgaaacctgatagaagctaatcgaaaataccaggcatcaaattgtagtgcttaaacttaaaaatgcaagaaaccaattgaatagcaatcattttctttccacttatatgtcttccaattcgcaccaaataagatttagtctattccagagtaagatgaaaggttcaaaagtatagcatgatcattataattacatttcagcacatcactcgagggatagttgacataaagccgaaccaaatcgggaccaaagcgaagacaatccagaagagctaaatattagtcctctcagtggctatgctttaaagtttaaacctgacacagctccgtaatcagtattctgtcaggctcgtatcttcagcaagtatcgctattatgtacaatttcctttttcttctttttcctgagaacgtatcttcgaaatggagtcatttgttcaacaaattatgcatctgtgctgctatttaacagatttgccaatgctaagaccgtctccaccaataagcttctttgcgggcatgccaagatcaaaaggtcccatagaatcattctgtattcagatagtacattacttaaatcagaaatcaagatattaaacataataaacactaaaatgcttcaatgaaaaaattaaatacccaattgatgcctgttaacccaagacttctatcatcatcatatgggcgtgaagaaagcaacaagtctgtctgagtcttcccggatggaggattttgtgaagctacatcttgatcattgacctttaaaacaccacaagagacaatgaagggcaagtaatgatggataacgaagcttccatacaactccatagcctactaatggaaacataatctcattcattcccacatcaatttgaaccccaatatccgtcctattgcaacactagaagttattttattaacaagacatttttgtggagccttaggttcatttgaaactacaaatattatgttcatagaatacctgttaatactaggtacttctaaagttgatgatgataataatatcaagttatacattagcttcttaaaagcatctatctttcagaaaagttacaaagataaaaaattgttgagttatcatacaaaaagcactaggtaatttttccatcagacgcaccagctaggcagctacattaaactatttcacatttcgataatggattttcattgaagactgagcaactaaccttatctgtatttgacaactttaacaggtttgaaaaaacaccctgactgcagacagcagaataatccttcctacaagctgcctgcacatctgttggggaagataaattttgaagaggaaatgcatgacatgtctcttcagcatccaaaatagatgtgtgcaagtcatcagcaggtagtcttggaactgggcaattattaatttgagcagcggcaataaaagcatccaatgaatcagaagttatatcacacggctgtatgccagcaaatgattttggatcaagcccgccaaataatgatgcttcagacaggaggcccccaatgcttatattgcttagactatcaacccatggagatgatgactgttgaaggctgctacttattcttgcctcattatcctagttagaacaaacatgcatatcttagaaaacaaatatttatgatgaaatgtgttggaaattagtctattattagaacataaggaacatattgaaactgtcagaggattggcattcaaaattcattttagaattcacaaccaaccaacaatagatttctcaaacatccaataaaggtccaaaaataagaattatatatgcacgaaaactacccaagtgtttatggtgtcatggtatcacaaataagattaattaatgacattttaactttccttttaaatttttatacgacattccaaaacttttcccaaaattatatcagtatttcagtcaataaagcaaaccatcataaaaatcattttgttgttctttgattcacacattgatgggcaatttaagcaactatttgctagttattataatgcacaacaaaatagctatcagtttaccataggatcaactgcagcgttttctactttctgagccacagtttcacttgctgcattgcccacttcggtttctttgtattctttgcttatctcaaccttgtcccgttcaccacataaagtctcctctaaattagcattgtcgcctccgggtacaacaagcttagagggagttggtgtggaaggtataccaaaagacccgggctcatgcatgtagaaccatccataccttgaaagggagaacaagttacaacactataaatataaactacctaagttccacatagaaaaggataaataagatagatgatcagatataatacttcatccggaaaagtgcaggagttccaacagcagcataaacagcagaggctgttgtgtcactatcgttaattgtccaccttctgcagtcagatagattttccattacattatatggaaaaagtataagctcccctttggctatacttgaacttccccacttctttccaaggtgttttaatattgaagatattttctttcgacctctaagtgtgagttccaaataaggattatgcccatcctgaaaaggaaatagtctaagcatcaagacctactgcatccagactaggaaagacatagagtacatccaaatttgccaatgctacacaaataaccatgtgaccttttcaagtcctatccgagtttcttcattaattggaaaaagttgtaacttgatttttgcagaagtgagcatttgtccaggatgaagttcaatagcctctctcttctctgtaataaaagtacacttgttggaaaattctgggcactttctcatatgttccttaaatggaaaatactgattctctttatcagtcaactcttgaccgcatcctaaatataaaagatttaacgatattaaacaaaatgtacaagatagtggcaattgaacacttgtgcaaatttcaaaactagtgttgcctcatccaagaaaataaaagattcattttttctaagacacggcatattcagtgcatcaagggagaggacaatatgaaaccaaaaatactgttaaatcaatacaaatggtggtttgacaaaaatgcatcacctcttgctttgttatccaacttatttgttcttttgggagaatttctcactccaatggatcctgtctttagattgcactttccagaagccttcacagctttcctgtctagtgatctgcctgttttcatgatagttcaaccttcctgaaaatgatgataaaataatccttgttgttattcttcttgagaaagcactaaagaatagccaaaaaattaagagaaggcgccaaaatagctagttagagaaagagttatgtaccagtaaattcatcaaacaaaaatcaccaggcttgctttcagtacctacggttttgacatcacaaaaccaaataaataaaattagatactagtaaaagggtcctgagccctgacatgttatcagattatagtcctacaactaaagttaacacaaatccacgcctttagagaaaattctcacattggaaacaaaacaaacccaccagtataagaataattatgcagacactatcagcttcaattcagcaaaacaaattcaagatttgcacaaattctaaaatctcaattccaaacgaaatttaccataaccgaccatttttttcatatttcactagaattatcaaagacatcctttcactttccattcttattcatacaattattgaacatgagagaagggaaaactaagtttcaaggaagacacaagagtcatcacacagccctaattgtgatctggatcacaacaatgacatgccataagacatcctaacactagcatcatatatatccacgcgcaccaaaaaccctaattcgattattacacgattcagattacaaagaaaacaaacattccaacactaagatcaaattaaagaattgtgttacagaaaaagagtgtcacaaaaagtaattaaggggaaaaaaattaaggtgaaggggagggatacagagatgaattccattaacaatgaaagcatgttttacagcgggaaatggtgaattgagtatagcgatgttaaattcaataggttaggaagggttgcgttaagaaccttcgagaagctccgacggagggaagaataactgaacggaattgcagagagagagagagagagggaacagaaacagtgtgcgcgggaatgaatgaatgttgaaagtttgtaaacggagggaaccaaagaagcaaggggccaccgaatttttcaaggccaaggcggtaaaacttttttcagtttttttttcttttgggggggggggggggggggggggaggtccacacacaaacacgttccgtttacgtttcctcttcagtcttcgtggcattttcaaagtatgggcctcaaacaaattaagcccgtcttggggtcccaagatttagatagcttcttaaacccttatttgttaacgagggtaaattctttactttttaattttttatgcagttaatatttataagcaaaatgtgtctaggagaataaatttttaatttgtattaatttttatttcaatattattaaattgaaactattataaaaagtatcatctcttcttctttcttctaaaagctttcattcaaatccaggggaaaagaattagtatttaacaaaaagaatgttagagaaaatatgactaacattcctcttattaaaatagacaaaaaattgagtaaaaataagttagtttgggcagaaagaaatgagaaaaaaaaattgttttaattaagggcattttatgaaaatgatcactaatgcacaagacattttagattaaactttaaaaaaaggaccatgtcacacttttaatttggaccttataaagaccaaagcaaaaaaaaaattacaaacttttgcaaaatacataatggtataacaaaaaaaattaaaaaaattatttaagcttcaacacattacaattgtcctctacacattttcacactttgaaaatattttatgattttttcattgttaatactataaaaagttaaaataataaaattagtatcaatttattatttttttatatttattcaatttttaaaaattatcttgtggaagaaatacttttttatgaaggcaatatttttattacatacatacaaaggcacaagggctggagcgtgacgagggcacaccatcatcgatgtcgctccaaagattgacaacagcaaaggcacaagcctcgacaaatatgcgatggttggtgtaggagagagagcacgaagatcttggttttggtcatggccacagtttggcagccacacggtggtgggagaaagagaatgaagggtaaaaacataaaacatgtagtttggttctctgtgtcgacatttatcgtcatggtgatgcctttaaattttgttcatagtctctgatgacaaagagaagcaaaggtaaaacaaatgtgagtgacgaaaaagggaaatttttcccttgacattttaattgaaaacattgtgcattgatgtgaaatatccctaatgtaaaattatcatgttaacaacaatatgtcaatgtatgtactcaacgctaatagaaacaatgaatacttgactcttagactaatttgttacaatatttgcacttatgtgaattaaattgattatttccaaagtataaagaccaaatgccgtcattgtgaaattcatttaaatcacgttcaacaagtaaaattagtttttaatctagtgtattagaagatacatgtgatatctatccattacaaaaaagaaattatcatcaaatacaaaatataaaaataaaaattactatttatccaattatctaagagtaatagattatagagaaaaatgacaaatatatcaatttggtcctaaaataatgggtatttaaaaaaatgctataacatattttatataattaatataattttattacaatacagtattagtaaattttgttatctttatttttattcttataaactttttaataaatatttgaattattcaattaaatctttaaaaatttaattagtaacattttaattttatatgtcaatttcgtaaatatgttgatagagggagataatatcttacattattttttaacccaaccctgtccacttaagagagaataattaataggacaaaataaccatatgttatttcacccaagtccaaacaattgattaaaccaccaaattaacatcattttttttttattgagtttgaagattataataattgtctatctaattatttggattaatcaagaatttaaaattaagtaaatagcagaaagatgtccatatatttatactgaaatgaatttaaatcccaccttctaaataaataaaacagaagtgcattttcctgtaaaatcaaacacctaaacttgcaaaatgcaaaacttcagccactaatctcaaatcctttcatgcataattcaatgcagcccaattcacaatcatatacacatagatattgatttaggaataagaataaattctctagtagtttacttcgcaaaatcttatgcaaacatcacacactagtatgactatatattgcttgggaaatggccaacatttttcaagaactatctgtttaaacatgtaagcttgatgttcaagctttcaaactggacgacaatgctacacaaataaattgaagttgatccacaataaatttgacatttttcaccacagatttcataaatgacctctgttctgttccctattctaactatgacagcatcagtatgaaaaatcatgaccaggactatctgaatgcatatccatgcaatcactggagttggaagaatttgtttccctgttctggccgttaggataagtcatgtcactgttccgggttccatttcctgaagacatgatattacctgaaggaaaactcccctgtgccaaatgatatggctgaaggctgcgccgaatggggctagagagtgcatttgagaacactgagttctttggttgttgatcaggttgtccagcttgtatcccctgtgctgccacagttgctccaaatgcataagagggtattgacacaccaaagttagcgttgtgcattgcagtctgggagttctgttgatacattggttgccttggggacactggtgcctcctctcctccatattcaagctcattctacatgcacatgcatagctcaaggttatgtacatatctaaaataagctattaagataaatctgaaatcagatacattcattttgaaggatagccggaaataacacaattatataaaggaaattccagtccaagtgaactgaaaagagaaaaagaaattccttttaatgctctggctgtaattcaacaatcaaaatccggttggcaggtggcacaactgcacaagacctcttacacaaataaaaatattgggatggtgaaagggcataaagccattgtattcagtgtacagaaaaatcagagacaagttaaaaggttttctggtagactggtacatcaatgaaacttagatacaattccctaggtgaataaaggtttgcattaaagattagtatagattactgaggtaaaactctaattttggttagagaagattgtcacaaacacctaagaaattaggtcgaggttttgtcctacttcaaaaaccaaaggtctaaggattatgtccatcaaacaacaacttcacattcaaagcaattgacaaagggatccataagctatatacatagatagagttgatgaaatgtccttaaaccttgttggatggaggaaaaaacaaacaggaaaaagagtatctccatcgaaaaagtaacacaaaaggcacaacatacaaaaaaaaaaaaaaaacaattgcagagacaacaaaattgttctgttatgtgataacagagttgtccggtggtatcaccggtggtgtttgtatgtaggacctgactcttcccggttagtctatggtgatcagaccaacgacagaagacgagatcacggacacgggagcaatgggggtgctgtgtgtgccgtgtgaaattgagagaggagggccagagtccattatgcgtacctttcaccgtcgagtgtttctgccttataacctttcgtccaggccggaaatgaggcattctgtctccgggattgtagccgtcgagtcctctccccttgtgcctgcaacgaggatcacgggtcatcggccggtaactgctcctgcgtcatcgaggggaatccctgattgcgcgggttcattaacgaggaggatatgggagcatatccgtaacagatgcccctcgtcctggttctccagtattctggggggccatgacgtgtcttcaatttgttcgtctgtgaccatcttggcactctggccgtttacagaggcgaccgatatggtgatagccgatggattatgttccgatggcgtcttcaacgtcggccctgacccgattatcctcgggcggccagtggcttttcgggtccctccctgtggctgcccttaccactggttttggaccagcctcgcctgtttagtaggtttggggcagcgcaaacgtccctcaatcctgaggtgccatgtgtccctttttgtcatgcgctttaatcattacttgggtgcagttatgacgtaaccgccgctcccacgtccttcaatgtgtcagttttttgccttcaatttgaatttcgacggtttccctttttcgtattccacttatccgtctcttcagtcttctcatttctctttgctcaccaactctctgctttcttctccttggattccctttgggcgcctgcattcttctcccggtggtcacttgtgtctccttcccccttatcttgctctccaggtaactttcctccctgctcctttcgttttgctttttccttgccccacactggcttcttctccatcttcccttttctcctctggtattgccattttactttttgtctagtcctctggttttgcttcctgtagaggcccttcttgcctttcttttgcttccaccatgaggtatacaccggaggaagaggcggagatccgccgtttgtaccccccacgcgttgtcttctggctttttgggctccctcttcctgacgaggaaaaggacagggctttccttcgggtgccctccggtttgggtgcccctagtactcctagaatttcagtccctttaacccctaggcctcctagtgtaggcgtttctagggcattttctcaagggttttcgaggtcttttccgcgttctggcctcgcgcgccctgtgccgcgggtgggggtggcccctaggctccctgcctctcctcctgttaggcccaagcctgtcctagaggtgcctccccaattcgagattcgctacgagccctgctctaagtgcttggatgaattcctctacctttccagcagggacctggataaacaagccgaggacctattagataagtgtcggcataatcctgttagggtgcccaaatctctaaggggggcagctctggcttcggttatccatccatcggcgtcggcgtcggttcaggctttgcctcttgcttcgcccttgccggtgcgtcctccaggtaccttttctaactgatttctcttttcttttattaggtatccatgggttctcgtgtcggtgctagcgactccacgcctggggcccgtcctgcgcctttggccttgtttgatgaattcccatgggtcgcccgtgaggttctggagtattcgtcggtattgtcttctgaggatcttacccggttgcctgtcgaagcttctgaggagtttcatgttcgcctggctgggtcgggtgttcctgtttgcgtttcccaaagggataacgaacctcctttcttttcattttacagtgaggtgattactagggtagggattcggtttcccctgtccgattttcagatgcaagttttgaatcacttgcacgtttctcctacccagcttcatcccaacagctgggccttcattctcgcttttgagacactttgccatcaacttagtgtctcttgcacctgccccttgttcttttatttcttctcagtccaagctagtcgttcaggaaaggacgccgctgaccgaaagggatgggtgtcgttccgtggtcgcaatgacaccggctctgaccgtcggttgttctctctattttcagactcctttaaacgcttcaaggataaattctttttggttgtcgccaatcctggccggtgtcccttctttttgggcgattcttccgcgcccaagtttcctttatcctggtcttttgttcattatgaattcccaccttcttcctatcggaccaaccgggctcagttgtccgagtcagagcttgtgtcggtggcccagctattgtcatgtaaaagttccgggaacctagcaccgatagcctcctacattcagaagggttagttgcatgattttatcgactgttgtcttttctttcttcttttctgatggatgtttactttgcagctattgatatgggttccgatgctatcccccgccatcttgccgccctgaaatccaacaagaggcgtcgcttggccgatggccgtggtaaaaacgcggaccctgcccctactccggtcgctgccgcctctgggccgacccctactgatgccgggccgacccttgtccctgtggctccgactaccggcgtggtcccaagtccccccggctcttcaccgcctgttaccatcgacatccctgaaagtccggtgggtacttctgaggctttggctgctgatggccccccatccgttgaggccgaggccgccatcaatcatgccgaggcctccggtccaggttcctcgtcggccgctctcgtttctattgccgctgccgagtcgtcgggtgactatgttcgtcttcctcctcgggctctctggaaccagggtatgactcaagacctctttgaggttcttcgggcgccgaagaaattttccgatgtcatcgccttttccgattctgagctggaggagctgaacactctgcagtcagcttgctttaaaacgggatctctccttgggagtctctcttctctaaacctcaaggcctccaagtgggcatctcgggccgaaaccgctgaagccgaggccgaggcgctccgccgggaattggagtcggcccgcaccgaggtgattgagtcggctgaggctttgaaggccgctagggtcgaggcttgggaagctactgcgtcggccacccgattgacttcggagcttcaggggtctaaggagttagttgctaagctgacggccgactctgagaccgcccatgagacagtggccaagctgacggccgaattggacatccatcggaccaaggtgaaagctttggaacgggaggctaagactgccaaggccgctgccagccactcggagggtttgttaaagacgcttcggaagagctatgccacgtgcaaatccagtcgcgacgagctgcttgagtttaatgccaagaagattcgtgattgcgaggaagtctccaaggagctttccttcgtccaaggcgagctggagagggcctccgagtcttctttctacaataccctgagccagctgcacttcctgaatcctggagtgaagctgaacaccgagggtatgcaccatcgggcttatgtcagcgatggccgactcctcatgctttctgatagcgatggggatgagggtgtttctgatggggctcttgacggtggtgctccttccggcgacgccccaggtactgacgctcccgccgatgatgctcctccagctggggaaggtgcttgaagggccggtatgccggttttccttgtaaatttctaacaatttgaacgcttgacatttatatgctagttatttatttgtttggctttacgtccttccatggtgttattctgattgaggtatctcctgttgatcggtatactgaggctccaacggcctattttcccaatccgtcgttttgatttggggaatccgattgggaagtcacttactttcggcaaatttcgttaaggctccaacggccgtatatcttaatctgcctttttcgacctttaaggttccgattaggattttacccagtttcgtacgtaggtttcgataaggcccccaatcggccgaatgtcctaatccgtcgtcttcgacctttaggtgtcgtacgtaggtttcgataaggcccccaatcggccgaatgtcctaatccgtcatcttcgacttttaggactccgattgggagttaacccaacttcgtacgttatgcttaggccctcaatcggccaaatgtcctaatccgtcatttccgacttttaggataccgattagtggccttctttttgttaatcggtgtattaaggctccaacggcctattttcccaatccgtcgttttgatttggggaatccgattgggaagtcacttactttcggcaaatttcgttaaggctccaacggccgtatatcttaatctgcctttttcgacctttaaggttccgattaggattttacccagtttcgtacgtaggtttcgataaggcccccaatcggccgaatgtcctaatccgtcgtcttcgacctttaggtgtcgtacgtaggtttcgataaggcccccaatcggccgaatgtcctaatccgtcatcttcgacttttaggactccgattgggagttaacccaacttcgtacgttatgcttaggccctcaatcggccaaatgtcctaatccgtcatttccgacttttaggataccgattagtggccttctcctgttaatcggtgtattaaggctccgacggcctattttcccaatccgtccttttgacttttgggaatccgattaggaggttatttattttcgtgtaaaataaagacaatcgaaaataaaggttaatcgaatccacttgggcatatataactgaattccttatgattttattcatattcgaaacaagatttgcatgacctattggctcgacgtttcccgggttgtacttccccggatcggccaatgaggttcatgatacatctgttaacattacttggcatataagccgtaaataagaactcgccgcccatgatcccgatgacaggctgaagtcctgctaaagggaaacacgtgggctagctgtagtatatcttgagcttgtcggcgttccacgttcgtcggatcggttctccctttagtgtttctagactgtaggccccttgcccgatgttcttgttaattcggtagggtccttcccaatttgctgctaatttgccttctctggcgttcctgtttccgatgtccgctcgtcggagcaccaggtcgccttcttcaaacaaccgtgccttgaccttcctgttgaaccttgtcgccaccctgtttttgttgtgtagatctcggctgtgggccgtctctcggatttcttctatcatgtccaactcggctgctagtgccccttcattatccgcttgttccttattctgctttctccaggacggctggccgatctccacgggtatcatcgcttcacacccgtaggtcattctgaatggggtttcctgtgtagatgtttgtaccgttgtcctgtaggcccacaagacgtagtatagctgttctacccagtttgatcctgcttcatgcattcttttctttagaccgtccaaaattaccttgttggccgcctcggcttggccgttggactgtgggtgttcgacggacgcgaagtgatgtttgatctgtaggcctgctgtcatcgccctgaacttcccgtcggtgaactgggtcccattatccgtcacgatctccgccggtatgccgaatcttgagattatgtttcgctctaagaatttctgaacgcgagctgaggtaattgaagagaggggttctgcttcgatccatttggtgaaatagtccacggctacgatcagccacctcatttgtccttctgtagccttgaacggtcctaataggtccatgccccatttgtggaatggccacggggcggtaattaagtttagttctgatgggggaatctggatcaccttggcgtgtttctggcagctgtcgcatttcctcacatggttctccgcgtctgccttcatcgtcggccaaaagtatcctgctcgtatagctttcaatgccaacgctcttgcccccatgtgctggccgttgataccttcgtgtatttcggtcaggacataaccgactcggtcggattttaaacatagtaatagcggggtgtggaggcctcgccgatataactcaccattcactattacatatgatgcagcgttccttaccagcttcttcgcctccgtttcgccgtccggtactatcccatgctccagatagccgatcaggggctgcctccaatcctcgtcgcctgagatgatcataacgcacgctggccgggatatctctcgctgaatgaccgatctgtggttggcggttcctttggtgctggccagcttggatagaatgtcggccctggcgttttcttctcttgggatatgggcgactatcacctcgtcaaactctgccatgacttctttgaccttaaccaagtatttggccagcaaaggtcctttggtctggtatttaccctcaatctgtgcggcgacaagctgagaatcggtaaagacgttgaccctggtggctccctgttcttttgctagggttagaccggcgaccagtgcttcgtattccgcctgattgttggaggtttggaagttgagttgcagcgattgttccagggatattccttctggattttccacgatgatcccggccccgcttcctttggcgttggacgatccgtcgacgtatactttccacatttggtccggtggatcggtcgatgttggtgttagttccatgatgaaatcggccaaggcttgagacttgatggcctggcgtgcctcgtagtggatgtcgtattcgcttaattggatcgcccaattcatcatccttcccgctaaatctggtttatgtaagacttgtcggatcggctggtttgttcggataactatcgtatgactttggaaatatgggcggagccgtttagccgcagttagcagggcaaaggctaccttctctagcttctggtatctgagctctgcatcttttaagacccggctgatgaagtatatcggatactgggtttttccttcctctctaaccagtgctgcgctgatggcctcgtttccgaccgataagtacaacatgagggtttcgcccgggactggcttggatagtactgggggagcagataagcatgctttgatcttccggagggcttcttcacacatcggattccgtccgatcgttgcttctttttttagcagcttgaagaaaggtagggccttttctgccgatttgggcaaaaatcgggtaagggcggccattcttccggtcagctgctgtacttcctttttgctggtcggcagccgcatgcctagaatggctttgcatttgtctgggtttgcttctatccctcggtgggtgagcataaaccccaagaacttccctgctttgaccccaaacgcgcactttaacgggttgaggcgtatgccgtgctgtctgagtttttggaatgtttcctgcagatcttgaacgtgatccccggctgccgatgtcttagtgatcatatcgtcgatatatacttcgatattccgtccgatttggtcggagaagaccttattcatcattcgttggtatgtagcccctgcgttttttaagccgaatggcatgacctcgtaacagtaatttgcattgatccccctgaacgcggtactttctctgtcggctgggtgcatggggatctgattatagccggagtaagcatccatgaacgacagccaaaggtatccggccgagttgtccaccaattgatcgatgttgggcatcggatatgaatcctttggacaaactttgttcaggtctgtgtagtcgacgcatactctccacttcccattggatttcttcaccatgacgacattggagagccaggtcgtgtactggatttcccttataaagccggcttcgagtagctcgtcgatatgtttctccaaggcctgcttcctatctgggccgagcttcctactcttctgctctaccggcctggatcccgggtgtatggccagcttgtggcagcaaaaggttgggctgatccctggaacctgcgaggctttccaagcgaaaatgtcttggttttccttcaagcatcggactagccgttctctgaacgcggaatccccctggttgcctagttttgtaatctgttcaggatgtgggccgatttggacgtcctctagctcgtcggccggctccggtctccaatcttcggtgtctcgcaaatcgagctcgatcatgttgactggtcttttggtgtcgcctttcatcggctcctctagccgaaggcatggtggatgttggttggttcgtgattctcttactgtgttgtaagagcactgccgtgactctttctggtccccgttgatagtaatgaccttgccgtgatggccgatcatcttcatcttctggtgtttggtggataccatgatatcccatttgtgcagcgtcggtcttcccaagatgatattatattgggacgggaaatcggctaccgtgaaggtcactttgtccgatctgaacccatctttcgttcccagggtgagctgaaggtcgattactcccttcagggtagtggctgagccgttgaatccatagagcatggtctgacagggctttaagtcctcgtctcttaggttcatcctcctgaacgcatctaggctgatgatgttggccgagctgccgttatcgacgtagattcttttgactctgaagttggccacggttccggttatgaccaagccgtcctcgtgtcctggcatcacaccttccatgtcttcgtcggtaaaatatattagcggggcttcgggtttcttggtttcctccttctgtcttcctttgaatcgcggtttctccctcaccgccatcacttccctcaagtatctcttcctttggttggccgaatcgcctcctacgcctggtcctccggtgatgacgttgcattcgaattccggctcagggaactcctctcttctgctcttcttatcttgcttgttttccggtgccgctttcctcttattttgccttccctgtgtctggatgacgtattggcgtagcttgccctcacgtacgaatttttctatggcatccctcagctcccaacattgatcggtggtgtgtccggggccgttgtgaaaatcgcagtatcgggagtagtccaatccttccctcttcagtaatggtgggggtcggtcgactttcctcatgtcggtgaacgccacttcctgccatatctgcccccttggggccgttagtggtgtgtatttatcatacttcaactcatacctgccggttctaggtggtggatcggcattcgatcgtacttgtcgatgtgtagggacggattgccgactatgttgtcccatcggctgcctttcgtgtcgtcggcccctgggcgatgggagtctttttccctcctttggccctgagttgactatctccatctgttctaactcgagatacttcttggaccgcattctgaactcgttcagggacttaactgggtccttgtatattgacttggcgaagcgggatccgccgttgagacctgcggagatcagatggacatgtactttttcttctaacccttgaacctgtagcgctgcttccttgaatcggtccaaataactctgcaatgtctcgcccgccgcttgtctgatctttcctaaggcgaactgcgatttcggctgtcttttgctcgtcgcaaagttcagcaggaacttctgcccaaaatcttcaaagttatgaatagaacgtggaggtaatgagtgcaaccatacctgggccgctcctgttaacgtggtagcgaagattctcgatatgatcggctcgtcgatgcccctgacgcacatctgcatatcgaactcgtcgatgtgtatttgtgggtcttggctcccatcatactttgacaagaatgatccgtcgaaatcttccaggtattgggcgtcgactatgtggtcggcaaatgggctgttgttctgatggcctcggcggtatttcctctggtaggttcctctggtcggtcccgtccttgcctgcttgtccgtcaccgggtttggtgcaacgtccgagtgtatcagacgcgcctccaagggcgttttttcccgttctgccctgtcctcatttctcgttccgacggggattagcggtactgacctcggcgctccgtgcgacccatggatgtcctggctgtttgttttgttggtatcctggcgtcgcacctcctccctctgtctgtagtccctttcctcgaactgggtggtgatgcgttggagatcctcctgtcgctggagttcgtatcgtttctccaaattctccattctggtaagtagggtctggagagcgctttgtatgaaacgctgggaagcgtcatgctgaacttcttggagtgcaccttctgggggtggcatgtctggccccctgggggatgaatccgtgtgtgaaagggcattttccaccagcacgttttctcgtcgatcccccctgggtggttctccattcctttccgcctggtgtctccttgtgttagccattgatgataggtgggaatcgaagtttatcgtttcccacagacggcgccaatgttctgttatgtgataacagagttgtccggtggtatcaccggtggtgtttgtatgtaggacctgactcttcccggttagtctatggtgatcagaccaacgacagaagacgagatcacggacacgggagcaatgggggtgctgtgtgtgccgtgtgaaattgagagaggagggccagagtccattatgcgtacctttcaccgtcgagtgtttctgccttataacctttcgtccaggccggaaatgaggcattctgtctccgggattgtagccgtcgagtcctctccccttgtgcctgcaacgaggatcacgggtcatcggccggtaactgctcctgcgtcatcgaggggaatccctgattgcgcgggttcattaacgaggaggatatgggagcatatccgtaacaaaaataaaaccagcaaatgggtaacaatatcaatggtggtcagcctagatccatcttgctgttgcctgagaatccattgatacaatttctcctgtgaagaaatggaagcagcgttattcacataaccaaatcctcaacagcgagcaaagttcaaacacatcaaattgggaaatttaaacagcggtgaagtcacttcagaaacaaattactatgaattagtaaaaccagagactgacggaaaacaaaatctgaaatcaattattcacaataaccctaaaaccgtaaacatcaattgaataaaaaaggagcgtgctttcgttcaaggtgggtgcgtgtgcatatttgcagtttaattaattattttttaaacgaaacgacggaagagattacaagagcgtgtcgttcaccagcctggaatgaaagtttttgttggttcatggcgtgggtgtagagatgagagagggagttggcggtgctgcagaaagtcgagtacatcgttcgatccacttcgtcaaggcgcgtggccaccgaccttcgcttcttcgccatcccaatggcggatttagagtaaggaaggacactataaaatgtgtgttagagagaggaaaaacaaacaaaccaaagggaacgcgatatgatatacttctactacgaatgaatgaacgaacaaaggaatttacttacgctgtacagagacgatacaagtggcgtccacgtggcgcctcttgccgcttttctcttctacttgctcttttttcgctctcaaaatccaaactataattgcactgcaccctgcaaaaattgaaactttacgggcttgtttggtatggagtttttttctctcgggtcaaatgtgaaagcttattctagtcaacttgatttgtgaataatttaatgataattttataatttaatattaaatttttatctttcagaataattaatttattattatctcacatttacatagatcaaaatgaatatttattcgtaagtaaaaatgattttattttaaaattaagtttgactaaaaataaaaataatacattatattctattgaaaagtttacattaatttttatagcaatttttttagaataaaaaatagtcaaacattaatttattttatacaataaatttggttaataattatttaaatatacatttagtcaattttgattgattgtcatttataataataattataagtcatttgactttttttaatgaaattttgacttttaactatatatagatataatcatttaattggttgatgatatattcattttgataaacatggctcaaaaaaatattgtttatcaatgtgatcaaaattaggaaattaataagatcaatgaatttaatttggatcttgaaaaaaatagcaatttaagtattaaattttaaaaataataataattttttcattaagaatatacttattattattattagtgccaaaaatcacttttacctatatatagttgagtataatttattttaaaagatgtaactattattagaagctaaaataaaatgatgcagtgattataataaaagataaaaacatccagaataaatatgataccaaatgaaatttttctctttataatacttatatattattactattattattataataacagtttgaatcttcaccataaatataatatttgtcatcttttattataatcattgtcttgatacaaagtataaaaccattcatagtatattttttaagttagtaaatgatttgtcacgttaaggaaatatttgtcgatattattttagaagaaataagtacttatttttaaaaattaattatttttcaaagtaaagtgaaatacagtaatacacgttgagatatttataaatgaaagtattttttagagagaaaaaagtaagataataatcataatttaattaaaataataattatatttcttggttaaaatgttgattgatcttattatttcaagtctttatgtgtttatgtatttgagcatgaagattgcatatcttttcggtcaaatgttcatcattcttattactttaaatctcgttgtacttacttgtttgaagttgaaagattatgtacccttccaattcttgttagattgaccaacctaagactcattgtctcatatacctaacaatttgacccaaatacaatgttattataatgttattatatgactcacactagacctaaaaagcatgacacatcacactttcaccattaaatattattgaattaggttttttcattgaaagccaccatctaactgcattaaaagtaatcaaggataataattataaaatttttattatttttatattatatatttattgttttattatcatatattatgttatattaatatacatttgatttatctctcaaaaaatatagattttattttttcaatatgttttgaagattcatttcaatattatcactctcaagtgagaaatgaatttaatattaacagaactattatgttatggttttaattttttacaccacaagtatttgttaatttaactaattgtagcaaataaaattcaagttactgtattatattattatatacataaaataaaaaatacaataatgaaattattttttaacatttaaatcatttatttttttattaataagaattttatttattttaattttaaaatatgtttctaataataataattaaaaataaggatatttaaatatttttaggaaaatttaagaaatatgtaaaagttatttaaagtttattatgtaatttttaaaaatcttaattacttaacaaaaatgtctcatgttatattagaaaaaaattattatttaaaaagatataaaataatttttataaaacctctttcaaataaaaaattgttttatactgataggaaaaataaatatttattcatatgtctgtataaatattgtattaacagtactaaaaaatgatctttgtggaacttctcttttaaaaaaatgatttcacaataacgaatatattcattgaattataaaatacaaaaaaaaaaagtatttttaacctaacgttgattttaaacaacaaaaagtaaaaaaaaaaaaaaaaaaaaagcaaaaaatcaagggaagtaaaatgaagaaataacagggtgtcgggttcgggcacccattttggcatggccgcatgggttccgtttgaggaaaataaattctaaaataatgtggaggggtttgggaaaaatagggcacaacacaacacaaaagtcacaataacaaatctgggtatagtggagtagggtttttttgcgtttgagagaagcatgagcaggagtttgggaattccggtgaagctgctccacgaggcttcagggcacgtggtgacggtggagctcaagagcggagaactctacagaggcagcatgatcgagtgcgaggacaactggaactgtcaactcgagagcatcacctacactgccaaggttctcttctttcttaccctactttttattttgttttattttatttttacgccaaatatggtttaattcacgattgtactgcgaaacatgtcgtcaatcgagggtttaaggttaggaaatgcaagtttaaattgggtattgttaggtccaggaatttgaggtaagttagcgtgtgtttgggacagcggcaaaacatgtataattaaatattgctagaatatattgcaatcagaatcagtttttatttgggtaaatttgctgaaaagcaggtttaagataattaatttcacttggatacaaaaaaaaaaaaaaaaaagcttttgggaaaagaagttgttggaaaataatcgtaagtttcaactttttagaaaaatgtaatgacagtcttatgccttagttgctgagtttctttgaagttaagagaggactgtgcacaagtggagattggggcatggatgttgggaatgaataattatagaataagggtgtaaggcttagaccatttgtgtatgcaagatccattggaccttggggggcaacatctgctatatatatgttttcaacatctgctatatatatgttttactatgtctgttctttggtctctcttacggggattacttggatttaggtttcaggagttattagtttgggaaatgtccaagtgttaaccttggagtgatgcactttctactgttccgttttgaactgtttttggtgggatataatgactctggatataggagaagcttgtgaaattgtgtttttgttaaattttagatgttgtagagatgtttagtatctccaacttcaagtatatttgttaagacatgcaggtaattcatattagttgctgatattggctaaattcttttcaggatggcaaaacatcgcaacttgagcatgtgtttattcgaggcagcaaagtcaggtatgaatcacatgtttctcggtgactttttaattttatatacaatcttgtaaggttttatacctcaatcatgtgttgtttggtaagtttaaatttttatattctgaataaggttatgtttgtagattgcattctgtaaggacagtgattttgacatgataagaatttgacaggtttatggtcatcccagacatgctgaagaatgctcctatgtttaagcgtttggatgcaagaatcaaggtaccttcttatttccaagttattaagtactccatattcgtttttttgtgtgcttttgaattttatgctttctgaacctcttgaagggcaagggtgcatcacttggtgttggtaggggcagagcagttgcaatgcgagcaaaggtacttatctcccctttttcttaattattagagatagatttagccttaaaaaattgctttttcaatatcctgctagttaaggacctaccctgtggcatgtataactccatatattgcttctgtaggctcaagctgctgggcgtggagctgcacctggaaggggtgtaccaccagtgcggaggtgatcaccattcatatattctgtattctccctgtctgttggacatgtttatgtgagaaagaaattcgaacagaaactgcgtatcaagactttacagattactctttatggatagtacttgatcccaaatttgttctcatcacctctagtattctgatctgcactgtgtactacttggctaggaggattttctgtaaggaatatttgttaaaatggtacaagatagtatcagttacgtaggggcagtttgacaactgttaatgctggtttagaactgttcgtggtaattatgactcgtttgaaactgtggagattttgtgtttgtttttaacaactgttttgtaaatagttttgaaaaaccatttttaagaaaagaaaaaagacaatctggttgataacagttttcacttgcactccttctccacacatccaaacctctattgatctctcctggtcactgcactatcatgtcttggacgatcaatatcgaaccagtaagctccaatatgccgaactagtaattgccaaatatcacgccaatagccaatcaccttcatactcgcccgttggacccttttgtgcttaattaatcatcaatgtattgcctcgttttgaattatgcttggtttttgatatatatcggatttttgattaaaaaattcttcgtatttgttttttgatatttgaaaagttttgttttaaggttttattgttagttaattgatgttatatttattaaaatttgataacgtgatttgtaactattcaaaatcttaattttaattttaatattttttaataaattatagtcaaaataatattagaatcattcaattaaataaccatattgtacaataggacttggtttaagtggtgatatacttgagcctcttaagcaagtgcttagaggtttcaatcttgatattgtgtgtggagaaaatctagttaggaaaagacaattcagctttgagtgctttcaattttggatatttaaaggtgattagtcttgataaatgataaaaaatctaatgaatgaaaaaaaaaaaaaaaaacttgtcttctacttctgtattgctgtttgataaagtgtagaaataaagttgtgaatacgtgtattaaataaaatgcctattattttaaaatttatagttatgttcttaaaaaataatattgttaaaactcagttaaatataaaatataatgtaaaataaaaaaagacttcaaaaccacaaataaatcagtatttcaaaatgatatattttatcctacaataatatagtttttaaaatgacacttcaatgcttcaaactttaatattttatcttacgtacataatttaaatttaattgagaaaacaccattcaattttacacataaaataaactgaatcagaatattctttataataggcatttctcatcttcttctccagggtttaacctatgcattgcctgatgcattaaaaatcaaaaagaaaatcaagatgatcacatgattgatacattgtaacttctctttttaacctgtctgaaaatttcttttcaaccatcagaaaacccactttgatttgagaaaaaggaaataaaaggacagaagaattcatcgacgctaataaacacatcatggacaaattcaaaaggcatagaaggaaaatgacctaaaagctgtccttactccttatatggcactgaccaacgccccaacctaacaccagaaataagagagagaagtttttaatttaaactgattaatttagatacttatttgcgtttctgatacgattaatattctttggtttgttcgtaaagaaagatgaattatttaaccacctctctgaatcacaagattaatttcatatatatttttgttagaaggttacatatatgagacaattttatttgacttgactaaaattaatgtggacaataaaattcgctcttcaagtattaacataattataaaatttgaatctgacatcattattcaataatggttaagttaaaaattaaaacaatctcgaatcaattaattagtcgaactcaaaaaaggaaaaagaaattttgatgagctattttcttttagtttgacagcaacaaaatcagattctatccattaataaagaattgtgaataaaatgagaaattacatgtaagatatttttggtaaattagtttgtttcctaacaaattaaattgtgtaggagggatcgatacaatctcataacatctctaatttgattaatgatcaatgcgtatactctgacaaatccctaatcagattttacgaagagtgctaataatttatttattaatatacacttttaacattttttttttataattaatgtataaaatgtgaaacccaaaaaaattgatttttttaagcacttccttattttttcttatacacttcctccttttctttttttgtttctttctttccgcactacccatcagtgatgtctctcctaaacgtgcataaaaacaaagacagaaaatagaataataataatttattattataatctctcttaaaataaaacccccatccagcaagcacagccacaattatttgtctgacaggccataaccttaattttaaggtaacaataaactaccagcagcagcgatggacatgtaacatgcacatacgtagtactatttttgatttcattgccagaatgattaaaatatcaaactttgtgttgctaccacgtacaatgcaacgttagtggtggtgtgcacaaaattgaccattgttctttatgacattgcgtttacgctgctgttccagcttccttccctaactcaacctcactgagtgaaaaaaaaagacgttacaaaagcgcacacgatttttcaagagccaaacagagtgccctaaattcaagcgcaacgagtcaaacaaacaaagagagaagaaaaagaagcaaagtacaaaaccaccgaactcggctctttgtagtttttctctctttatataaacttgtcttctctcataaactcccctcactttttcttcctcctctcctctcaccacctacgtcgtttcgggtgagtaccagcttctccttttggcaattgtcgtcttcggtgattcctatagtttcttcattgaattcggtttagcgtgactttttcttcaagttattattattattattatttcatttttggtgttaattgcggttgatattattgtgtgttgggaattattgcagtttcatgattctgttcctcggaattggactgtattgtgatttgctatgaatagaaaggagtaatggatctaatgaggattttgctattcggctttgatttcattttttacaactattatttggtttctttgtctctttgtgtgtgtgtgttttaagttattacttgaattctgtgtaagtttgagaatgttggattttatggcaaactgagcttcaaggttcattcccggtccttgtaatctacatcagctttctctctctctctctctctctctgtgttggttttatacctagaatcaattgttttgttcatagacttggtctgacactactcaaaaatcaatttctcgttcaaattctttgaagtgttgaaaattatttccgaaataaatgtttttaagaaccaaaaaaacagaagcaactgggaaatattttctcatcttcttctttgagtattctgtttaagtgtgcacaagagacagatttttagaaaacacaaatgtgctcagggaacaaacaatttcaaatacgccaaggacacaaacaaattttagaaaatagaaaactgtttttgaaaataataaacaaagccagcctaaaattagacattgtttctccttttctttatttattttttaaatagtatcagtatgggagtttaacttctttcgttggaatctgtgctgcttctgatgacatgtgttcgcatgcagataaagccattgaacatgtcttcagcaaccaagggtgatagaaagactgcacttgatgtggcatcatggatgttcaatatagtcacatctgtgggaataatccttgtgaataaagccctcatggctacatatggtttcagctttggtatacagtttcttgaccctttcccatcctagataatttactccacttccattttattttaaatgtgcaaatgctcactgcttgcaatgcattcgttgagtctatcttttagtgctcgtgtgcagcataagcttggtcttaggatttaaaacaaaagtatttaatatattaagggaataagggtggtagttgaattggggtcgagtatggtatcagcgatgttatttatagacaacagtactacctatgatagaaatagggataaaaagaaaaaaatgaggaagggtaatgatctatgttatgatttcagatgatatgctgatgctgtacggtcctcacacttttttgtatttgcgactcacagataaagcataagtagagctactttggagtttgaataaatttatcaacaagtacttataagctgaaaaagctaatccgaactggaccctaaaccaattactatattcacttaaattgatggtattaaaaaagctaccagtttttctaaacttcagagggcacaggaagaagacacttatagccaaaaatatttattgttgtgttcaagataggcatacaaagttttcacccggaaaactattttaaacatcttatttgcaagactttagtattcggattgattagtattattggttgtatatatcccagagttacgataggcaagcgccgagaataacactccataattgatttgagtctcttgtataactagttcaccaaagaagaatgtaattttatggtttctctgattccaggtaatagattacttttgagctcctacactactcctgagttctaacattgtaaatcataactattatgcagctacaacgttaactggtctgcattttgccacaacaaccttgctgacagtctttcttaagtggctgggatatgtccaaacctctcaccttcccttacctgatctcatcaaatttgtcttatttgcaaatttctctattgtcggcatgaatgtgagtttgatgtggaattctgtcggtttctatcaggtaactagatttaaaataaaataaaattgaaagtataaaattttaacactgccagtgacaaagataggcatttatagtgtttccttcctttgaaatgaaaacttcagattgctaagctgagtatgattccagtatcttgtttcctggaagttatcttggacaacgtgcggtattcaagggacacaaaaattagcatttctctagttctccttggggttgctgtatgtacagtcactgacgtgagtgtcaatgctaagggttttatagctgctgcagtggcagtttggagcacctcactacagcagtatgtaagtaacatactactaaaactatctatatccactctcaatcttatttggtagattgcagtagatcaaaattgaatttattgtcataaaggtggttctagaattgatgaatgtgcactttcaggtgcaagaatgcttgttgctaatattcatgtatgttagaatttactcatctcatctaattatatatctaaaactgccaaaatgggaagcctgcaggctgcatttcagtaacttatgtcagatcattctgattctagtttctgctgttttatttgggtgtcatgacctagatttcttttagatgatattttacttctattttgtgcagtatgtgcattttcttcagaggaagtactctcttggatcgtttaacttgttgggccacactgcaccagtacaggcagcaagtttactactagtaggtccctttttggactattggctgacaaacaaacgagttgacgcctacaactatggtttcacatctactgtaagtttctctttgtggaattacatgctttatagacttttgccaaataccgtgaattttgccatttgctctgccaaactccagtgccaaatactacaattcattcatgtctttctctgtttctgattcactgtagcatatgtttagttcaactgtaattttccagtaccattatttagtatcaccatataaaagtcttgggcacatatctgttcctactcttccagaatgtttagagttgaaaatcaagatcctgaaaagtcacgtataattgtcttattttgctctagccttgcactgcttgaaacatttcctaatcctcaaaatttttaagcacatgacatgaaaattttcacccagcacttagatactgactgatagtcttctctttgcattattaacgagaccaatctagtcaatcaaaatataattgtcaacgtgtctatctatacaatgttgtaaaagacacattggcagatgcagaattatccatgatgtagttctactcttcatctgcataccggcaacatgcatagttgcatacaacactttttgtttttcggacctaaattcagctcttctttatattcatattcataaactttgtgctagcttgactttttgtctataggattaaaatcaaatttaactatattgagaaagacaaaaattatattttacccaacaaattatttattgaggaacacatttgccaaatccgacattttatctcccaaaaaagactgacattttcctaggaaaagaagaggcatttaatgttaagggtcctactaactagtgtcttaagggcactggttaaagtattcaaaatagaaagtttttattggaatttatgttggaaatgcactggaaatcattttctattttgaattccatatgcattggccttagcctaatgttaactttacaatagtactatattgaactaatctgcttcttctgtttgcagttgttcatcattatctcttgcaccatcgcagtagggacaaacctcagtcagttcatctgcattggcaggttcaccgctgtatctttccaagtccttggacacatgaagactattctggtactggcattaggattcgttttcttcggaaaagaaggtctcaatttacaagtcattctgggcatgaccattgccatagcgggaatgatatggtatggcaatgcatcttctaagccaggagggaaggaacgtcttagcttacccattaaccataccaccaacaagacacaagagtataatgtactaccagtgtcctctgaaacggatcaggaaatatagaagtttatgtaaataaagtggtgaatagcatgggaaaatcaggtgccctctaggacagctgattcattttctttataagaaggaatttcccaattactgatagatacatacgtggtcatatatctgtgctttgtgttacggagttgagggaggacacatcgaatggtttcaacttccgttaaagataaaaaaaaaaaaaaagaatttggatattttcacacagcctctctctctgcttacttacagggtttacaaaactgaaaatttgtgtcctacgcaatgaaaaatgacttattgtcacagtttttagaaaaatgaaaattaatttctagtccttcagataatttgcataaaagttactataaatcacgttactttaaaactgattttaatcaaaataaatttccttattaaaaatcaagtttgccgacacttactcatgcatatactaaacttactttcaagttttaaatacaaatgacaatagatagaatctgattaggatattatagtatcgattttcatatctatattttaaagagatgaaagatcacaacgaaataaaagtgagaactaaagtattagttttcttactgtaaaaaaaatattagttttctaaacaatttattttagaagaagaattgaattttaattatttttgtaaaatatatttttagtgtaagtagattattttaatattttacaaattactcatggatggaaaaaatcatttttattttaatttatttttagtataaattttaatcttgagattgggaatttaaaataaataggtatttttatataaaaaaaagtaaataaatttttttataagaagtgattcacttgaaatatgttagcaattaaatgtgaatccccctttttttgcttaatttttttataataaaaagttaattaaaaattgatagataaatctaaaataaacagttttttggtggaaaaaaataaacagttgattaaagatgaattctgttatttattattcttaagatgatgattaaaaattaataattttttaaaaacaacataatatcattaaacattatgtttttttcaataaaacttttcaattttaatttcttaattgctaactttcaaaaaaaatgtacttaaatttcttcttatttcaatttattaatttaaattgatgaacgttgtaacgtttttcttctccaaagacaaattaggttttcaaaacaaatcagaaaaccccaatctatcgtgtcttggctcttcttcaccttcagtcttcactcacgcgcgccatcttttcagtcgccaccactccacgcccacgtgagtttcccaatctcattcctctcgaatatgattaatcccttatgttgctattgttactcttagattcgcatgaaattgcgttttcaaatttcaactggtaggttttgttgctatggatctaacttgggtttatttagtgccacgactttcgtttccttgtctttttgtcactgaattagttaattggacttttttcaccaatgatgcgtgtcgagagtagcgttcttcttgctcattcgatgttgagctttctcagaaacatgattattctcacctttgtgggagtgaaagagaaagaaaaagagtatcacgagtcatactgtcatagagagatatttcatttaattttttaatatgtttatatatctctttgtttaaaaaatggatggaatttggaaaatagttactcagagaaaaacaaagggaggtgaagtgtgtcaaatttatgacagagtggggtttactgtttctgagctgaaccacgaagagctaactgaattttaccagtaaaatatttatttattaattatgtgttaatctcgtgtatttatataaccaaggacaaaattccacacaagctaaacataagaaatttttaagatgaaaaacacagattttcttgatgaaactattttttttaattctagtatttatattgttaaattctgtggcatgggaaatgaagcctaatcaagtgctcattttatttggtgctgtttcattcaatttatgtgtataatagctactggagaatttttgttaatcctatctttctcccatggcaggctgagaaaaggaatatgggtgatcggcaagtagttgaccaacagcacacgggtgatccacaactgccatcttctcctccctcaaaggatgatatggtttcatgtgttatggctttggaggctgctttgcttccctgtttgccagccagagaacttcaagcaatagaccgttctccccacccctcacatcaaagtgggtaactgcaagtatttcaaattttgattttgcattttcaatactggctgctacgctctgctattcaagatcgataactatgcatcaaccatgagcactaaatggcctttgaaactttatttaattatccgacattctgatctcgtgtcaattaaagcttttaggaattacagtcagaggtttttcttcatgcatacatagtgcttaaattaacaataaaatggcttaggagatcaaggaaagatatgtctactactttatcttaacatttgaggaattgaatcaactggaaaagcatattcattttgttgataaaagttgatggaaattggaaaatagtgttactcagaaaaaaacagggaggtgaagtgtgtcaaattttatggggacatatcttctaaagtgtgttacattttatattaagcatattcatttaattcagttgttgatggattattcaatgtgcaagtatgtgcacattgattatctagggcaggaaggtggggtggggagggaagaagggtggtaaaatgttcatatagatgatcatgcagttgataagtaaattttaaagaaatatgtttacatcaataaccgttggtttgataattataatcttagaaacgagctcaataatcctagaaatgagtgaaaatgccataaactgatgtctgatctttggatgaagtttagctttaatctatgtccgtttttcataattccatatattattggggggcataggtgaaggttactaaagctcctatggattatggcagtcttcccatcttctggtttgaatgcaaagttggaactttttcatatataacatgtatcacaagaaccatagtgctgaagttattgaagttaataaaaaatgatcaggtcactgacaagaccatatttaagtttaacagcatttgcaagactaattaaggttcaattatgtccctgggctttaatttacagcaagaagggaaatctcttctttgctcaagtcctgtgttggaaactatatttgcaaaatggttttctcatctagcaatgcatggtaaatttaaccatgtatccaactgaactttcccgccttggtatttctttttttcagttgatgtggataggtatgcaagagactttatggaggctgccaagaagcttcagctttattttatcagcctgcaacgtgaggataagccaacaaaagttgaaatgcttagaaaggtatggcagttcattatgaaatgtttttaatcagttatggagactaatatatattttttcatctaaactaattctatttgtcttatttatgcaggagattgctctgatggaagaggaacttaacataaagaatgagctgataaaaaaacaagaaaatttaattcaggagtggaaaaaagagttgaaagatcagttggacaaacacaagattgagttggatagggtttagacgtttagtgtatgcttgtgctcctatgctctctacatatttaaagactcggtgccacatttgtggcatattttctttctcttcctctatagtctttattaattattattgctcatcccatagcatgaaatcatgaatccaaccacacttaactggctgcgaataggtgtgcgattagattgattttaagaatatatgatcattcaaaccaaattaattaaatttatttagtttaattaatttggttagttagctcattttatttttgaaataaattgaattaaatgtcattaagtttttatattttattttcaatttaaattaaatctattaaaatttacttcgctgtcagattatagttattttcaacttggtcacttttttattattattttggatttttcctttacttttgtatgtaactttggttatgcttactattcaaatttatcatattttaaacctagaaattaataagttgtaaagtttataattgtagaaaaatttatattagaagttaatttgaattgatttgatttggattttaaatcatatttcaaattggtttgatctggattaattgaagaaaaaatggaagttaaattaaattgactccattaaatatgattggtatgaaatttgggtcacaataaagttaaacccgagaaacctgtgaatattcaaacatgaactgttagactggatattcagaaattagctggctaaattagacgccaaaggtctattcatccatgatggattatcagaaaggtgaactgaaggaggttgcaaaagctatagccgaaaagcattgtcttagcttctgatattgtgacacactattaatttattctttgaaattgttggatgctaaattaatttttaaaacaatttaatttctaaaataatatatgaaaattgaagatggtcaatcaaattagttttgcaactatcactttcagttaattaataacgtcaaatacactaatatgatgcattgtttagctagtgttcatgagtcatgttagctcacacatggagggtttgtcgtacgaaataattattttagtctctaaattgaaaatcgtggattatgttgatccaattgtcattcctaagaaactaagtagtatgttaattgccctattgactccaacattgacccacgcgtgacagttgagtcacacagtattttttgttgttgtcttttacggtattcacatttctcctcctcttcttccttcaattcaaaaacatcccttaaactctagaattagcaaaatcaaagctataagagaaacaatatagaagtgatgataatgaacaacgtagggccaatcaagacaatagaaaaagacaagtgtgtcttaaagtgcatttgcaagctcaaatcaataactaaaaacaagatctgtaatttacaattttgttatggtagtttaagagcagttgtgcaatactctagcagtcagagaacctaaaaagaaccttttataagtacatatattctaaatatattaacactgtgaatatcattatatagtatattaatactagtatatttttatccaataaaataaacaattatttttaaaaaaattaaaatatgtaatttcatcatattatttgatgataataatatttatatcccttacatacttattcattaaaatttataaatatctgtacactgcaaaaatacgctaataataataacagataaatgacatagcagaccaacagaaggaaatgcagattttattgggcacggaaaataaaaagaccccaaactgaaaaattatactctcaataatcttttttttacgtcttcctacataataaatactttgttagttccttaattaataatttaagaaaatgattggatcgaaaaaaaatctcatgattacaattgtacataaaagaacagtagtattgagataagaagaagaaaagcgaaacaaaatatcagacgccaagaagaaagaaaagagaaattaaaaaaaaaaaaatcgcgcaaggcattaacatgcgcttttttatcatgatacgtgggtctgtgtccctctaatttcaagatccaccacattctcagtccttctctggtcgaaggtttgttctctccaataccgcaggtagtttcttcaatcatagtttgtcttcttctttttttgttaattttgctatgtatttatgtatttctgtcatttacatctgtgagtgtttctgttgataatttatttgagatatgtcatgttatgtttttttttcctattaaacttttttagctctgagctctggttaatttacgtagtttttttttttcttcctttgcaaactgttttggaattatgtgtgtatgaatgaattgaattgattttggggtagtttcggcttagtgaatgttaattctcaattttatactttgcaaactgtttttcctaaagtcgatttgaacattcgttttgtgatgttttggtttttgtcctaccgtttctgggtttgttaaaagtaaattttagatatggcttcactttaaactatttcttccctctacaaaattggaagttactgatattagttagaaaaataattaggaaacaacaaatatagctgcagccaatgctccaaaacatatttcaataaagtagtaaaatttttaggaaagaaataaaaacttatcttcttttaagaatagataaaaactggttttactacttttttgtgctgccttactctctcaagaggaaagatatatatagagcagaaaaacacaacgcaacaccagtcagacaaaaactgaaacaaccactgaggcactaacttgcaaatatacttgtaacgttaagaaaataataacagaacaataaaatctccttatagtgcaaaggcctataacgttaagaaaaacaaaataatttgactaagtaaaactaaaacttcctaaaagataggaatggaagaagatactggggtacttttagttttacggaaaaaaataatctgaaaacatatttgatctttaaaaaacgaagctaattaagaaatattttttttttaacttttaaattttaaattataataaaaatattttccaacatcttgcaatctatatttggttgaaattactatgtccatgtcattcaattatgctgaattctgcttaagtagttctcacaggtgtaatctaaatgcactatacaggaagcaaaatttaagctggtacagtttctttctataaagcagcatgtccctgggtacttccaaagcagtttttcaggttctgtccagggctgtgcctcaaactgggtataatgattctcttgtgaactcttcagatttagcattacattcccagtttcgagtaaaatgtatgaagaaaagatcttccaggcatagggatttcattgagtgttctagcatgcttcaaagtaggctaagaactcaacaatttcagtggatgggtgtcagtttccaaaactataagacctatagtcgtccatggttgcacacatgcaaatgccaacgggctgaaagtgtgagtgggataactacaggagatggaaatggatcgagacttgtgaatgatgttgaaacaacaaattcgttaagcaatgggatgagtgcaaagcatatcctagagtttgaagatgtccaagcccaacagttgaaacaggaaaaggaggttttggcatctaatgttacaaatggatctattaaaggcagctttaacacaattgacctcaactccatcgaggaagaagcatgggatctactaagggagtctgtagtttattattgtggcaatcccattggaactattgctgccaaggacccaaccagttccaatgttttgaattatgaccaggtctttattcgtgatttcattccttctggaattgccttcctattgaagggggagtatgatattgttcggaattttatcctttatacgcttcagttgcaggtaatgtcttggaatcttggtcttataacacagcatgtgccggtaacagcaaaatttgatacaacttggtcacttacatgccttatatatatatatatatatatatatatatatatatatatattttttttttttttcaattgattatttcgaagttttgttttgcctttacaaagttattcttattaatcagtcattactgttttcaatcctacaaatctaactctagctgtttctccattggcttgtaacttttttggtgaaaatactaattttcttttaagaaacatgctgaaaatgcttgggtttgacaattaatattaatgtgaattgtcacagatagaatgaggtaggaccatctgctgtacataattaatgaaaagggcatgaaattatacttttcattagaaatatttttttagcacttcttttgccttaactgtattataattactttgttgtttctaatatactgtcttgaacccacacatccatatttcagagctgggagaaaactatggattgccatagtccaggacaaggtttgatgcctgctagttttaaggttaggactgttcctttggacggtgatgattgtgcaacagaagaggttttggatcctgactttggagaggcagccattgggcgtgttgctccagttgattcaggtaaaataaataatcaaatcaatagaaatattttcttacatagccgaagagacttaccataactctccttggattgctgaacatatatgtgatctcaggattgtggtggattattttattacgggcatatggaaaatgctctggtgatctatctgttcaggagagagttgatgtgcaaacaggaattaagatgatcttgaagttgtgtcttgctgatggctttgacatgttcccaaccttattagtaactgatggttcttgcatgatagatcggaggatgggaattcatgggcatcctttggagattcaggtaaataagatttcctttctttcttcaattgtatgatgtttgtaaatatgtattttctaaggccaggaatgaaaattttactgtgtattcatgattatacatttgttcagataggagggaatgatgcatttgtgtgcaccattttggctagaagcaagatcaaattgagaacctgcattcctttaacgtgtgattgagttcttttcttttgtttttgggaagagggtagtggtattagtctattagatatttttttatgtatttaaaactcttttttaacagggttggaaaatttaaggtattttcaacttcattttgagtttgaattgattgaagaatgacattaaagtgctggctgaattcatatttgtaggaagcagcaacattcaactatctgatatacattagagttcataaaatcatcattttttggaaaggagtggtgataaataaactaaacaatatcaaaagctaatccatctgaatagtaaatattaaaatgatagcggacataaaaattaaagcaataaattatttaatttacaaaagggatgcatctctttccacagattaaggcttggctggttcatgagtagaggatccctgtggtcttttctattttgaacttttgatatatactcttcaataacagttgattggtacttgatacctaattctgtaagcttagaactaagcattctttccttatcttgactgcccttatggtagtcaagagaaatgaactcttgtaacggattatgggacatggaataaatgcatccatgtgcatgtggattgacaaaaatatgtgaaaaactgacacacgagtttgcacagaagttggactagacaaagctgtgtaatttcacctttctaacagttaattgactaacagttgtaaagccatcagacttctacacctacatctcattcactatgcatgcctttctcaaatgcttttgttcaagtctcatgagaatgttaacagaccgatattgttgctctgctgcatgttttaaatgcaacaatcttttgacaaaataaaattctcagttctggaaaatgagagaatcacgtgataatcacacacaattagagaaacttaaaattaaagatgaaattagtgttcaagtaatcttctctaacttgtattctcttttgctttttgttaatttttctgtttctaggcactgttttattctgccttactttgtgcacgtgagatgcttactccagaggatggatcagctgatcttatacgggcactgaacaatcgtctggtagctctatcatttcatattagagaatactattggattgatttgaaaaaattaaatgagatttaccgttacaagacagaggagtactcatatgatgcagttaataagttcaacatatacccagaccagatttctccttggttagtggaatggatgccaaacaaaggaggctatttaattggcaacctacaaccagctcacatggatttccgatttttttcactgggaaacttgtggtctgtcgtaaacagtttggccacagaggaacaatcacatgccatattggatcttattgaggccaaatggtcagatttggtggcagagatgccattcaagatttgttatcctgcacttgatggtcaggagtggcagttaatcacaggcagtgatcctaagaacacgtacagtatctaatttgctgtgtttgtgtttttctattatcttattatatttttcatcaaataatttttttatttgtttattttttggcaggccgtggtcctaccataatgcaggctcctggccaacactgctctggcaggttagttacagtgacaaattttggtacactcaagtctctctagtcaaagcggttttatttaaagcttttatcctctttttcacctttactattattatagaacttggtttctctaaagtgagtaatttactttagagtaaaataattaatatcagtctttaatgaggaaaacaatggtcaatattacatgtgttgaaatatcaacgattaagattactttacttttactcagttaagaggaaccaaattcattattataatatatcctgtgtacattttcttccatctagacatttaagtgaatgagctttgttgtcttttcttagcagtaaatgtcccgttgacttaatgtacatgtaaaatcctttttcttagtgtacctggtttctttattcaagtattgcaagttggaaatatcaggttcaagtttttaacatgaaatatgcctattgcagctcacggctgcatgcataaagatgaagagaacacatattgctgcaaaaacagttgagattgctgagagacgcatatcaagagacaggtggccagaatattacgacacgaaaagatctcgattcatcggaaagcaatctcgactatatcagacttggtcaatcgcaggataccttgttgcgaagctgctgcttgcagacccaagtaaagcaaacatactgatcactgaagaggattctgaacttgtgaatgccttgattagtgccaaccctagaggaaagcgagggcgcaaaaatttgaggcagacttacattgtatgagtcttcaattgcaattcatttggttcctttgggtcaaattcattattcttctgattattagcagcatgttattcttgccagatacggcaggaatatgcaaaaatatattgtagtttgggttggttgtgatgaaacaaaaatactactatgtatatatatgttaatgtaattgtgaaaagtgatgtcgatactcctggagtcctggtacaagaatgtaagtagcatacaaaatataaccgttaatcatagatgatgaggacttttatactagtaatttctagaggaaaaactagtttcccctgtttgcatcatagaataccatattccgtaaactgccatagtgaattaatttgaactggtaggaaaagtggagtggtaccaatagaattcaaggctagtgactcggagtattggaccgttgagtttgttaagataagtgatatatgctaattgcacccgtctaatcagagatatgccagctatcagtaagaaaaacacgaagagaaaggattggagtgaccttaggatggtttgttacatttttaaagaaaaatatacactatggtttttgttttttttttttttacaaaagtgcaggtgagttgaatttcgagatttatcaagactaggacgacctcaagatttaaaagtgtttatgaagatatcctcacatcatgataagtcatttattggagagtaaaatatacacaagggagtccctattatgaaatttaaggttttattaccatatattggtgaaataaatttgaatacaatctcttgaatgctttccaattaaaaggtcctattaatgattgtcctaagagcaattattaagatgtttttcatttgtttttattgtttaaattattattttggtttctttattttttttataatttgatatctttattattaaaatcttcgatgtggtcttctaatatgcaatgtgattggtcttctaattgcaaaattatatgcaatatgatcatttttagctattttcacattaacaatggtagcctagtctaatgaaaaatgaatatgtgactattacatagaaattaatcatcgttaataaaaaaataaatagaaagtgtcacatttatattatttttttgctggaaattacattgcatatattttaacaagtaaagtaccacattaaatattttagtaatagatggacgaagttgaacaaattaaaaaataaagataccaatagaacaatttagttttttttatttatttgttgtcaagagaaacatttattaataatcatgtgtctatttaaaaaatttaagataatattaattattattatttaagataataatattaactattgtttttatttttattaaatagtacatatattgtttacaaataaaaaatgaataatagtagatgtaatattaggaattttttttagaacagttatattaggaagttaaaattagttttaacaaaaatgattaaatggaaattttatattacatttcatataatttatgtattagacatgtagaaaaggaattaatccatggagtatttaatatgttcactcacttaaaaaaattattaattagattactttagaagtaaaaggttttaattaagatataattcattacattaaaaatactaacatcattttttatctttatttcttaatatcctaaaaaaaattacttttttttacaatgatggaatagagtttgaatctaagattccatacaagcaacacaaatcttcccaccactaaaccaattctagagagttcacatttttttatatttattttctacatttaacattatctcttttggtaacgctacaatcgtgaactttttgaatcggtgcaaatattcaatcttagacaattttctaattaagatgtcttcaaacattttaaatgttttgtacttgtgattattattttcttatgcatgtaattaacttttcatctattttaactctcattctttgttaaattttcaagatctaattcaattagttaaaagatgatataagttgttataaattctttgatatcgtttcaattttcattcattaaattcatttctccttcaatctatatcaaattatcaatatataaaggagatataattttgtgtaactgttttttctctccacattttttatgctattttatctttattcttaataatatttaaatagtaacaataattaatcttctttaattatgcatattaaaattaatccattaaccaaaattaggtaattacttttcacttttattagacaattttatctttaaaccatttcttaaattttaattttttattttaacttacattaatttctcactacttttatattattagtttttttaattctattattttttattaactgtatttaatttctatttttttattacttaaaaattttagagagacacggaattcccctatattttcttcccctatatagagttagttttgttaatttattcaattaattaggaccccttaataagcgcttttatttcttaccatgtaaaagaattcaccttaccaagacaatccaacttgttatatatgactatgaaattaacaattaggtagtaaaaactcattaaatacatggcatgttgagtaccaacaccaccacttagcaaatttagagaaaagtgccacatcaaaattgtaagaatcattggtctttacttcgtttcaatttaatcttttaattcgtacattcacaaatttaattggcgatcaaataatggctacatagcctactcgtcattttccattactatatatttagtgtctaccatctctttctttactcatagttttggaaaggattgagtagctgaaatggagttcttcaaagtgaagctctcggacaccttcaagtccatgaagcaacaggtctttctctaaactccctcaatattcataacatataaaaaaattgttatcaattagtttctagacttatagtgggttgaaagacacccttggttttaatttgttctttaattaaaactaaattttgctgaaagtacgtgaaattgcctcattttgctttatgtttttctccttctaattttatgatagggtttggtggatgatcagttcacttttgtctactcgttgaaaaagaatgtcgaagataatttctacatcgaaattatacctgaattttgctgtgaagttcgagatggcttgaaatttttgacacaaacaatgtaatttttacttctttgttcatacataatatgatatttttattaacaaaatttaagtattgttttataggtacttttctgtgttgtttttaattaaaacacaattacaataatatgtagacatgtttatgttttattgaaaaacagtacaaaaaatgtctataaattaaatatataaacgttgtcttattattatatgctcattatttagttttaaatttgatactttcctctcttttttctttgatgtaggaatgatcaaactttgaactacaaacttatgaaagaatatgtttataaagtcaaaggaagttcttcaaggtaattattttaatatttgcataaaggttacggctctttctcactaaagttagataaagtaaaacgagtatatatattgaactagatttaattctcatacctattttcttcaagcttgtttagtttaatgttagtacttttgcacttttgtttggaaatcttatattgcatagcgagttttattattttcggatgttaatcaatctcttttgaggcgctataatcataagacaaattccaataaactctctaaataatggtcaagatatactattttgaatatttaatcaatttatgtcaaaaaacaaaataaaatatgagatataaaagttctcatttctaactattatttatttgtgtatctcagttttggggcatgtagaatggcaaaagcacttactgactttgaacgcactattgatgcagcctctaaagaagagtaatgaacaccaaaacctatatatatattagatgaacttaaaccctatatttaatagcatatattcaataaacaaaacaaaaacaaaaaactccatggaacattttaaacaaaaatctctttctttgtaggtgttcgaaggcactgaaacaagttcaacgtgaattttctgctctagaagaaaaacttcatatttgccttaaggtaattattttgtacatatttttcagttaatagtaactcatgaataatatgcacatatttgttccttgtcaatataagtttgattgtgttacattaaaatacattgtttccacgagaacattacagctaaatctacaagattagacttgacactattacttaagggttgctttgaggtgtgttattaattttattaaataagtctattagagaatgaacgaatatttgaattgtttaaattgaggagactaagactagtcaaaagtctttttacatagataaaatgttagtattaacacataaatgtttttaatttcaactgatagtgcaaagtattttcatattcccttctggtttgtgatccttctagtgttttggttactatgtacaattgtcttcttagtctatcacttttaattagaaaattgcattgatattgtatcatctttattatgtacttattgtgaaaactttttttgttacagcttgaaagaagtttagttctcaaagctattgagggaacggccaatatgtgagagtcatgttttgtgtaaatcaatttattcaaatcaatatgaatagattgattttttgtttttctttgtagcaaagatattgcgtttggtttaaaatattgatatcgatctacatgaattatgccaaaatattattattgcaattagttttgtatttgaatataatctccattttatattatatgttaattcgagtctcattaatcaaaatatatgttcaaacaccacctttgttatcaatttgaagggattatgtgagagtcaatttgatatggttttattgacaagaatatatatatatatatatatatatatatagagagagagagagagagagagagagagagagagaatgcattgatatcacttcagttttttaatacatagatagatagtaactaaaatattcaaaagtttttttttctcctttttttatgttttcatgagtaattataatattttaaaaattaatttagatttttacattatagctaactattttcatacaaatatcatagataaaattatcgttggtgagctaccgcgagcatgttaattataattttgggtgagggggttccttggaaaataattaatgaacatccatatattatttaatacctagagagataaagaaagagaaatatatatatatatatatatatatatatgataaatattatatgataaaaagagaaaaatgagtattatcatatttataatagagatgtgttcatgtatcactactccaattccttttatgtgttgcagccgagcttggttatcagctagcatatttattcgagcatttgttgggcgcaaggaaaacaatattcataattagttgaagatcaatgagttactatatgacgttgaatttccttgattttagcagttatggtttgtttttagtacaggtaagtaaggtataaatgtaacaaaaatgttaattaacaacacgctcttacattcctcacatactatataaatgtaagataatcttgttagcattgttatttttgtaaacttgttttttactcaatgggttgaatactctttcaattcttaccaaaaaatataaaactatagacgttatttttctgacaaaatctgcattgctaacataaactattgtgagttttatgtgttaataatgttaatagtatatgatgcaatattaaattaatagataatgcagttattatatatatatatatatatatatatatatgtatgtatgtatattatcattcatagtatcagtataatatatttagtgtaaatccacaatcattacactttagtgattcatttagtttaagcccacaatgattattcatttaatccgtacaccaatacacaagctaaatgcgtggtatatataaaaatagaaaaatcaaatacactctcatggtgtgcttggaagtgatgaaaacccgggaataatggatgtagaatatcgtgcattttataaatacattgacttcttcctctatacttattcatttttcatctcaacaaagaaaacccttaagaacatatacattttacatgaatattatggttggagtagtctaccataataagaagctatcaagttgagatggaatttgagagtcttcgagatcatttgatggagagtgaacatgtctcccttcaaatgtggttatcaccatccttggatccttggcgaggcgttccacccgtttctttacacgacaattatcttctatgcaacggcaatagcttctacatgcaaatgtagaccaaaacacaataagataacttcatgattcttataaccgttcgatgagttattgtgatcgatggtattgttagagagtgacttttattccaactgatgaaatattcaacctccatggtagtgtgactattaataataaaatatcttcatgctataatcagaatcagtatctaagagttatcaatatcatattaatgaaggcactataaaaaccattttgtatttttttccgaaagtgctttaatgggtttgtgagaaaagcaagagtatcaatgtatcatgatctactcggtgagtgtaaggaaaaagttctagtagacacgtacatttacatatactatgaatcttgccgatggctctttgcaagtcgacattgtaccccggaatagtcagtcaccttggtctgacttagttataacatctgagggtcataattatttagtagttctttaaccttggcaaaattttcttcctatcctttgaacaaatttatatatgctttatatatacattttgaacttgacatataaagtgaacttttgcttttttatatatatctttaattattataggcatccgcacattatttagaaaattaagatcttgccgaaactagtagcaaagccagttatgcgattatgataaaaacaataatgaaagagaggtggcagactggagagagaatatatgttgcaagtgttgggatatacactcgatcatcaaaggtttgatcaatttaacattcttcaatcaacttaaaaattaaagcaaaaacaaaaagagggaagctttgaattcatgatcatacctagggtgatgcgtgctcttcacaactttctgtccatacttcctccacttgtagccatcgtccaatacatccatatcgctcatggtattgaagcaaaacctaggctctctcaccttccttcttgattttcttcatcttcgtggctgaaattccgagatgatgatcatcaaattcacttcttttactgctgaagcaatcagccacttctcccaatgccctaaattcacgcataatggaatcccaactctttttagctatatatagagaatatatgtttctgtgcagaaaaattgttacatgatcctatttcatcatggtcttaattataatcttctcataacatgcaatcaagtactagaattttttaaaaaaattgaaaaactcgattacatgttacttaaaaattaatcagatcaatcataaacatgtagtaatttagaattatctaatatgtttttttctatctaacggttaatgaatttacttaattacatgacaaaaaaaggtcaatgtgcgtggttggatattatgagaatttattaaagtgttattgtctcaccgtggatttacacttaatctatgcaaggataggaattgagctcctccaaagctagaagtgaggtcttctcttgacttttgagcagtggttgagaatagggtttctgctgttaggtttgatgcagaatcttgttgagatatagcaagtgaagaaggtgttatggagattacatcctaatggaaagcaaaaatttataacgttgcaaaaccaactttcccttttttttgctttgcctctttttctttctttggggatttgctcatttttttaagattttattcttttaaaaactaaatttaattagccatgtaattttttttaaaaggttattgtcctatttaactaggcttatttaaaattaagattttcatctatttaataattttaataaagaatatatttttaataggataaacctaattattcaaaattgggtctattcctatccctacttatatgcaatatttttaaaacaataataaaaacattttatttaaatatttcaacacacttagacatacataggctatgtttgtttaggtgagagggagagaaataatattaattctaggtggatagcttttacactttgttttaattaaaatacttttattttaattatctctgttaccatcctctaaagtctaaaccaaataaaacaattgaaaaagatgtgtttaagtatcagatttgtaataatgttttttgttagaagtgtacaaatatgtgcaacttttgtccaatgaatgaattgaatgaagtgtgaaaatttaatctcaaatttattttggttagaaccaactcattttttttaatctttaagtctttctttgggagagagattttagagaggaagggaggaaagggaaaggtttgaataataacatctccttatttgagagttttaatttttgaggaaaagaatttgaggatttttaaaactcattcctccaaatcattaaaattattgtttccccgatttggagatttttagaaggtaaagtaataaaattactatacaaaccattatataattttttcaatttaaaattaagttttatttgtaaaatatagagtgtattagtttttgaagtaaagacaaaattataaaaatatcttattaactctcaattttcctcgtgaataaactttcctctcttttcttcccctcatctccggagactaatttctcaaagaaatagaataccaattaagaaaacacttctcttctcatatgggttgtattattattcacgcgtgtgcatattttttaggaaaaatagccatgtgttggtgtgtaatattaccttgatgttaattttttaactgttaatattttataggtattgagttttatttttaattttcagcacttatttattattataaccgatacagtttagttcatttctattattctgtattctgtattatattttactattttataataaaaaaattactcataatattactaataaggtcaaataaacttttaaaataatacaattaattaaaactagttgaaatattatatcaaacagccactgtattacatgtcacagtgtcatagattgaaaatattattttaataaattttgccacaagatttaacaagttggtaaaaaaaataaatctctcgtcatttaatatctcgaccattgtctaagattcaacaaataatcaacactcatacttactggaaaagtgctaacaatacgtttattgaaatttacaaaattataagtaaaactcatcagataagaaataaaacttataaaaaattataatttttagtaaattttacaataatggagtagctaatgataaaaaatatctttacaaggctatgtttttttttttaaaacgttcaatcatgcactttataaggctatgttaaataatggagttcgtgttttttccccttccccgtataaataaataattcctatattttttgagcaaatatttcctatattattaagagtaaaaataaaaataaaaaaacttacggagttggatcgggcatagaagcacacagtacagtagagaaaccgaaccaaagcgtacaccttccttccttcgtgttccattgcgctaaaactcgctccattctcaactcaaaacctcccttcgcaaaactcaatctcactcactctctctctatatccatgttccatggaaagcaaggattctctattttaatcccttaatcatcgccctactccaggttctatccttttccatttttttctctctcgatttctcctcgatgctattcgaactcgtcgtttcttttttaaataatatttattgaatccggattggtttcgaggctccacgtgtttccgattacaccattcgattccaccaccagcaattcacggctgttttcaataataataataataaaaacaaaaccgtggaaatgaaatagaaacacagacttagcctgttattgctatgctaccgttttttgttatggagaataactcagtcaagtgttttgtattgtgagccatgttagatcattcattacgttcatttattttagtgtttaagttagcgatgaatagttctttggatatttggataactagttgttattattattattattttatttattttaacgatgttttgtttttgtgaatatgcgtttggttgaatcaggaagaaaatggattttcccttgggtagtgaggatccagctatacttcagctgcacaactgggacctgtctgagacccgaattgggctttcggactttcgtgaagcttttctttctcctaccagagagatactgcttttgcattcttatgagagggaggctcttttacttcctctgagtaaaggtgattgctgctttcctttattcgtaattttagtttactgtaactgaatagcgtattttatttttcatgtgcaaatgcaattctgtgtttcggactagttgattattattgttgtttcggactagttgattagtattgtgcatttgctttgttgcttgcaggagagttgcattctggtggtgctgaaggtgactatgattatgagaatcacaacccaggttcagcagatgtttccccggaggcatccactaggcccagtgaatcggttttggtgaatgattcaccttgcacttctgggtcagatactgatgttgatactgatcttgctggaattaaatgttcaaaatccaatagttgcccatacattagtgatgtgaactcgttggcctgggctcgttgtgaggacggctatgatcagcacaatgatgcttcatttagagaagttctatttgtttctgggagatgtggggtaacagtccatgctttttccaaactaacaaaaactaagggaatggttcaacccatgttagagggtaactttaggcaaggcaggtgggtggaatgggggcccattgctacattatcttccgacttcagtcgtggagtctctagagaccagaatgtaaatttgactggagatggtggagttgaattgttaagaggttctgctactaagagatacttagaatcatttttcacaaatgttgaaactactgtatctgatggtagtcttttgaccaaattccctgagaataatgaatttccttgctcgacaaaagtggtttcttttagcatatttgatggcagtctatctttggaccatctcctcaaagaaaaaacagtccaaagtaaggagaattggcaggaaccagctgattcagtaagagatgcttctgatcactctagcttgagctcttgtggagcagatactaagcttgattgtttttccagtgtttttggtgttgtgattaatgggttctatgaatgtcgcagagtgttctcgagtgcttcaaattgcctggtaggttttttttttacattaatgcatcacgtgtctgtcaatattagtgatgagaatcaaagaggcggaagtggagatttagttcttgttgccaagttagataattggggtattcggtgggtttcaatggtgaagcttgatgaaagaataaacatagttcagtcagttgagtggatggatttcaaattttctgataatcttcttgtctgtcttaattcttctggcttgattgttctctattctgcaatgtccggagaatatgtgacacatttaaatgttttacaggaggcttgtggccttaacccccattttaatttgcaagggttagaaaagttatattcacatgttgatatatatgctaaacaagagtgtagcattaaggataacatgtctgatcagcagagtgattcttttaggagatcattcaagaggttagttgttgcttcacacacctcccttttagctgtggttgatgaatgtggtgtgatctatttgatctctttgggggaatatatacctgacaaaaattattcatctgagaagttgcttccacattgtcagcaatttgggcttggaatgttggttggctggggagttggtggttctgatatagatcgccaagcagtctactccaatttatctggacattttcaatcaaatgatttaaacataaaacatggaagtgttgcttcctcagacaaagctgttgcaggtaatgcacttcagaaaactaatggctgcacattcaaagaaaaggggaatttgtttggctcctattcaagtggtttttctgctacttctaaagtaaataatggtaacaaatttcttggttatgatgtgaaatcacctgttatgagaaagatattccttcccaattttagagtctatgaggatgattctatttgtttttctcctttgggaattactattttctctaaaaagaagtgtgtaaagaatcagaatggttctcagcttatccattttaatctgcaagtgaagttagaagtccatgatgacaacttcttagacagtgtatatgatgtataccactttgatggaaaagatgttattggagaagtcattggttgcacattccaaggttgtttttatattgtgagagatagtggtctatcagtatatattccctccatttcaattttatcaaattttcttcctgtggagtacattggttatcgtcaatcaagtaaggatatggggatttcagttctacttaaagacaatctaaaaataaaagaaccgaccaaaaggttttctccttggaaagttgaaattttggacagagttcttctgtatgaaggcactgaaatggcagatcaattgtgtttgaaaaatggtaagtgttacaaagaaaaatcatttttcatttatctataatatgacatctcttagtcttctccttacttgtcttgggatagactagttcatttagtttgtttgtgattttgcatatggtttatagagggatgttcctctagaaattattcatgggggccaatggcaatttctattttaacagaaaaggaatataacaaataaagtactggaaaaatgataaatcttagctgtaagtctttccaatctctttccaacttgattgggaaactcccttaaacacgtataggccacaaaaaagttcctgccctctggctccttatgtgtctcattggacagcatgcaccaggactggacaattttattgtttcaagaaatgccatgtcctcctaacaaatcctcctaactacttataagtaataaatgaaataactgaggcattcgatatcttgggaacccgaaaaacatttcatgctttcttctttgattagttaggagcattttgagcctgattcaacaggaggatataaaatcatttttttattatgcattttatttctgcaactttctgtaatgaggatatcataatttatgtttttcttattcaatgtgacatagtgacagtttcttttttttttctgtaaaggactcttatttgtttcattgatttaattgcttcatttcaataaaatatttctctgcattaaatgtttttttatagagaaaatacaggtgttcttctattccaatttctgttataaatgctttttgatatcttggcgtgttaggaattttagggctagccaaccaggtgaattaggatgtgattatttgcattatctttgttaacaattaacatcttcatcttgaccaatgccaatccacttgtcttgaattgctgcttttggtggtttaccttctcttgtcttttgctgctaaaactacctctatttcaactcatgataaaccatcattttagtctttgaaagtgtataatactatcatattagtccttgaagaaattttcaaataagtcactgaaattgcaattcgtcaatcacattagtctaaaattcaaaaaaaggtgtgacttaggtgataatattaacatatatttggagaccaaaataacagtaagagattagatttaaggtctaaatgaaatttcagggactaatttggaattccttagttttggaggctaacgtgacaacactatacactttcagggaacaaaatgatgctttactcaaatcttattatagaaaccaggaattgtctattaaaggtgaataaatgagaaactgattacaaagtagaataatttatggtgatgttaatctaatttttgattttaaaatttgacgtgtttgtgtaatgtggtggtggtgacacactactttagaatttagtgaaacaattttaggtgcatgcttatttatttatttattttttctttgtcaggatgggacatcaaagtttctcgtattcgtcaattacaaatagcattggactacttgaaattttatgaaatagaaaggtaagccaaaatttattcattgcaggcttgatttatactttttgtgctttgaagtggcaatcttgtgccataatgtttggtcatgttgtttgtagtattatttggggaagaagggtagggggtgttgggggaggggcaatatcattgttattaaacttggaccagttatcaacttatttgagggtgttaggttactatttcaactattgagtcacagggtgaattggttaagcagatatataaaatatataactatttaatatagattaaaaattaaaattctacacttaaaattataatttaattcgattacacttaaattttttcaacatttaatgagtctcatgattttgtaatctatatctatattaaatccgtccaaaccaatgccacttgtcattgtatggtgcactgcagcccaccatgttctctccattttcacctttttgcttttattttctctcttctgctgtgcaaatcacaggttacttatctagtttccaatgaattttgatcattagtaaagaatgtgttagaaggagtgtgttgtcaacactcctctttaggttttactatggcaaatattatctaatgtaattcactttccagttttattgatgaacagatctttggaaatgcttgtggatgttgatctagcagaagagggaattttgagattgctttttgctgctgtgtatcttatacttaataaaggtggcaatgatagtgaaacttctgctgcttcaaggtaaatttatttgttcattgcttacttacctatattttttgttctttatcattttcaaaccaatttgctacttgctagacatgtcatctgtgtaaaatactaaaatatatggagcaaatgtccgttttggttctccaaagatatatgtaacatcacattggtcctatagcttatggtttgtttctgtaggatagctatattaattcattttgggaaaaattgaaaataaaatcgaactgttagtaaaagtatttccactttaggactggaatttccttatgtctacactggatgaggaaactgaagttaggcaatcgtcgatatatccatccattgattaacaaagctctctttcttgtatgaacttgtggctgtctctgctgagggcctatataaagttaccattagctatctatgtaatttgttattattacatgtaaaaaactaaaaattgatccaagcatgataggcatgtgtttttcctgcttgaacactggatattgctttcaagtttcaaagttaaatcaactttcatatgtttttaggaattttttactgttttcaagtttatttcaattatttgactaaactcacttctaaataacgtaattttattgttttacatggtatactagctgacgcaaatgcctgaagataaatttctaactggtgtttgcataattcacatttatgtaacacgtcccttactagaaaaaaaaaaaattcagtaatgtgatcctttttgctattagatagcaagagtgagttggctatatcggaggctatatcaatttttctattcaattagtcactgcttgggttgtcaatattctgtttgatttctttatgtctggctctatattcttaaggagaaaaggatactcatgaagctatgtacagcatgcatggtctgttttaattctgattttattatgtttttgttgtcaacatctataggcttcttgcactggccacttgctttgcaacaaagatgctccataaatatgggttgctacaacataaaaaagatacatgcatagcagagggctttaacaagacgggattactttctcttccaccaattgaaccagttaaactacaaactgaggtggattttgctcagaaactttgtgagatagctcatttcttggagatcatccgaaatctgcaatgtagacataggtcaatatttcgaagggccagccaaggattggtatggtgctccatggttatgctacttgtattctgcttaaattggttacattattttttctgaaaattaaatcgtatcttgttgctatatacaggccgacagtggagaagagtcatctttaataagtacagacatgttgcaggaagaatcccaactttcaattcttccatcagatttagagtcattggatgtgttgaaccaacatgagctttcttttcctctaccaggcagcgacaataatgaaaatcttgcgctggtgcctgttgattctgagtctcatttggtctcagatgaatttggaagcatatctcatttaaccccattaggaggaattttaggaaagaaagttttgcctgtggaaaatccaagagagatgatggcacgttggaaggtaaataatctggaccttaagactgtcgttagagatgctttgctctctggtcgtcttcctttggcagttctgcatcttcatcaaatgaatgattttgttgctgataaagagcctcatgatacttttactgaagttcgtgacattggcagagctgttgcttatgaattatttttgaaggtaatgtatgttacattctcattaactgttacaaattacaatgaaaataaccaacaccttgcaattatatagggtgaaactgaacttgctgttgctacacttcaaagacttggagagaacattgaatcttatcttaaacaacttctgtttggcactgtaaggagatccttgcgaatccagattgctgaggaaatgaaaagatatggttatctagggccatatgagtggaagatattggatgatatgtcacttattgaggtatgtggaattcatttgtcttatttttgcggtcaatgtagtgcagtttaactactgggaggaaaaatttccatgagctgagacttgtaatcttatttgtccctgtgcatgtatatgagaagagtctctatcctagcagtagcttctggaaaacatataatcgccgactgaaagaaatcagcattgcaccggactctgttttaccagtggaaaataaattaaggctcttgcataaccattcatttgatagtcatgtcattgaatgtggtgagattgatggaattgtctttgatgcatggattgatattagtgaaagttcctctgctctggaagttgatgaagatgatgctcatgttggatattgggccgcagctgctgtctggtttgatgcctgggaccaaagaactgttgatcgtgtaagttgcttctctgttttctctccctttatattgatgttcatttttattgctgaattttgatgaagccaatgatgattagcaactttcttcgcctttagaatagtctagatggtggattttaaacttgttttatagttgcatttactaatgaaataaagaccgaaagagaaggttagggtaagaattctttaaatttcggtttcttatgagtgtgacgtttctgttggatcaggttggaagcagaagtgcttatgccctcttagagatttgtatttgatatgcatgtgtctatttgtttcttgaagtccattagtccaccaatttgcacctttataacatctatttctggatgctctagttgttttggtttgaacttcaaatcaaagatttctatactttgtattagaatgtgggtttagacccaactcaaccccaaaagctagcttattgggtgaggattgttcttcacttatatactctgacttggcactatctctagccgatgtgggacttgggttattcccaatactttgaattaaaattttagttgtgatgaaaatttgcttccccctattgatgtattcagtcattgtactgctcttagtcattaatttaatgtctatatctcttcaaggacaaagatctttatctatagtaactttatttttcattttcattcatctttgcatgtacagatgatattgaatcaatctgttcattcggacaattctatatcgtgggagtcacaacttgaatatcatgtttgccgtaaccactggaaggaagtctttagactgctggacttgatgcctgcatatgtcctatcggctggaagccttcaactcaatttggatcttttacaggccgcctcatctttaggatgcaatatgaatatgacgtcttctaattatggaaatttcttgtgctcttttgaagaattggattctgtatttatggaagttccagatgtccaaatgtataggttttcacctgatgtatgttctgggtggatgaggatgcttgtggaggaaaagcttgcaaaaagatttatatttttgaaggaatattgggaagggacattggagatgataactctcttggctcgttcaggtttcatatctggcacagataagatcttcttggaggatgatcttactaagacatcatctgtcagagatggagctgtacaaactttgcataaaatatttgtacatcactgtgcacaatataacttgccaaatcttttggacctttaccttgatcatcatagtttggtcctcgaaaatgattcactttatgcattacaggaaactgctgtaagtttctttatgtccattgtttgatattgttattctgattgattgtttttggtctttattatttcaaatcacgatgctagtatgcttccataagctgttaatgcgctgaaatttgtaggttatgttgtttcatattttttggttggttttcaaacttaaacgaggatatatagctcggaaacggaggacaaaaattcgtttatttacaccattaaatctatggtattataatgcaaatttagttgctaattcaggtaacctctttccttgataaaggaagaaattccataagatgaagtgaaaaaatatagcaggaatatggaggacaggggatcctccatagggaaaaagggaaaacaaaactatagaaaaaaaaaaccatcaatagagcaaagctgctcaatccctgtgaatatctgttaagaacctctataaatgactttgctttacaccaaacagaggctgatcatttaattttatctgtaatcagttagagtcaataacatgtcattaaaatacaagtgttacattccaatcaaaatgtacacgacaatcaacaaaaatcagtcgaagaatttttacacagattgcacattgccataaaacttttgtcattttacttttaccataaaggcaaaaaccactattgctagtcatcaacaaaagttagtccaagaacctttctcaggcctatattcacccaaaaggctgaacaatacactgtaaacagacagaagcagaacaatgtaggaacagatgaagaactagaaccacacatactacaattgttaggataagagactaggacccttattttaccaatctaaaatgtgcgtcagcattaattctatgacacacacgagtccaaataagagactggccttagaaggaattcttgtaaattctatttctttatgttaacaccgctgacttgcatgtgttatgtagttaagcctcttgaatctacgttgggcccaactctactccatgtgatttgcctttgcacctaggattggacatcttgagtgtggagattgtaggtctgactttttaaagctaaaaagttgtagtccctataaaatgtgtggaaaatgattttcttatagagggtgaataaataaattggagaaaacagagcctgtacatcaatctaatcctaaaaatcaggagccataatttccttggaatctctacgtgctaaaaaaggaaaacaataatataattgatccgataaattaaaacaaatgattaatgtctagatgtacagaggatctaatgatcctgattgattttagagaatgttaagccatcgacaaaatgtgttttttgttttgatcttgttaatttttttatctgtttgtgtccctattaatttttatttatttattttattacggtccctaacatggctcccagtccattcacctcattatttcaatccctataaaattgtaaacttttgatataggcttaaatcagtaggttttcattttagttcctgttatttaggcaacatcagctctgccctgttttgcaacctctgctacccacatcatcaattatgacttaaaaagggaacctgatgtcagtgactaaaatgaaaaacaattaatagggacattgataaaaaagaaaaaaattaaagaggaccaaaatgaaaaaataaaaaaaataaaaactaattttataggaacaacttatttaagccttttatatattgtataggaaagccaagaggccaatagattgcactggcagttgagggtgcccaaatattagatctatggtagactttgatgccattttgaatatgggttaggtctaactctccccccaaagctagctcatgagataaggattacccaagcttttataagtttcactttagtcatatctatggtcgatgtggatatattcaaagccaatggattggcccaatgttatttattaatttttgttacttttaaggggctttaatgttgtggacattcaatattgcttatttctctttcattattttaatcaacctctattcttccaatctttatgttaacatggatgtctttgctttaaagacgttttagtgttgcatgttgatacattgcttctcaacaggttgattgtgaatgggcaagatggctactcttatcgagagttaaggggtgtgaatatgaggcctcacttgcgaatgctcgatcaataatgtcacgtaatttagttcctagaagtgacctcagtgttctggagttagatgaaataattcgaacagttgatgacattgctgaaggagggggagaaatggcagccttggcaaccctgatgcatgctgctgttccgattcaaagctgcttaaatagtggtggtgtaaataggcatagttattcctctgcccagtgcacattggagaaccttaggccaactttgcaaaagttccccactttgtggcgcacactcattggagcatgtcttggacaagacacaatggccttgctggtccctaaagcaaaaactggttagctattaacctcattttttgggtgaacccccaccctcttctcctaagttacttgggcacttaaactaaccctatttttttgtgtcattttttgtctatcacaatattgcaatgcagctttatcagactatcttaattggcgtgatgacatcttcttctctactggtcgtgatacttcacttctacaaatgcttccatgctggtttcctaagcctatacgcagattgatacagctttatgtccaggtctgttttattctcctcatctatatgattttatgattcttatttaaattcaaattatactagtctgtgttgttattatgatggcttcataaccaatctcttgttatctccttctggttggttataaataccttactctgtcatgtagtttgtatgttgttacagacaatcatgtaatatgtaagcaatccacattatgtagttttctttgcattacagggtcctcttggatgccaatcattttcagggttccctacagggggaactttgctacacagagacattgatttattaataaatgctgatgtacatgctgagataaatgcaatctcctgggaggcaactatccaaagacacattgaagaagaattatatggtcctttacttgaggtatgggcattgaatttaattgcttgtttctctcttattctccttgtctctgtttgggaggatttattgtctgactcaatatttttgtactcaatttttctttcttgaaaacttctaagaaatgttttactgcctaaagcttgtttagctatatagtatttgcagttttattggtactacagactccaattgcaatagtgtgaggaacctgattatgagtatcctctcgattgaattctatgcagtttctggtttgtgttgtcagacttaataattatgtgacaattttcttgaccgtaagaggggttttgccctaatcaaatagttttgaaagcaattgtatgcagtaaacacacacacacatgcacaaaaaaagacaattctgccaaaattttgcattatttggtagttgttggataagtcaaaagtgtctgggaccacccatctattgaaaagtcattaaccatgccaacttgttccaataaaaaattctggctaactattatttttcctgttaggagcttaactctaatatacaatattctcctatatctgctgctataagtgcagatatgcaatttgctgtattctaagtatatttttctactgtgtattggtaatttgaattgatttttcaggaaaatggattggggcttgagcatcttttacatcggggacgagcattggctgcttttaaccaaattcttggccatagagttcaaaatctgaagtcagatggggaatctagtacttcagctcacggacaaactaacattcaatcagatgttcagacacttctttcaccactaggacaaagtgaagagactctactttcatctgtgagttcttgtttgtgttttttaaatagattttcttgttatgtacttgaaatgagagatcaaattaaaacaaatcaatgcattatgttcaaatgttgaaaaaatgcttgctcttttaccacataaaaatcttgtattgatgataatgttcataattggcgatgtcattactcccaactcccaagaccagcttctaaatgatctgtttatcaggaacaaattcaacctaaaagtttaaaaaggccatatgagtagtttatatctctaacatgcccctaagagtattttgggctttaagcatggaaaatacataagtccattttaatttatgctataggttagttgaattatgacaaatatgggtggcaaagatcagcttttgatcacttggtcattggggatttggaaccttgtgaagaacctatgaacctaaatgtttaagctgtttggttaaggatatgaatgattgtatactttaactatccatttggtcttctatcaattttatgttacatcttagggtttcttttgattttgatgctggatattctcccatattctttcctaatattaacatgattggctccttgcttgattttgtaatttttcattcatgaaaaatacaaaaaagaaagatatgactctcattgaagttttgaatggaagattgaaaactgttcttaaaattctcaggttttgcaaattgctattatgcattttgaggattccatgcttgttgcttcgtgtgcttttcttatggagctatgtggtttatcagcaaacaaaatgcacgttgatattgctgtgctaaaacggatatctttgttctacaaatcaagtgaaaatgaaaatctcaggcaattatctcctaagggatctgtgtttcatgcaatatcccatgaaggtgatttaacagaatctcttgctcgagctttagctgatgaatatttgcacaaggattctcctgtaaatggttctgagagtgtaagtaaacaaccttcacgagctcttatgcttgtgttgcaccatttggaaaaggctagccttccacggttggttgatggaaaaacttatgggtcatggctattaagtggaaatggtgatggaaatgagttaagatctcaacgaaaggctgctagccagaactggactttggtaacaaatttttgtagattgcaccagcttccgttaagtactaagtaccttgctgtattagctagagacaatgactgggtatgtttctacttctgtttcttttattaactactcaaattataatcttattattgtttttggcttctgtcagattgaatttttgtctgaagctcagattggaggatattcatttgatacagtagtccaagtggtgagttctgttccttatcttaactcatcataaaatatatatcatatatatgatatgctaaagtgaaactgtttcactttgaatttatttgtgattgtgaatgctaggcatcaaaggaatttagtgatccgcgtctccgacttcatatgttaacagttttgagaggaatgcagtcaaagaaaaaggcaagcactgtattattcttggatacactggagaaaggcagtgaaacaacctttcctgatgaaagcatgggtgttccagttgaactcttccaaatattaggagagtgtgaaaagcaaaaatgtcctggagaggctctcttgaggaaagcaaaagagttgtcctggtcaatattggcaatggttgcttcatgtttccttgatgtctctccattgtcatgcctgacagtttggttggaaattactgcagcaaggtgactgggactctatataagtaaaatgacattttcataattgtgttctggttatgttttatatatttctatttagccatttctgatgtgaagagcttgtagttttgtgtgatttaatttatgttgagcttgagtgtgaacctggttatgttatatatatgtatatatatttatatatagccatttctgatgtgaagagcttggagttttgtgtgatttaattatgttgagtttgagtttaaaagtagtctatgttacagtaggcaaaatctgcctgtctttttatctatattttaggataaagtaacagcttgaatgaaattgaatcttacaaacagcaggagttattctttttatgtgatggggttctcgcaaaatccactgttgaattaaaatttccatcatgaatatcatggaattttacattcttctaaatttttttatattgcatcagcacatgttaaaactagcattcaaattcaatatatttagtttttcatgcttattggtgtccaattttttaaaaaaaattggtaagacaaaagcaacattctatccaactccacgtagtagaaaatacttggttcttgtatttgtataattcaataattggactgaaaattcacattatatgatgaattgttaaaggtctaagcgttttgtgtcttataccagtgttaactgatccacatgcactcaaacatgtgtatagatttcaatgattaaatgttgaaactcaataccttttatctgtgggcagagaaacttcatccattaaggtgaatgatatcgcttcccagattgcagacaatgttggagcagctgtaaatgctactaataccctgcctgtaggtgacagagtacttgcatttcattacaataggcagagtcctaaacgtcgacggctaataactcctgtttcgctagactcctctgcttctgcaatatctgacatctctagctcttctataagtgaaaaaatatttgattcccaaggtaaaactatggagaatgatagaaaaatagaacattttggacgcattaatgttcctagtgattccgatgaagggcctgcttctctctcaaagatggttgcagtgctttgtgaacaacaattgttcttgcccttgctaagggcatttgagatgttccttccatcatgccccttgcttccattcattcgtgctcttcaagtaagccaactaattcaaaatttatctgttcatttagtgtatactttagaatagtggataccatgttcctcaggtgtctattgttgaatacagtattcttttttatgtgctgctgcatctttagcctagttctataaaaagtggtcttggttttaagtgccagtgtctgattattttttacacatgtatcttgactttctttcattcagtatttcttttttcagggtaaattacacttcatccccttgtaacatgccaatgtgtaaattctttttatcttttcttcaggcattttcgcaaatgcgcctctcagaagcttctgcacatttgggttccttttctgcacgaattaaggaagatccaatctacttacaggcaaatgtaggaagagaggcacagattggggcatcatggattagttctactgcttcaacagctgctgatgctgtgctttcaacctgcccatctccttatgaaaaaagatgcttactgcaacttcttgctgctactgacttcggtgatggtggacatactgcagcatactatcgaagggtttattggaaaattaatttagcagagcctttacttcgtaaagataatgagttgcatttaggtgatgaaatttcagatgatgcttcactcttatctgcactagagaataataggcactgggagcaagcaaggaactgggccaagaagttggaggccaatggtgcatcctggaaatctgctacgcatcatgttactgaatctcaggtaatacttaaaggttgtaaacatgtttgtgacctgtaatcttaactgaggggaagtcttgagccgatattaaaaaccttaatcaattgaatggtttgtagagaaacccattgtaaataattcaaggtttctccaactcatgttgatattactgcagacgcttgaagtgactgctcttcgtaatcctatcttctattaataattataattttggtctgtcaaacttcatattagattaattaatttttctttgatgggcatgataaaactcgttgtaatacagactattgccaattgaaaatttaggattatgaacatgtctcttaatgattgcatcttttatacgtgactctgttgttacttgcaccgaattgtacaattgatatgtcatgtcagtttgactcatactgtaagtatctggttttaataaattcttgtgcagatgatcatttcatttgatcaaatggatggcaaattcttttgttgaaaatgaggagtttttgttgacaaaattcactttttaaagattgaagataggacattactgaaatattaaaaattcaacttgagtattaaattgtcttaattttgctgtaaatctgagctcgggtggagcttttaatttctttgtcattttaaatgaattttttctttgacgacttttagcaattttagttgatagtttgcgtatttctcatcaaccctttaccctcatctttctctgccccttttataaatggtaggctgagtctatggtagctgaatggaaggagtttctttgggatgttccagaagagagggttgctttatggagccactgccacacactattcatcagatattccttcccttctcttcaagtgtgtttggtttatactttctagtactatagtcattgttcagctgaagatatatgctgaaattttatctttgttgtaatgattgcaggctgggttattttttcttaaacatgctgaagctgtggagaaagatcttcctgcgagggagcttcatgaacttttattgctttctctgcaatggctgagtgggatgataagtctttccaacccgtatggaacatattcaagaatttactttctgtttcaattttagttattatctttacttaaactttactgaatttttcagtgtctgtccattgcaacttctgcgtgaaattgaaaccaaagtatggctcctagccgttgagtctgagactcaggtgaagagtgaaggagatttcaattttaccttttccaccagggagagtggtatcaagaacgactccagtcttattgatcgaactgctagtataatagcaaagatggacaaccatataaatacaatgaggagtagaattgtagaaatatacgagtccagggaaaataaccaaatcccccacaagaatcaagtgatggatgctggtctttcaactacttttgctgggaatacgaagacaaaaagaagggccaaaggatacatggcaccaaggcgcccacctcttgaatcagcagataaaagtgctgatactgatgatggctctagttctattggtttaaagaatgagttgcagctgcaagaggaaaacgtaaaagtggaaatgtctttttctaggtgggaagaaagggttggagaagcagagctagaaagggctgtactttccttattggaatttggacaaattgctgccgccaagcaactacagtataaattctctcctggacaaataccatctgagtttagacttgttgatgcagccttgaagcttgctgctatttcaacacctcctagcaatgtatcagtgtcaatgcttgatgaggaagtgcgttcagttatgcaatcatatggtataatgaatgataagcactacgttgacccgctgcaggtagttgtccaccggacccccttccctgctgttattacaagttttgtttttctactgatgatgatgtgtataaatacaatattgtggacatgcaatgctaggttttggagagtttggtgaccatttttattgaaggcagtgggcgtgggctgtgtaatagaataatagcagttataaaagctgccaacaccttgggcctctcattttttgaggggttcaacaagcaaccaattgaactactacagctgctttcacttaaagcacaagattcctttgaggaggccaactttctggttcagactcatccaatgccagcggcaagtattgctcaaatacttgcagaatcttttctaaaggtttggttcatcattttatttcaattctagttattaatgtttttgcatggcatggtgtgtggtaattgataaatgtgttagacatccctcctgatcgtagatgatttttttttgtgggcttgttacctatctattgaatatagatattattattggtctagtaacctgaaggaatgttttggttttcaggggagagcttaggatggtttttatttcttttgctgacctagtcttaagtaagaacttagttggcttttttcatgcttttcatgcttcaagccacctaggttctacttctgttcatgctaggatgtaagtttttacagtactccttgtactgtatctttgcttatatatataatataattatctttgccaatccaaaaaaaaaaaaaaaatcaggatatgtaaattggtgtcattttgatttacacttttatatttgacatgtagtgtcagttatgcaggtgtctgttcaacaactgtatttagatacaattttgtgacattaataagggttcataaaactatattgctatgtttaactaattatattgccagggtgtgttggctgcacatcgtggaggatatatggattcacagaaggaggaagggcctgctccattgctgtggagattttcggacttcttgaagtgggcagagctttgtccatctgaaccagaaattggacatgctttaatgcgtttggtgattactggacaagaaataccacatgcgtgtgaggtatcatgctgatagttgtcagccttgcaatttttttccactattatgtccagaaaatggtgaattaaaattgggttctggtggggaaattctaattcatattggttttaagatgataaatgtagtcaattgtgatccctctcgttcttgttttgcttaattaaagaagaaatttattaagatgatgagaagaatatagcaaagctactcaatccctcaacatctctgtgaggacgacaccctttgaaaaggtcatgcactttacaccatgtggaaaccaagcacctaatcttgtccagccactgtttatgttaagagatatccttaaaaccaccctaatgtcaaagtgtagcaaatatttcaatttaccattttttttaattactgccaaaaccagtaaaactggtccaaataactaggacatgcccatattggaaaaaaaccaagtcccatattggctaaagacaaggccaagatagagtatataagtgggggggacaaccctcaccctttaagctagcttttgaggctaagttagtccacaacccacattttaagatggtatcaaagtctatcctagatccattaaacaagttcactaactatattatccacgaacccagcccaacagtgctgggagtgaggaggtgtattgcaaaaaacccaaatctcaaataggctagagatagtgccaagatagagtatataagtggaaaataacccttaccttatgaactagattctggggttgaattaagtccaaacccacattttaaaaattggtttacaaactacttatgtttttctaaccaaaaaaaggtcgctagtctattaaccaataattaacccataattagctggtgcccggaagactttcaggtgtacaaataatagacctgtctgtgtgtaggaagagggagagagacagacagacaggacatgccaagtgagagacttagtttattataagagtgagataaatgaagcataatcattaaatcttgcattaattgtaaggggttaaatgaccacttacatcacacactttaatgccttagccattcttacaaaatcctattttcaatatttgttcctctatccactgacagcttgacagccaatgatattgtttacaatgctcctctccctttgtattattggaagccgtaatatagatataataaatttaagtagagaaaatatcttaatttttctgctgtgttattccttttgcttgaagctgacactgttttgcctcatgaaattggcatttttaggttgagcttcttattctgtcacaccacttctataaatcatcttcttgccttgatggagttgatgttcttgtggcccttgctgcaactagggttgatgcttatgtcttggagggtgattttccatgtttggctcgcctgataactggagttggaaatttttatgctctcaatttcattcttggcattcttatagaaaacggtcagttggatcttcttcttcagaagtattctgctgctgcagacacaaacactggcactgctgaggctgtcagaggatttcgaatggctgttcttacatccttgaagcatttcaaccccaatgaccttgatgcatttgccatggtttgttcttttcaatattgctataatatcaactactaacaatgttgtttgtttagcttacgataaatgaatatatagattaatgattgtatgctgctaacatacaatttatttatgtaaatatattattgaataagtcaatacctttttgtttcacaataatttagtctagtgtatgccattttttgagccattcatagtcaaattattattttttaaatgactcggggattattgaaatattttactgttatccccactatataatatatcaattgtatggcattgcatagtctgtagttaatagctttcttcaagcagcaactttaaagtggacaagttgcttgttcctcatgctcagaaaatttttctccttttttaattcttggttctcttttcatcaaaatcaacgaagtttaatttattttaagctgaagcaaagaaactcgattaaaatgtgttgtaaataacagaattatcctaggggatccttcattttcttttttgatcttttatcatctttattctttttatattgaagtcatagtttctttattttaggggtagttcccttataaaagcatgattagagaatgtaattctcgtgtcacaaattaataaaatcagtggcttttcaactatatgtgacaatttattgtttacaattttgtgttctgtacaggtctacaatcattttgatatgaaacatgagatggcggctcttttagagtcacgtgcagagcagtcatgtgagcagtggtttcaccgctacaacaacgaccagaatgaagacttgttggattccatgcgctacttcattgaagctgctgaagttcactcttcaatcgatgctggcaacaaaacacgtaaggattgtgctcaggcttcccttctgtcccttcaaatacgaatgccagacttccaatggctttatagatcagaaaccaatgctagacgagtgttagttgagcaatctcgatttcaagaagctctgattgtagctgaagcttataacctgaaccagccaagtgagtgggctttagtactctggaatcagatgcttaaacctgaagtaatggaggagtttgtggctgaatttgtggcaattttacctcttcagccttcaatgctgattgatttagctagattctatagagctgaagttgccgccagaggggaccaatcccatttctctgtctggctcactgggggaggattgccagctgaatgggctaaatatttaggaagatcattcagatgcttactgaagcgaacaagggatttgaagttgcggatgcagttggctacagtggcaactggatttggggatgtcattgatgcatgtacagaagaaatggataaggttgctgacaacgcagcaccactagttctgaggaagggtcatggtggagcttacctccctttaatgtgaaactttctgctgtagatcataataatgattggataatcacgatggacaggaagttggttcttgaccttgaaccattgatcagggaattttgctgcaagcattgaagattgcaagcagaaacctcaagtgttgaccaattgaaaattggatggttagttggtgaaagtgagatgtataatttttggtcgagtaaatgcttgatggttgtatattgggccgactgtatttatagctcattcttgtaaaacaccattttagttttggttttctccattttttttgcagggaggagaggatagtttattgtcggttttgaggctagtagaatagaatgccccattggtttcttttttccttcttttttccccctccaaaatgtatagttcctgtacatcaatataaaaaatccatttgtcatgttttacatgctccaattctatcaacaaaatgctcatgcatagtgctgttttcacacataaactataggcagactttagttttgctcaagaatttagagtgctagaagctacactagttctactcctaagaaaacaccattgaagactatagaaaagctatgaagaagataaaataacaattcagatattcttcattgatgatccattacacaatgcataccctatattaaataggggtttacaaaagataccaaccatacaagtggcatcatctagtgcttttaggaaagtaaaataaaactaaataataacaaaaggataatactaaagtcatctaatatttaaactgcttattgacttattggatttctttaggttcatcctatctggaacgcgtgtttttgagtgatgtcatttcaattttgcatggggtcgaatctctcgagtattagttttctacaaaacgcgtgtgcttgctgttgaaagactattatttatttatttatttatttattatgaaatgaatttagaaaagcaatttctgtcatggtatcgaacccttccttgactcaagtgcgctccctttaccaattggagtacatacttagacggagaagttgagtcaatgtgaatgaaggttaagttttctatttaaattaactttttattctttttattttgaaaattaatttaataaaaagcaatcggggaagggagattttgttttgacaaaattaaaacaatcggcttcacttaaaaatttacaacaaaaaatatacaatcttaaacatctcgaatctcgaaggcagcagagggactgagtaatgagtatcaaatagatgaaatgcttttctaaatatccggagagaataaatgggacatttttgttaaatataattcatcaaagaatcaacgaatcctaatctcaattcttattgatattatgcttcccaaaattccacacaaaaaataattttagcagttggccaacatagaacaatgttatagacttacagcccacggacaagcacaagcaggaagggaaataatcaagatacaattttgctctcaacgattaaaattaagagcatactgtatttaagaaaatattattgcacttggaaaaaggcactgaggggagaattgaaaaggaaaaaaaaaaaaagaggctaggacaaaaactattaatctttgctcttctctgagtatgtgttctgaggtagtgtagggcgtctctcagcaagaaaacgttttgtactctcaaggacaccaaagaatattgaaccacctatgccaatccatagtactctgggaccaataccctgcagcaaatatataatttataagcaccattttttttttttgccatgtagctgcaagcctcatttagatcatgctactttataccacacaaactacattacaatgtatggaggaaaacacagaaaacccttactttcaaaaaggcacgcggtccttcttccttaataatggtttgaacacagtcaacgattcccttatattggtttgcagttcccttgaagaggaaaataggaacttatgaatggcttgataattcgcactgaatattcttattgatttgcttctagattatccatatacataaggtatcgtatgtgcatggttgtatgtagatgaactgttgtaaaaacaagattaaaaaagggaaacaggattacagcttacttgaaccattaaccttgtcttgatgacatcgaggggggtagttatagctccagttagtgcacctacaagaaacaaggcagttaagtcacatttcaacgcaaggttagttggacttgcaaaatgcaataatgcttaacaaaacaaagcagtttatacctccaagaatccttactacccatgaacctattttctctccccctcaaaaaaatataaatagaaaattaaaaataatagaagctacaaatggttgggtgtaagcatatgttaggtaacagttgcccctgtctgaaattttggaggtgcaagtttcgcctactcaatcatgcagatacttttatataaaatgagtagcttattaccaaataaaacaataatcaattttattttgctattgcctattaagttctccaatgtaacaaacccaagagctttatgaagatatagaactggggatagcagattattcacattcttctcagtcacaaaactacaccactcaagcactcattccgtgatgtttgtgcccactttgtcctctgggagacataacatggtgattgtgattcactacacaagatgagtttgcataatctatggaagaaataagagttaaaaacgcatatcaatgtcatgaataagatatattataacacaatttatactcattatcataatttgttcttgatagcattcagtgggggcaagaataagtaatgcagtactttgacatgaaagcaccatgtaaatcaggaaacaaagaaataagattgagatactccccgtgagccccttttttggttcatttttaactgataaccccccaagtatttgatagagaaggcatgcaactggcaccttacaaacaaaattaactagatatatggtactaattgtaaacagtaaagcctatttgtgtcaaactaccatacaccttacaagattaattcacatggtgaggactgaggataaaaactgacttttaaatccctcgcacaaagaaaaaaaaaactcagcctaaagcataaagtcatcatagttatcagaaatgaaactcaatatgtatgtatatcctcatatttcttaatatatatatatatatatacttatctttgctgataaaaaaaaaaaaaaactctaaaatacatgtataacgatatgcccataatggcacacatttacctgcaaaagcaccaataattgcattttctggatcattcagatttcttcgtgcctatcaaaaaggaatgtaagttgcaccaatcatgaaatgaaatagaggagcaaacatcaccaatctgtctttcctttaataagtttagcctataaatatggattagtgcttgtattgaaaaaccatcaaatactgttcagttttcctcttcttgctgatatatctttttgttgctttcacccatgtcattgtcagattccctctccctggtcaagatttttttttaatatgtgaagtttgacaaacacaatacttgccattactacggtgaatccattgtacatcagactatacaatactaattcttcgtcaaagaaaactaaataataaatagtcattttcatcctaaagtttcaacgtataggaaggaaacctaaagtattttcaggctcaaaaatataacaagagaatgggaatggaaatttgtgccaggtaaacaaaaataccaaaacaagctctaaaacagatgaagatagaacttgagaatttaccgcaagcatatagcctaatcgaatctgctcatagatgcaaaattgaatagcatcaaagggtaaatccctcaacaaaaaagatccatacccctgtgatttcaaagatcaacaccaaagaaacattttagcatatcattgcagacatggagaataaaatttatcaaaaaatttaaaaggaagagatggtgaacttcatacagcataaaatcctttaaagccttccttagaagcaataaagcgaacagcaccagaagctgaagtaaactggccagtttgcagtcgttgcttgataacctgaggagcacgtaaaaatatgaaattgtccagtgaaaccgttttcaaccatgctaatgtcatttttacaaataagagaatttatttacctcagttggaacacgaatcaatgaagcagcaatgccccctatggcacctgcagtctaatgaaagtgaaaaacactgaaagattttatccccataagaatgaaaattttacatcaagagaagtgtatgccagcaacaaaagaatgataaaatagacagagcatcaactccaatacaagccaaataaatgccagaggcttcagaggaccataattggccagaattcagacttttgaaagcattaacaggtacttaatttacttaaattttcgtatgccaattgtaatttttggagaagagatgataattttgtttttctcctattcatatggagtcaggcaatcctagaatataaagtgggaatttgattaggaaatgtcaaccaatctgcaacaatttaggagaaaacaggagaaaaataagggataaaaaactgaaacttaattctgatctgaattggataatttagatcttattataattctaactaatcttcctaactatcaattcctaacatgaatttacaccaatatcttcatatcaatgtttatataagaagtatcttaccaaatgagtaaaagcactcaggtgttcaggaaatatcctcagcaatttctgctttataggttcataaactccaacaaataaagcagatgccctgcatatttaaaagcaacaaaaaggtgtgatggaaagaacctagatgtgattcatgaattcatatcttgataagcatgaaatgaaaacttgtgaaaatcacttcaatgaatttgtgaggttaaaaaaaactctttttagctttgaatatgcataacaataaataaatagttacttctaatgataatactctttcaaacaaaccctaaataaccttaatcagaaaactcaatatccagtcttggaaggatctatcaatctcttattccaaaggcaagtacataccagattatttatatcagaaacaaacaagccctgcttattccaaaaaattgagttaagtcacattttactaacaacactattgtttgacttcatgtctctacagtctacataggctcccttttctcaaggcatacttccagaaccacccacaaaaaggggcaatgctgaattccagccagaagaattacaatcccttagccacctctcttcataggatgcaaacatctctcaaaaaaaataaaaagatctttcttcgtcaaatgtactacataagaatatgttatttctcaaacatcttcggaaaaatgagagatagaaaccactgacaatgtgattttgcagttagaatttagaaattcatacaagttttcttttccttcaacaaataaccttcatacaaaatgcaagtctcttgagttagatcactgagcagaaattcaatgaatcatggaaataaatttactaagcatgccaacagctttctgatttctttcaaagatgattgggtttttcaaaatttctaattaacataaaaacctagaatgtttgaaacaacatgctatccatgaggttctcacggtaagacaccaacaaggttccctgccaatccggaataaaggcccttcaatattagtttttctcctccgcgagcagcctagggaaaaaaattatatcatcagcacattttatgtcaacacaacatactatggaaatacatgcatacacacacaaacacacataaaaagggtatagaattgtatggccagtggtcataaactaaagtatacccaaaattgccgtgaagaacacaaattaaatttttaacccacatttagcatattgaaaattttattcaaattcagaaaagtccattatgttatgtaaataaactaactaagtattccatacatatcaaatgcttgaaaaaacttttatagctttccaatttcctcattgttagatttcatcttaaaaccaattggcattaaatgaacttgaccgataagtacataaatcacacccatcaattgaggcaatcgacgtggaactttccaacacccccctccatattccctccaaaaagcacaaaagcaaacaaaatgggccattagaaatagactgggcctaactcacccccaaaaacttgttcaactatttgggccatattccttgccaatgtgagacatattaaatgccaaaataaaattttatggtatttctgtcaagaatcatgcctagctgcactgatgcaaagccttatcacttggcatcatattcaagatttcagcatcaaacagtaatcagtaaaatacacagaaaagcacaaccgttgatcttcattacaatttttgtcataaaaacctgcctgcagacgtgtttttattgtgtcgattgggtataaagctgtttcaacaacaactccagctgtacctcctgcaataacgccctctgcaaatttcatctagctcatcagaaagattgatatgtaataaacccatcaagtatatagtattgtctaccaacttagcaagaaggtaaaatactcttttagaggggcaaaatttcagtttttcacttcatatatgaagaattgggggatagcatcttagtgttggtccgccttctacttaacaaggccttaataattatttgcaaatcacagaagtgaatataagtaggcagtgaatattttatgttttctttccaaatcacagaaaaaacttggtaaacaaactaaacaggaattacaatacctactgaaatcatattttgctgcaatggaacaccaacactgataaaatttctttgctaggaataacacctaagaagatcttatacttaccaaataaagtgcgtaggaagtcaaatggcttttcatctcccatgctaactgatgcaaaagaatttttcagaagtaagttctgctttcttttcgtacaagtatctgcataaccgtatatccttccaaaatgagaagcgatagcacaaaccagcagcaaacagagtgctaaaataacacatgaacatgagactctcacccttcaccctacagatatatctgctaaatcatgcactaaaataacaaatatactaaccaataacaacttaagtttagatgtaaaaatgatattcccttttcgctgaccatcaataacatggacagtacaatccataattttcttactccctccccgaatataatcctaagtcccgacttataaatgttgaattaagaaaacctctggtttccaatggtgccaattgagtcaatatatcataaatcctcgtaacaaataagagcagtaaaaatcaaaattactaaagtgcatttctctagtctgaacatatacttgtatattgtgaaactaataagctcttcagtattctcatcaatagaataataatcctaactaaaagaaaaatgaaagaagaaaaatcacctcttacaccaaccataagtaattggccatcacaagttgaacagttgaactagaacctccacacaacccctaaccctaagtagctaggagtgataaacctcacatttataaattttcatataaatataatcccactaacctatgtcacaaattcaaaaacccatttatacaacacaactcacaaaatgcaaatgggttacccacctggtaatgaaatggcagagtcattaaccataacgggcagtgtaaagggacccattaaggcccaacgattccacctctaaccaaataacaaacaaactgaattggttagtatttaaccaacaaagcgtcaaattttgaaacagagaaacaaaaaaacgacaacaacagaggttgtttccaatattattgtgaagaaataagaatggttacctaagaagtgagaagagtgatagaagggaagtgaagagatgagagtagcggatagaagagcaggagtgtgcagaaacgagttgtctattttttatttgcccaataaattaaactatccgttaattcttgatgcaggcttgttttatttagtttatagtttaatttgcatctataatcagtaataatctatccataataataaattttcaaatccataaataaatttgcttctcgtgcttctcaaactttggaaatatttcataattatttacgaatcagattaaaattaatatatttttaaaaacaaacagagtaatacatttatttattattaatatagttggaacaaaaaatttatccaaaattaatttaatttaatttttaaaattaaaataaaattaattattctccaataattaatgttacacttttcttgaaataagaaacatgaataaagtatatatcttgtagatgtgtcatttaaaaatgcattatgtgtttgtttataattaacacacatttattgaatactacattattgattaatgttacacattaacaatatgtgttaagcacattattttttattttgtgacaagtgtaacacatgttatttgtcgatcacatttattacatatgtttgaaacaattccttaaatcttgaatatcttattgttaacttttaatttatattgttttaattgaattatataaattcatattaattgaaaaaacacaagaataagatgattaaaacaaaatatatagagtgagtcgaattaaaagttaaaacaagaataatcattctttagaagttagacatattcatatttatacatcaagaaaataagacacaagttagcattttaactctaaaacaattaatcaaaaagaaaatttagaaaagaaaaaaaaaaaaaaagacaaattgctcaatgtttcattgatttgttgttattgccattattttatgttgaatttcgtatttgctttatactcctaacttgctaaaggaaatgtacttttgatatttaaatatggtctattataattcatatacatcatgttattgatggtggaatgaaatagtaacatatctacaaacattatttcaggcattcactacattcttttttcctattcatggtcctatatatttatatataaaaaagtaaaagtgaaggtgttgatgtaatttcaatttttcgcttaataggaggttaacataataattttataattttatcatagcttattatttataggctaaaagtgtaatttgcagtgtatgttgctatcaaaaattaaatattttatttaaactaattacatatattgaagaattctttttttcacctgactttttttatattttatgaatttataatatttattatttattattttaaaattataacattttaaggtgacatataatatactatttaattaaataatttctttaaactaatttataaatgtactagcatttttatattttatgaatttataatatctattatattaaaaaaaattaaggtgacatacaatatactgtttaactaaatagtttatgttaaaaaaattatatatctaatgaattaaaaaaaatagttactacttaattatatatagttaattagaggaaatcaaaaatatttattttgatgacaaaatattgaattatatacttttaaatgtaccaatgatcatatctattttttaaatctattataatacaatgacaaggattgtgattgagatttaaatataccaatgatcatatgtaattaataattttattacgaaaacaaaatatattactggtttaatttgatttgatagccattaaattcttcaatcaaatataaatgcaaattttaaaacagttatattttgattaaattaaaattaaaaatttaatgttaatttttaaaattgatacgtaaccacaaaattaattcaaatacaaatgtctctcaaattaaaatttaatgttaatttgaagtaacatcaaatcgttgcactcaagatatatatatatatatatatatatatatatatatattttgaagatttattttttgttaccttagttttttatattttatatatgtataatacttattatttattatatcaaaattataatgttttaaggtgacatataatattctgtttagttaaatatttctttaagctatttttttatatctaatgagttaaaaaaataggtactaattgaattgtatataatttattacaggaaatcaaaatatttctaattgatatttacagttgataatataaaactataaatatatttttaaattgtgactaattgatacgtgcaatcgatagtatatataatttttttttttaaattgttattaatttatacgtgcaattggtccaagttaaaataagtaacaaaaaagtgatatattaaaattgtgtgttttgaaacaaatacgtgtaaaatgccattattcaatctacattatgtttaaagtttaaaccaattagtggcagcgcaaaaaaataattagtacaattatttcttaaattggtttaaaagttagagtcctatataataccattttgattacatactctatattttatctataactatcggttttctttcaaaaattttacatacaattttgttgtgaatacacattttttatattgcttcattgttatcatataaatataacatatatttatttttatttttttgcagttcaatgacgcctaaaatttcactcgttgaaaaaattaagcctacaaccatagaatatagattaagagtttgagttatcaaactatggaagcaaccggaatacaataaatctcatcagattaagattattaaaacaatactccttgacaaaaagttataaaaaatagtattcaacccttctttgttattaaaataacagtttatgacacggtaaaatcatttaaaaaaatttgtattttatgccccttttaacaaaaacaacttatttttataacattaaaaaaattatttttatatatacattttcctgttttatttaatttatgattgaattgaaaaaataaatgaataaccatttgtatggtaaaactgcctatttaatcattaatattttgtcccatatgtttcaaggattcaagtttaagttattgtaactattatttgagaaaattgttaatagtatttattattcatttatgaaacacaaaataatgattattttaagttgttagttagtcttattttatcatcaatttcatttgtcaaaataaatatgactcatcaaatattattatatgttgtcaaagtaggtataaaacaagacaaaaattaaaattctaaaaaaaaattactccccgagtaaaaaactagtataaatttaaatttacaacaaatgaactattcttatctatcatcactgatcctttgttcactaggcgaaaagtttttacataaaagttgtgaaaatcaatgtgaacccaattaaaatgcctcccacattttgcattattctgagaatgtttccactactgatgatagctatagggaaataacaatctccttttgatgggtcctttgatacaatggtggccagcccctcgaaatcacatgcctcaacactttgatcgtttatttgaaagtattgattgaaagcgtatgaagcattgccagatgcatccaatttttcacaagaacaaccagtacctaagcttgtgcaatcaccacccgcacaagcataacttaaaggtccatccaatgcactcttgttggcattacttttaaggacacaccatttgtgctcttggtaacgaaccccttttgctcctattggcattttttcttctcctttgccagaaaaatcaatagggaacttaggcttcccatcataacgaaaaataccccaatgacgctcaaagtcaccaggtgcgacactcttcatgttctcatcaaaaagagaaaataaataagtgttcaggggtccagggtgaagtggagtcccttttttgtttgccattttcttaaggaacccttggtagaacctgtttgcatttttattattggcctttttgtgaccatcagttggccatccaatttcacctacgcatattgacacattagggtgaccaatcttttttaatgaccaaacaagggtatctaagtttgcatcaaacatgttggtgtaatgtgcatttttgtcatcagtgcttttaccattaccttcaaagaacgcataatcctctggaaaatcttgattttgatatagactaaggaatggatatatgttaacaagaaatggtgacttcttttcatcaagaaacttcactatttgtttcatgacaccataaatgtcattgcggaaattaccatccgagggtttgtttgaactagactcgtaaacatcagcatttaaagccgtagtcacctttattttgtctcctaaaccagccttatcaatagccctttgaacattttccattgctggaaatgtgattcctacaaatgacccattgtaacttttcaagaatggctcatttccaacggatacgtatctgcaacaaaatagtgaatgaggatgaaaaaaaaatgatttcctaatagtaaatttgtgatatgttgttcatggaaattaaaagatttaattaatcgcttcatttttgtccatatacctaaaaactctaagctttagtttctatacaaataactcttacgttttctccaatttgtagtatttttactacaaaaaaagagctaacaacatggatgtcaaaaatagctcgtatatgaattactaattccgttcctatttaaaaattctaaaacttttttatatttgtttgtttctttgtataatatctaattcatatgcttcatgtattaattgtttttaaattaaaaatactcttaattaaaaaaaataagagacatgttatattattattcatttagaaaaaagataaacattaatgataattgtatttttataaaaatatataaatttaggataaatttattgttataactaaattaattatcattattttaatttggattataaataaaaacgaggataataaaacttaagagttttaggtataaggagtaaaactaaaaattggagcaagttaagtactaagtgattaactaaacctaaattaaaaatatggaaatagaataatgtgagtcttatgtgaaggaattgtatattcatatacacacacctgatgttgacccctccatcatgaatatgtttgctgacattttgtttgacccaatcttctgcattatcttggtctttggatagtttcttcaattgatcattgggaattccaaccatgacttcaatgtctgtgccagaaaaagcacttacagtccaagaatctgcatcaaaaagctttacctttttaattccattgtcctttagcaaattcaccacaatgggaggatccataggatgagatgctattgcaccccaattgacaccaataccagatacagcctctgctccttcaccgccttgcagctggcaatgagccagaaccaaaagcatacaaaacgcccacataaaggagaaacggtaaatattagtcaaagtaataaagaaaataagaaggttaattatcaagtgaaatatttgttaagattgaatgatttacatttgaaaaaacaaagtggatgttcctaatcctgtgtgtttaattagctatactgtctaaataaagcattaaatgagtattggttcttaagctacccgtgtaactaactatctatatttgtagatggtgtgtaatattctaaaactaatctagaatttccttttttaaatgattgtccattttatgttcgagaatatttatacatacgaacatatacttttttgacaaaattaatataaaactaaaaatgatttatttaaaaatataaatagaaaataattactagtatgcgatatatttgttgcgtaagtatataacttggatggatggtacatcagtgacttggataaaaattagagaaaaaagtaaccgagagaaatattaatatagtattttttaatataaacggcaaatattcctaacactcaaaatcaaaacaattaagcataccggttaaaattaaaatataaatataataaataaaatatataaaagatgattttttatgattaagatttttttaacttaaattttaatagaattatatcataagaatttaaaagatgattttatagatttatcaaatttggaaaattttcataaatttttaaaaaacattaaaactaaaaaatcaataaaaaataataaaaattgaattaaaaataaaactaatataatttttcaatttgaattgctgtataataatagctacaaacgaattgacttctccgtagtattacatggacaaatgtccaggtcgtagtgtccgagccatagaagcagcatatagcttcttattctctccccttaaatccacttgtaacatcctatagcttgaaatttgatgtcaacgtccatagacattatacaatatgtttctcttctacacacaagcaaagttgacgtgcatcccatgccatcatgattgatacggtattaaaacaaagttgcccacgcctgggtcttcgtcatatggcaatacgaatattgtattggttcaataattgaaatttgatgagattgtattctttgagaagaaagttatgaaaaacaaggaagaaataatgaattacatgtgattggagaaagaaaagtatgacaacgtaatgaaaaagaaagaaaaaaataaataattattttcatttttgaaaatataaatcattgataaatttatttttgaaaaataaaaattcaaattttaatttcaaaaaatgttataaatatatcaatatgtaaacttttgtttgtgtaagttgaatgaaatagtcgtacccaacacaaaaggaaggatgatgaaaatattataaaaataattgtcgatataattattaaatagattagaccaaaatatcaataattttttattggactaaaaaataattaacttttcattagactaatttgttagatcccaaaattcatttcatttaaagataaaatataattaatcttcatcttttctcctttttatcgttgcaaacataacattataataaatattttaaaaaagaggaaaataatcataagttaaaaaaatataataataaacataatattgattaataaacatttacaattttggtctaacttataaaaaatgataaatttagttaatccttataaaaattaagactcaatattatgtttattattatgtttgttatagtttatgtttgtttccctatattttttaagtgtttattgttctaacttatgtttgttttcctatattttaggtaaaatataatttaatttttatcatttctccatttttaagtgtttatattttacccttaaatgaaacaaaatttgagattttgtaaattagtctaatgaaaatttattgacattttggtttaatatattcagccatcatattgacaatcatttttgtaatattttcatttctctgtatcacttagactttatttcattaataataacatagaaaagttatcatagatgaatttttctcaattttttcattttcggatactaaaatttgaattttcattttttcaggacgaaattctatccattcaaaaataaaaataactatttaccaaaatagaaaatctataaaatttcaaagaatttgattgagattgtttaataaatattatttattataatatgaaattcattctaaaagataatctattgaaaaatttaatgattttgaataataaaagatctttttaagctatacataattttaattgaatatcacaaaatttttattatcatattctaaaattcttaattaaatactatattttttatattatttaaaaatcataattcaatacacaagacttttttatcaataaaaaatcttctaaaatccaaaatccaaaatgaatatacttccttaaaattgaataaattaattagacctattataagatgaagggcgctagggtagccatatttgtattggcagcttaacccctccgtaaaccctagtataactggaaagaagcagtcgctttgctgctctcaaccgaaattcctcagttcagtcgctgccgtcgtctcgtcgttttaccgcaggtctcatttcttgctcattattgtttcttccacctgaggccttttatcgtgcatgactctttattgactcagttacgattgtgctattagtgacagttcacaattcaattgtgaaataagaaatttgaaattctggaattgaaaacaatttcaattagacggtttattctttatttattctgttgttgatatttttggtgtgatatggtgacttgtgagaacttaaattttgtagcagaagaatgagaaagaaagttgacgagcgaatcagaattttaattgaaaatggcgtcagatcaaggcataggtcaatgttcataatcattggcgacaagtcccgtgaccaggtctttttatattataggcccctctctatttgaatcattttgggaactccatttaatggaaaagagttaaagagtagtgcaatttgagtgcttaatgcggtctatactgtgtgcagattgtaaatcttcactacatgcttagcaaggcacagattaagtccagaccaactgtgttatggtgttacaaggacaagcttgaactaagcaggttctgtataaaatcaatgaaactgtcttgtgcgaataaactttgtttgagttattctgaatgagtttcactcgtgcttgattataaatgtgctaatgcagtcacaagaaaaagcgtagcaagcagattaaaaaattggtgcagaggggtctctacgatccggagaaaggtgattcgtttgaattgtttgtggcaagtgggggattaacttattgtttatacaaggattcagaaagagttcttggcaatacctttggcatgtgtgtgcttcaggtatcacacttccttctagctcaatttttgtgcagttgtgctttctaggctgtgtttctttcctttttacaagatagataaatttttccatcatcttcccatttaggattttgaggcgttgacacctaatctcctagcaagaacaatagagacagtggagggaggagggctggttgttttgctgcttcgttctctatcctcgctgaccagtctgtacaccatggtgatggtatgaacatagattcatcagtgttgatattcttgtttttttttttttcttttttaattttcaattcatttggctaattataagtgttgttttaagctgtagttggtgctcccttcttttgatgatatttgagccctgtgaccaggactttgatttcaggataatcattttttgtttgttttctgcattgcatttattgaagttcatagactttcatgaaatattagacatccttctcataaaatctcgttttataaaaaggggtattggtcattaattgagttagttgtgttagctaatggtttctttacatgcattagaaatggatttgatatctctcttgactcgagttgattctctgtattctatttatgttgtttcctttattttcttttatttattattcttgttggaggatttcttgtcctggttagttgttaaagttattttatttcctttttcttaataaattcattttatataaaacatatacggtaaatttagccataacatgatatctaagttagcatacctaatgttgaaaaaataaaaataaaagaatggaaagaactactgttagataatagaataaagaaacacaagaaaagaggatttcttgaaagagaatctaaaagcacaaaatctagaacaagaaaggcacatcaactaagtagttaactgactttaaaatctatatatttcctctctaaatacacacgagctggtgagctacataatgaggctaagtagacctctgtatcccacaaatattataaagtttatgcatgaaaaacttctagtatttctgtccatgcacaagcaccatataacgaaataagacattgcacgccaacttgtatcccttgttactactccccaccttggtaattttttttcatcgttttgaattataaaaacacataaggaatcagatttgtggtgcatataagagacacccccaaaagttctttctgtgaagaacaacttctctgcaagcgaaaacttccactagctttagtccatttctcaactagaatatttctcatttttgttaaatccctaacctataattgttttaaaatgcacacacacacacacatatatcatgaaggatacatggccctatatgtttgatcagggcttcagtaaaataaatgtattgtatgtgagaagtaaatattgctcctaaaaatagttatatttgttggactctagtaaaaatgattgcattgttctcattctcctagcacttttcatggaagcctgaaaaccagaaatttatatttctatgattaagtagatgagccattgcttaccatgctacttttctgttaaaagtctcattaaattcaacttgcatgttgattgctgattgcaggatgtccatgatagatttcgaactgaatcccattccgaggctgctgggcgctttaatgagcggttcttattatcacttgcttcttgcaaggcatgtgtggtcatggatgatgaactgaatatattaccaatttcatctcacataaggtctattaccccagttcctgttaaagaggtactttcattacatcctcaactaaatatttcttttttccttttctttttcgatggggtttgcatatagttttgggttttaatgcatgaaagacctaatgccaaagtgagcataagtgcaaaagaaatcatcttttttataaatatttttgctggttttacatctgacttaaaattaaatatgtaatgtgtcttcattgatgtttctgaagattctggtgcaaacaggtccttttgcctccctcaagaatctggagaaatagtgttcctacttcctatatgtattgttcagatatttgtacttgtaaagatgtaggggagagataatacagataggaagatgaaatttggaagagactagagagagtaattctgtaatgggatgatctgtatagcataacctccctgtatgtgtgtgtgtatatactacatctggtcctatatataagcaatatagtacaaatcatcaagaccaaggaaagtgttggtcacatttaatactaccataaatttaaattttattccaaaagtgccctaagtttaaatgttgtaagtgatggtttcatttaatattaatactcatagtcgaatgagtgggtttctagtaaatagagttaaccataaattaagggtataaaagacatttaactctgaataagttttaaaactggtcattgttgctcctaattaggaccaaagaaaaataccatttgttgcttatatataggacccgaggtagtattatatactactagtactaattaggagaaataagtcttgcatcatatttaaggcggatttccaaaaagcatacgattcagtaagttgggatttcattttgtacatgctggggaggttgggtttcccacctaaatggataacatggatcaaaggatgcttatcatcagcatctatatccatactggttaatggcagtcctacttcagaatttcagcctcaaaggggaatccgacaaggagatccattggcccctttcttgttcaatattgcggcagaaggcttaacgggaatgctaagacaggctcaagctaacaacctgtttgaaggcttcaaggtgggaaatcaggatacagaagtatccattctacaatacgcagacgacacgatcttttttggggaagcatctaaccaaaatgtgaaagcattaaaggtattgttgaaaggttttgagatggcttcgggtctgaagataaactgtaataaaagtaatcttgctgtctttgggagagatgcacaatggatttctgctgctgccaatattcttaattgtggggtgatgtctgtaccgtttatctatttaggtattcctttaggggcgaatccgaggcgggcttcaatatggggaaatattatcagaaaatgtgacagaaaactggctttgtggaaacacaaactcctatcttttgggggaaggctaaccttaattaaagctgttttaaattcgatccctattttcttcttttcttttttcagggttccgctacaagttattatcaaattggaaaggttgcagaggagatttctgtggggctctaatttggaacaaaacaaaatcccatgggtgaaatgggaaacaatctgtttacctaaggagaaaggagggctgggcataaaaaatttaaggcttttcaatcaggccttgttggggaaatggggctgggacttatttcatcatccgaaagctttgtgggctcaaattgttgaatccaagtacgggggctggaggaacctgcagacttcatccaggatatcaacggcgtcaacctggtggagggatttggccgtggtttttggatctaatcagatcgatggatggttttttggtagccttaaatggaatatagggaatggtagtaagatcctattttgggaggacccgtggaaggatgataggattccgttgaaagacaaatatcctagactctatcagctatctaaacaacaaacaaagcacattcagcaattgggttatcaatatcaacatgcatgggaatggcaactactatggaggagaccatttagggacactgaagttcaggcggttatagaatttcttgaagacattcaggtaacgccaatgcaccagcaacaagcagattcttggagatggactcacgataccagcggcttgtattcggtgaaaagtgcatacaacatgctttcagaggagggcaacttatatcctcaagaggaagtgttcatcaacctttggaagctgaaaatccctttgaaagtagcatgcttcgtttggcgacttttgaaggacagattacctacaaggagcaaccttaggagaaggaatatagtcacacttgacactctctgtcctttctgcaacacatcggatgaggatgcttcacatctatttttgtcttgcccctgtatcttacctctatggtgggagtcatgggcctgggttggaattagtggagtattttcatccgatccaaaggaattttttacacaatcatcctttggtcatcttacagggaaagctctatctaggtggcttacttggtgggcagcattaacatggtgtatttggaaccatagaaatcagattctctttcaaaatgcatcttttaacggacacaaattgatggaagatgctattttcttctgctggtcttggctgaggaatttagaggatggttttgacttctcttttcatcattggtccagcaatctaaaacagtttttttatctttggggaggggctaactcattggatgtagttattttgtactttgtgattctcgaatctgtcagaacttagatggctttgatagaaacccaccaaagttctgaatttattcacatgttttgtatcttcaacagtactccttgtactgtttcctatccctttttttttatatatatatacatatctatttttgctgatcaaaaaaaaaaaaaaaaaaaaaaatatactactagtactaggttaaggatgcagtataaagtacatctagactctgcccacctactctcaagtctccataactcttaaaaatactgattaattttcactcttgatcttccattgggatgcaatattccttatatttagtgtcagatgcttacttgttgctgataaaaaaaaaagatgcttgttgttgaaaacactatcatgataattgttggagttaatattttctaatttgtggtgttgtttgtactttttcatatagttagaaatttcgtaaattttggtctttgatatttgtataattgctagtcttacactctattctaactacatctaattgtagcatgggcttgcaattttttaccaaagccatttaaactatatgtaatggtttgtctctgaattgatgctgtaggactctgacgaactctcagaagcagaacaggacctgaagaaccttaaagaacaactaaatgaagatttccctgtggggcctttgatcaagaagtgttgcacattggaccaggtaggtttgtttacctcaactttgcattttctactttgaccaaccaaattggtttttgggtggtggatgcaagcaagttttatatgattttggttaatagggaaaagctgttgtgacatttctggattcaattttggacaagacacttcgtagtactgttgcattattggctgctcgtggtcgtgggaaatcagctgctcttggcttatcagttgctggagctatagctgttgggtactgtgccttctggacagatatatatttatatggacaactatacttttagtatcttatagaaaattctgtgtgtaggtattcaaatatctttgtgactgcacccagccctgagaatttaaaaaccttgtttgactttatatgcaaaggttttgatgctcttgactacaaggtactagttctctcccttgttgacagatataacccttattggttaatttatttggacaaatcaagtttcacatcggctagagataatgctaagaaagaatatataagtgggagacaacccttaccttataagccagttttgtagggttgggttaggctcaaatccaaatgctaagatggtattagagcatatcctgaatccattatgagtcacctaccatattatctacacaccaagcccaaaagtgctgagtgtgaggtgtattgtgaaaaatccaagtcccacatcagctagagatagtgccaagacaattaatatggatttagtcataaaaagttctaaagatggcaactgggcactttaactttggtaattacgtaagcaaaagttccaaggatggcaactaggcagtttaattaagtaaccactggcatttatatttgatttctatatggttcattacccatcaaaatcataatgtagtgcatatttggattaatttatctgcacaaaagtgaagttaaaaaagggtgacccagtacacccttgctaaatgtaccagctttttttcaaacagtttttatccttaaaaaaagccttttatcacaatttaatcatttccaaaatacattttaagagtgctactgtttccaatgtcaataggaacatattgattttgatgtggtgaaaagtgtgaatcctgagttcaagaaagctactgtaaggatcaatatttacaagcaccacagacagacaattcaggtaagttcattgaaccttttgcattaattactgttaagggaatttactgttgttgtgaggttaggagttaattctggacttattttccatcgtaattcaatcagtatatactgccacatgagcatgaaaagctttcacaagttgaactgttggttgttgatgaagcagctgctattccactgccagttgtgaagtctttgctgggcccatatctggtcttcctgtcttctactgttaatgggtattagtaatgtttgttattggtgaaattttccatatatcatgccaaatgcatttttttgttttttttgtaaacaattatgattttttttaactcattagtcaattttatgtctcctcatgtggcttaattactgacgattttttttaactcattgaaagttatgaaggtactgggcgctctttatcactaaaacttttgcagcagttggaagagcaaagccatgtgtctgctaagagcacaaaggacactggtatttatttgtgctcagagcttttagaagtcagtttaaataaataatgtgcatgtcatgtgctgttttgtacggaaacacagtctaagtgggttatgaaattaagataattggttttcaatgttctgttaaatgattgtaatacaatgttttcaaggtccatgtgcaatattgctaaatcttgaattatatgtttcaggtcgtctgtttaagaaaatagaattgagtgaatccatcagatatgcttctggggatcccattgaaagctggcttaactctctactttgcttagatgtttcaaacgccatccctaatattagcaggttatatcaaaagcttatttcatatttcctgggaaaatgagaccattttttctctatctccatttactgtttttctcctgaaatcaggttacctccacccagtgagtgcgatttatactatgttaatcgggatacgctcttctcctatcacagagatagtgaattatttttgcaggtaaagtcagattgatctgtttatgtagggtggtttgtgattgatattttaatgtgatcagatgctgtactaaaatattctattattgcagcgaatgatggccttatatgttgcatctcattacaagaattctccaaatgatttgcaactgatggcggatgctccagcacaccacttatttgtgctgcttggtataatcatttttctttcttgttattcttcttttgttccattttttaaattaatatcactcaaattagtcttataataatatttgtgtgacaggacctgttgatgaatcaaagaatcaacttcctgatattttgtgtgtcatccaggtttgcatctttagtataaatcaccctatttttctgctgctttttttgcatatggcctgtctcattggcttccatgatggggcttggctcatctgttttgtcagaacctgttatgtccaattaatggtaattttttttttggtttatttcacactgtttgattatgatgggggaaattgttgacttgtttcttgtgatgtgacccattatgaagcaacaagcatacaacatattgtggaagccgtgggaaacagttattttgatattgatattatctacagattgagacactatctttatattggtttataattagaatgcttgaagctttggggttctctttgtttaatattgatgcttgatagcacatatcagtttttttaatcagatatgtgaagctgctgtatatgcttgagttctgatttatgcctccgctttatcctgctgctcaaaatttgtattggagcagtaattacagtatttcaaatttatggtggttgcatgatccttcattcaaccgaaacttttgccaccacctgctcctttttttttatatatagttttgcttaatgttagctttaaatttgttattatttatggttatagtacagatgattatgtttactatcccgtcttctgcttgtcttttctttatgacttcctatattccgcaactttgatttacaggtttcccttgaggggcagatttctcgtaagtcagcaatccaaagtttgactgatggtcatcaaccttttggagatcaaattccatggaaattctgtgagcaattccgagatacagttttcccctcactttctggtgctcgtattgtacgcatagcggcacacccaagtgccatgagggtaacttttattttctgctctggcatatggtttaaccagattctgccaaagttgtaacttatttcttttatttcagcttggatatggttcacaagcagttgaacttttaattcggtgagtgcatggttgctttcttgtttcaattggagtaatgttcattttatcttttcctttttacacaaggttccatgagcatagaatgctcttcaaaagtttttaatttaatatttgatttggtttgggaggagccttggttcaacatgatagaaaatatctgatatttgtgtgtacagtcaattattgttataatcaagccttattattaggatttacattattgtagttgatgcaatgtagtgactctatttgacacactctttatgagtggctgaaatttattagaaatcaccaattttggtgggccccacttctcatttaatgagacttggtttagaaatgggacccaccaagtttggtgatttccaataaatttcaaccaatctggaaaaagtattagaaagagtgtcggagagagtatcgctagcattcctctaaatatattcttgtgtggtctgatcatattacacagaattccagcatatgctgttttctagtgtaagcccactgccatgggacctgatggccttaggttctagtcacatcaacctctatatttatggggtaagcctatgcactttttaccatcttagaccccacaatgttgggagcatcatgcacagggctgccaaagaaatgatttggcttgtgtatgagttgtcctgttcattaaacgttgctttaagagaagctataatttggtgcttcattatattgtctttttttatatatgccaaaatgttaaatgcagaacatcatcaattaatcatttaaatcactgtctgcagctactatgaaggacaacttacttgtatctctgagattgatgtcgaagataaagtgcaggccccacgacttagagttacggaagctgcagagaatgtatgttaccactgaaagtccctttttgaataggtttagttagttgtgttcataaaagtatctgaaagttatgtatattatgatggtatttgaattatctaagattccattcagtctagctgactggaatctgtaagatcaagattgaaccagtaaagacagcattttcataattgagaaaatgtcattcgtactagttatattaagcacatttccaaaaaaatgacttaaccttagagtaggctttggaattcaaatagttttatcaagatggagttggtttggttcttcaatttttttatgctgcttttcttttcaatcagctttgacatgcactgcccagcttttggaactatgggcttttttacatgggagattatattctcttgctcttgataaaataaatgtgatttaattactgttgtcagttgatactctctgcataaacttacgaagtgtctgatattcatgctaatgatgctatggtcctaatttcccttttgtagcattcatggtgtctgacgtggaatatatcttttaattgtatattttacttttttttccaaaggaagatgaaatattttcttgcttctttcactggctttgtttgatttcatagagaaagacaaacattacttttagacaggtccttggtttcttttagctttaagatattaatgactgaattcaaacatacagtgcagggtgcatttgagcaagaatggtaggctatatttgatttgttattttctgtgccttttaactcttaacgatttatgtttatctttttcaaatatgctttacgtttttcatgatactactatggaatatggattcaggtttcactacttgaagaaaatataaaacctagaacagatcttcctcatttactagtacatctgcgtgaaaggcagccagagaagctccattacattggtgtctcctttgggctaactttggaccttttacgcttttggaggaaacataaatttgctcctttctacattagccagattccagttaagctttattttttgttcaagcagtagataacactgaatttatttttacaagtaattaacatggttttcaacttgatagaatagtgtgacgggtgagcatacatgcatgatcctgaaacccctaaacaatgatgaaattgaagctgatggatcaaatcagctgggcttttttagtccattttaccaaggtgggttcatcttcctatgctgttgtgatctttgtgtttgatatttatgattcattttgtgaatggttgatgatttagttcgctacttgtagattttagacaaagatttgctaaacttcttgcttccacttttcgttgcatggaatacaagcttgctttgaggttagtattaagaatttagtagttcactgttataattattagatagtgatttggatattttggagttcattgaattctagggaactaggattatgtgcatattgattaataagattttccacatctttattttatcattttaataaaagaagtattggtagaggagaagatgaagtgcaaagcagagtaaccgaacagacaaaacaaaagacttgaagaaaaagaacttaatatttcagtgtatttagaatacaagctctaatccccgtttttataggctaaatggctgatgctaattaagggaaataggggaaaacataagaaaggaaataggaaaaatattaaagattcaattagatatttatttaatcctaataatatcaaagatatttactagagtccccctcctcaagttggtaaatgaatatcagttattcccaacttcctagtaagttcttggaatcccattgtagggagctccttgtgaatatatttgccaattggagccccaaagggatgtaaggtgtagttataagactgcatctataagtgaatattttaaaactttagggatttagagtttctttaactctaggatacatccctcatttacatctctatttttctaaatgcatattatcatgataatttatccagcataatagatcccaaaatcaatttcaagtgccaagaccctacggagaccacatctgataaatgtctgcagtcggtcagaggttatttatcaccacatgatatgaagcgattagaggcatatgttgacaacctggctgactttcatctggtaagagctcaagtgatggatatgataccataccaatcagtttttctagatggtttcttgaagatgacatctaataccacttagttcctatttataagacccaaattagaagagatgttttttcctttttataagacttaatccataatgtctcttgcattaattattttttgattaaaacatctccaagacaaatttattgttataaactaaattaacaaattttctaatcctaatgaattaggtaattgtgtcttatacataagaacgaaggttgtactattttggtaattgaaaattgttgttctctactcctaatggctctcacttccttggtaaaagcctaaaaggcgacctctttttcaattttcaaagtattgctcccaccccacccccacccaaaaagtgccttagtttttttttgccctaatatatttttacatagcgtaattttcatttaatttgacattgttaaagtgagtaataattttttatcggataaactgcagtggccagacaaattaaatgcacatttacgtgattttgcatgacatgtatggtcatcaatatgtgagaatcatgatgagcaacttaaatggcatttaagatacttctgtgtggtgaactgatgtaatctcaagcaccttgcactatgtcactgctaaagttgtgatgtaactgtgccaagcatagtccattgaaataacataattctgattgggtgtgcaaaaaccagttccataaaaaaaccaaacgtaactggttttgaatcgttttaaccgattcagttttatatccaaatagttgaagtgatttagaaaattggttctgaaccaaattgattttgaaccaattttaaacaggttctaagaactgaactggttccggactattttttcttataaaaaaattatccaggtgaaaattagttcggttaactaaaccgattttttagaaacaatttggttaactgaactggtttttcataacagtgtagttatttttttcaaactggtttagtttcagttcggttacaatccggtttggtccgaaccatttttttttttgcacatccctaattctgattatctgttaaagaaatttgggtgcttttaagtttgatcttgaccctttttgtcttttacagattttagatttggttccaacccttacacatctgtacttccaagaaaagcttccagttacattgtcgtatgctcaagcttctgtgttactctgcattggtctgcagaatcagaacatttcatacattgaggtctgtttatcaacttattaatttgttagttgtaatactacactcagatgacgatatagcacctgatgccttgtacatcaaagcaataaggataacataaagctgaatcccattaagttaatttatatgcacttatgttagtgtaattttttgtacagatatcaaataggagttcgctttgctgccacattataataatgaataggatgatgtggtgataggatgaattcctattgaataaaaacagttttatattgattgtgcatataaatcaaactcaaatgctattaccagatatacaaaacaaaatccttatctcactaggtgaggttggctacctggatcatgtgttttagaaaatatactcagccttcttttgaaatttatcatgcattggtcagtttatcatgatacagacagtgttatcaatagcagaacatgatggaaggctgaaattctgccatataagcacaccattgcagtttatggtactgcagtggaggcctcttaacaaattggctatggcggttggcaaaaaattcgtcacaccattccgccatggctgttatttaacaacactggatacacattttctatcagatcaacgagtcagtctaaaattcgttgcatgattttgtttgaggtttgagtttgcctgtttgatatcttcctccattggtgccttttcaaaaagatggaatcacattctcttatatgccctttttttaacagggacaaacgaatttggaaaggcaaacaatattgtctctatttataaaggttatgaagaagttctacaaatatctagatggccttgcatccaaggagattgaatcaaccttgccaagactgaaagaagtaagtttcttaatgacaatttaacttgtttattccatggtatggtgctttcagtagaattcatagaaatttttggttagtgaactcctgctgcagtgtgtttaggaacacattctaatttgtgcttccttttttatcattttactaatcttgcacctcttctttttccttctcatctgggttatgttctgttttgtccctagattgtcatggaacctcatagtgtctctctggacgaagatctcaatagtgcagctaaacaagttgaggtatgtgccttcaccttttgttgttttttgtttttgtcaaagatccctaccccgaatcccatctttgcttgtttttacctccggttttcatagctcatattttaaatgattgtcactggataggatgacatgaaatcaaaagcagaagcaccctttactcccgaattgctccagcagtatgccattgaagatggagaatctggctttgagactgttttacaaaataatggtggaaaaatacccacaggtggtcttattagcgtgaaatccagcaaagtgcagcatgaaaaggagaagggaagccataagagtgacagaaagcggagtaaagataaccacaaccataaatcaagcaaaaggaaaagatcgttgaattgaccatgggaagaaccagccaagataaaactatgattatttcagggattgttggtcctttttgaacgcccatattgatataattttaccagccctttttggcggcttaagaggatagatgaccacaatttctagttttttctccttgtggacaactacatcagtgctatatatatatatatatatatatatatatatatatatatatatatatatatgggtttttcctagaaaatgtatattataagagacagatctgacggtcttgtttcaacattttttagttgcaaattcagagacatgtaaacgggactctctctctctctctctctgtgcgtgtcttacaaaaacacactgaaattgagatacgagatgagtgtgtccacaacacaacacagcattaacattaacgattaaccatttaaccttaaccaaccattgcattgataagcaatgagtagcttagaacttagaagctgctaccaatcacaaaactcgtacattctaattttttaaaaacaatcgtaaaagtacaatatatcactcattttaattcaaaattaaataattgtataatttactaaaataacaaccaatacagcttaagaattaaaataaaatataataatttattttaagttttttgacatttataaaaagaaatataatgattcgtgattttcatgaactaaaatgataatttattcaaaataatttcacttatatagatagtaactacatttaattttcatatatatcaagacaaaaaaacaaaaacttaattctttttaccccaatgcaatcatacaccacatgaaccccctattaaaaatttacataagaaaattatatttaaattgtcttaaaacaattccaattttcaaacactcgacatttaacaaatcactaatccttctaaataatacaatcaccataacgtcaattgtacacaccccccaggctccacgatgtttctttgaaaacttcccacgatacttgttactagacaattttcatcaacttcttatttagaatgttgcgcaaaaaaaaaaaaaaaaaaaatctgtacatgtaaatgtaatctttccaatgtaacaataaattgtataaaaaaacacgagctatatattcatgtcatattttaagcgacatcatatgtaaagaaataagttcaattttctttcaaatgggagtcataatccttccagcatcatacctctgccaaagaatcacaatttgaactactcagcatagcactctaagaatctgtaaacctgcaatgttcataacttcatatccataaagattatgaaacaaaatctgaattgatcgcgtacttcttttagggtacaaggaacagttcattttaaatgttgtaagattgttgccagggtcgagaatttcaattaatcgatgcatgggatccaatgggaacagccataatatcaagaataaatacttgggaaacatgacaagaaaaatttagaaaatttgatcgcctcaacttccagtttaacatggaatttgaaatacaaaaagaccttgaaaaaactcaagaatcttcaaactggcatcaatgttgcacttcaaaccagtggtgtctacttattcaacacagcttcatcattatccaaaatgcaataatttctagtgtgcaaaaacatccttaagacatttaaaggaagtttctgatgtccaaagttttgacatcgactgattcaggctcatccttgaattcctccctgaaatggcaaaaaagacaaagcaaaatcaatcctacaatggtttaaaatttctatcctattgcacatagaaacccgagtggaaaggaattctaaaagtagaggagaaaacagaagtccaatttccttctcttggacagtgttatattcatacgttcaaagttcaaaagccataaacctacagtgcaaggaaaggccaagcatcatctttggactttggacttgggagttaaaattaagcagaaaagaaaaggtaattattatgtgcttatcaacgatgttctgggtccaaaagcacagagaattggggagaagggaaaatacaagagcaagatatgatatcattagtagtacctcttcttttgagtttccattgcctcaagagcatccttcttcagctcctccagttgtgctttggctactttaatttctagctcctcttcatacttcggtagatcttccttttgaattccaagtctaaggtagaccaccaaaggaagaaaaagggggggagaccaaaaaaagagagaaagtaattacaacccagtaatttattgcgctcaactgaagagaataaaaacacttcagaattctcaccagaaaattaggaatttaaacaaccaaatggaatgcccaatgaataaaactaaacactgtgatgcaagctttttttttttgctcagcaaaaatatatatgtattatataaaagagagaaatacaagtataaaatgaaaatatacagcctatcagacagaacagaccataaaccacggctatctaatacaagcagggacctggattggatagcctaagatctggctgaagataggtccaaaaccccaacagataggctgcaagcttacgacaaagtggagaaaagctataagcttggtggagggttagacctgttattatctctatgttccatacgatccctttttagttcctatcctcttcatttcccccctccttctttcacccttcttttcttttatcttattttcttttcttttgtcttatttcccctttttcttcccctaacccttccttttttccccccttcaactttctcgtatctatttttgggttcatctaccaccgatcccaattaacaaagacaaaacttcaaaaattagatgtcaactagaatgcttccttctatttaataaaaattcctcctctatatttttatagcaaaaatccttaccctatacaccatctaatgaaatgagcactttcccatataatgagtgtgtaaatgccactcaaccatataaaatattgataaaatacccaacaattagaagtaattgcatgcttacattccatgacaatgatgatgaaataaaatcatcatggaaacagattcaaaagctagaattagatgtcacataatattagctgaagccaacatatcaaaaatatatcaagggatatgagcttacttcttattaatcttatcaaactctgccaagagaaggtccattcctttcttatcatttctcagtaaaggtttttttaaatccttttcaactttgtccaatgcatctatcatcagagcctctgcaccaagatcatctgtaagacctctcctgttaaaaaaatgaacatataaatatatgtgctcatgtaacaagaacccaacacatcctgaagcaagggatgcaatatgttgccttttatctcaattggaacatatgtgtacacaagtataaaaagacaactattaggtgaaaataaatcccaataataatttaggctagtcacaatttgcagaaagaacaaagccattggcaatttttagaactggaggtttaaaacaaaagcaaagccaacatggttcatggaattgaaaaaatcattttacatatcacaaaataatgaagctggtataaatgaaaaagtaaaagggcacactttacatatcaatatcacatctagttacaaaatgaagagagtagagagaatagatcatcatcacacacttgactcttatttccttcaaagtccgaagataggtcctagcatctggaatatcctgtgtctccatttcaatggtggatagtatgtcttgggactccgacaataagcttgccctgtagaatgcacaaaagattgtaggcataacataattaaaacaacaaaatattgagaagaaatagtcatataaaaagaataagttaaagcagaatctcacttctctctaactgttttcatgacctttgcataatgagaaacagcagctggatcttctgggtcaatggtgatcttctccttctttaatattcctatggcggtctcaaatttgttcttcacctccacaaaaatgttcttcagcatctcttttcccattcaatcaaagaatatgttgtcaggaagcaacataaaaataacaatatttccattgaagatcaaaatgcatattttaaaactatacaactgtataagagaactcacggtctcccttaagggcaggaggggcagattctttagcaaagtgacgaactggaatagcatgctccttttgcagaagtatttgactgccatagatctgtaagaaaatgaagaaaaatgaacacatgaaaaaaaaaataaaatcagtggataaaccacaaacatcatcactttctaattaataaacaaaacttatgcatattaacgaccatggaaacatgagtttcatatcattcattttcacacaccattccgcaactcaatatgagataaatcacaaacatcgtcacttttaaattaataaaccaaatttatgcatattcaccatcattaaaacacgagtttcatatgattcatttcaacacaatatgacacataagtaacaagcaccaagacattttttttatcgggtggccataactgatgatgatcagggatcacaaatccaaacgcattgactactcctagggtgcaaacaagcgaaaaacgtaatttccccaaacaatagaatcagcgaagaaagaaaaacctaattgaccaaaagaaatggataaacgaaatgttaaccctcgaaatgtaacgaatattatctctttttcgagtaattttgattttaaattatcgggatagacaatcagatatcgctagatgtattgaaagcaatgcagatcccgagattacaacaacaaaatcaaaagtgagaacgtgaaaagaagaaaaaaaacgccatgaagaattgaagtcgacagagaagaaattggtatgagagataccaatttggatttggaaaagagacgagaagagagtgccatgagtgacgaatattgagctggctcacgaatgcgtgcgtagttagggcttcttcgtttcactttggtaattctctctcaccctaatgaaatgaaatgagtttcacaggaatcacaaagggagtaatcaggtagggtaccccagttctggtgaatgggcttcgccttatatctcagccgttggatatacctcccaagtggtgctctcgctcttttatacaaagaaatgtttttaattttaatatattataatgttgaatgtgaaatttttacactgttaattatttaagatgtaagttttaaaataattattacaaaaattaaaaatcttataatttattattgaatatcagtccaaaaaatattcttttatcgtaaatacattctaattagattaataaaaaattcgtaaaagtgttatcattcatttatacccaaaaattaataataacacaatgacaaacataatcactacaataacagtacattatatatttccaaatttaataggtattatttttaaatttagcataatctggttaatgttgacagttccagtatattaacattttctgtataaaaatagattaaaacattttattaaagaaaaaataatatattttcaaaattcttttatctctttttttttaatcagcaaattttcttaaatcttagttaatgacagacttttgatacttgtttgaaatttaacatcaggtatttattatttatttattataattattaattttattttacatgttgaatgttgttaaaactacttttcatatttatttttttataatttgacgaaaaataccatatgaaaatcaaatggcaaccactcccatgtcacaatttttatttttatgaaattttgaataaacgtcaattaacgaggtcattttccatatgaaaaaaaaagttaagaaatatgaaaagtaatttgtacaattttttaataaacattttttatagtatggcgtatttagacatttcgcttcaataggtactggtagatattgcctaaaatcaaataaaaacattatactatttattaaattgaatgttcataattgctttgacttttataccaatatgtcatttagattatgtaatcaaattaacttttatagtgaatattattaagacaaatgttaactaatgtttttagtgcactggttaaaaaaatttaaaataaaaataattttattaatatgcataaaattatattattcataattttttttcttataatttttacaataatttcttttttaattctttaattaatacctttaagagtactgatttgtaagatcctattattaaaagaatcaagggaactagggaagtcaggaatcccttaactgatacatttgggtcaaaaaagttaattgctgtaaataaacataattagcaacttcgatgtccaaaaagtggctcctgtggaagcattaatgttgtctttaatcatgccttcacatattaaatgtgacaaaacatctcatgttatatgatacagatcctataaacatgtacctttagaaaattattagttaagaaattaataaataacttttaggatgttgaaaaaaagtggtgagaatatatcattaatgtatttcaataatttgtagtgttctaaaaacaacttgttaacattctccttgtgatattcctgaaaaatacagcagtttttatccaatttctgccatacttcaacaatcagcagttactttctgctatgcttgaattagtagaagaggatagaatgaaaggatatgtaaaatgaagtgaaaattagtgggatctatttcatcgtttatcttcacttttctttctcgctccaatttgggagtaacaagatggaattgaaattgtttcattccatcataacaatccaaacagtgatgggatgaaggctttattccattacattttagttcattccatttcattcctctcgttccatcaattcaaaaatgcattaaccatgaacgccataataaacagatttccgtaaacaaattgaaaagatgaatgactaatgatgcagcgaaacaaatacaaacagaatacaaataacaagcattcagtacatttttttttgacaatgcatataaatatatttatgttagtaataaactattgtctataaacatgattctacatttcggcggcaaaggatttaccacatccacatgtctgtgtcgcgttaggattcttgaaagagaagcctcccccaatcagagcatcactataatctaattgcatgccaaatatgaagagtagactcttaggatcacaaactgcagaaataaatggagaagtcaaaatcatgcagtggcttatggtttaagacttgaacaaaaacatcaagcgctgcagtcaatacattgatcaaagaaatatatagaggaaagtctccaataccataaacaccatatacatgcatcatttttgttttggcgtaaggtgcaagacagtttgctcactgttctttctcttatttaccaaatacagtaagcttaatactaatccaagtgcgatcttaacagtaataataataacaacatttttaactgtttatccaatgcaaaaaacactagcaatctaagctgaaaaagaagcaaaaaagatcatgttgaggggacccagctttcaattcagtctaagattaatttttttcctattgaatcaacatagagctagtagggggttggctttcatttcttgaaaataaaactaaagtgaattacacttagttgatacattaagcaaaaaaaatgggcataaactgtaaagatagttggaagttggatccaggaaacttagttaatccctgtaggaggaaatgttatgttctaattaaaatcaatcagacattatttccctaattaaagaaataaatacttcttttaagttttaaaccatttgtattccatagattccctccctctcccaagtaaagaataaggtatttgctgtgcaaagacatttttacatgctaaaagcctaaaatcactcatgtatcctccactccacctatttgcaactaccaagtgccaaccagtacacactttgtcttggtcaaatagcttaattaggagaataattttattcagaaatcatggtttgtaaggtgaagtgcattggcaatcttgacaaaccaacctgaaaaattgcatgtaatgaatggatgtagctaaagcttgtgaattataaatgttaatgataagaaacagaatatgaatcataccaatttcaaaaccttcatactcaatgattgaatcatctggccttttattagccctgtcttcaaaatccattgtgtatgacataccagagcacccaccctgtttgacacctattcttaaacataaatcttgatttcgttcagacctcatcttattcaagtgcttcagtgcattatctgtaacagaaattgcaggggccagagacccagatgctggtgcagctaaaggatattgaggtgggggtgagtgaaagcaaagactaaaaaagtactgagcatggcagaaaaagtatttcacataacacacacaagtatataacaaaattcaaagtatactgtttagctgttgcaatctggttaatgatattaaaacagagtgaatgtcaataacagaaaactccacgtttttcgttggaattactgagtactagtccaaataacaataacttgctgagagttctttaggttgggaacttcaaaatgtctattatccatcatctaaatcttcgtatatgaatatagtgcctaattaaaagtgcaaatgtaaaacttctttacaccatcatctaattatgtaatgccaaatcattaaacgattttgaaatctttcctatcataacaactacctaggaagtcaagatcttctaatggtgttccaattcatcattagttcattacatgcaagtgtacaaaatatcaaatttgaactcctattgtattcctttaatagtcaaacagaacatgatttgagggtgatccctggcacagcggtaaagctgagtacaatatccctcccccttaccttcgcatagcaaggagcctctggacaatggggtacgtagtttagtcaaacagaacatgatttacaacaaaatattatgtcatcatttgccacatgtagctgaacccacctagtgcaaaaacgcttggttgatgttgtaaataatcaaattagtccctaaaaaacagtgttgctcatattaatccctaatggaaaacacaattgtggtccttgaatatgcatttagttagtcaaattagtctctaagattcatgattccctgaaacaaggactactttgaccgaagaaatgttcatttaagaaccttaggtgtaatttgtactattcaaagactaacatgactggcatcatatctttcattggcttatttgactatttacttattttcctttctttgcagaataaaacaactgatagagatggaaaaaggtaagagtgtatttggaagagcttattcacagctaattcaaacttatcttataacaaaagcacttgtataggtgtttgtgagagcttatgaaaatagcttataagttgtccataaatctgttttcagcatatttcaataagccatccaagataacttgtaaaaacaatttacaatttatatgaaaacagaataacttttattttcccttggattatagaaacaacttacactgatacataagcacttattcagaaagtgcttaattaagccatttacccaaacagaccctaaatgaaagggtaagaaatctgtctacaaggtcaatataccatataaggaagcaaaaattataacaaaagagttccggcaccattactatattgataagaaaaatgaagtaaacttaaattaaaagaaacccaaaaccttcccagaaattagggtaggcaaagctcgtcatgcaaatagtcggatatcttattacgagcaaacgatttgtttgcaagttgcaaccgtttcctaacaaaaccttcaaatggaaaaaagtgggtccctctttgctacaaactagaaataatttactctatcacgatgtatcatattctaagcgacggaattgtaatcataattatgatatttgtcattgatgttgctaattaacagagaaattaacggcaaattcataaacgaggaagtaatatataatgtaccaggaattgaaactgatcgaatggagagtggtttaaggcgtttgagaataggcggtgaaaatcgaccagagggtgaagatcggggaagggagatgggaaggcggagaaattgaggagagtgcatggtagtcattgcagagaaagccattggagcctgcagagagagagagaaagaaagaactacacacacaaacacgttaagaatttaatttaaatatctttgactctttcactcacacaatcccaattaaaacttatttactacaaatattaaataaaaatttaattatatcatgtaacttatatcttttatcattcaagtacattcacattgtttaatgtttatatataataaataaaactcgggatttgaaagttttaatctttgaatctaaaatatatagttgaaaattacaataaacactatttcaaatatgataaattgaattcatttttcagtacacctcttgtgaagatctgtggtgtcacactcacgtgtcatctatgttacataattgttacaaggatgtcatatgttatgttcatgtgtatttttattggacacattaatacttagcgttcgttggttttgctagaaagaaatgcgaaaaaagtatcattgggtatgaaatggacggaaacatatgttttctctcatttgttgtctccaaagtatcgaggaaagtgttgtagaaatgacaggtctcatgtttttttctcttttcaaaacagactatatgcatgtttgtaaatcaagtgaagaaaatgttttttaggcaaaagtagtttgtaaaaggataaaaatctgtttttatttgttagattgcattggaacgtgcgttacattaattttaattgcaactcaaacatatacacacattactatagaaaagtgataaaaatgtagatggaaattatttatttgaaattgtccctaatattgtgggacacgctggagataggatatcaagtgctaggtagtatttttttttttaataatcaatgggcctaaaaaggcgcatgaaaaatgataggaagtatataaacacaagtacattcactttttccaaaggtataatcgattatggcttttggcatattagattgtgcaacttttttttctataacgcaacacatggcatatttgattatgcattatcacataattgattatgtttttttttttaattattgatgaccagcggactagaaggaagaagaaaaagttggtaataaatacaacggtataattgtaattgtaaaaaaagttatttttattcatttattttattatctaataaatcactttaattcaaaagttcttcattttcatacatttttcatgtcaaccaaatgatttcatttttcactctccttcattccttttttttttcctttccattaacacactttttttttttttctttttccttcctagcaatcaaatacactgttaatgatttgaatttaatgtcaggaaccaaaattattgatggaaaataaattaaaaaactaaaaacaaacactaaaatctacaggactaaaaatcaaattttaaaatagttacggggtgaaaaaacttatataacactttataaaatgcaattcactttatatttttttaaaaatgcaattcactctgataaatttaaattattactattaaaaatgaattcatctatattttattacttcacggatcacatgtccttttcattttatgacacgttttgagctttctatattaagttactacatcaataccaaactttttttcttctgcctattagaatcagcctagtgatagaagaatttaagtagtttgcgcaaaatcttaggttaaaacattgtcattgctgttgatttattgtacaaaaaaaaacaattttttaatttaattacttccttagaagccatgacatacttgttaatttattaacatatgcaaaacagatatacgtaacattttagtttgagcattaaaattaaaagatcatcatgtaaagagtacagagaaggttacatgacatacttattaatcgtttagtaacaataaataaaatatacaacaaaagatttacacaacttttgattcgagcatgagaagctgaagagagtacaggaaggttttccacacatactgagatttagaaacccgtacgatgtgtaccaatttcgggatttaaaaatagacactacaccttaatgaattaaatgatactgtaccagagctcaaaaccaaatatgttcaggaaaacacattaatcttcttgcatcctacttcagcatgcacaaccacttcgttgttctgcttctgaaactgcttcagagattcctcgaaaataactgccatgaacagaacaatattagagactaacaagaattggatttgggtagcactagcagtagcatttatgaagaattaccacaacctaatcatcataattcataacagagaagaaaaagggtgaatgttgaatttaaagagataattaagtggtctaacaaaaaatagaaggcactactagtacaaaaagttgattctcacatgtcttgatcgtgttcattttctagtgcaattttagcaacgcataaaaaagcctcttcaacattgtaaccctctttcgcagaggtctcaaagtatggtatgtttccccgggaagcacaccagtctctagcttttttctctgtgacctgaaaacaaatagcacttcaaataccttgcatgaaaaggttcaaatatttggatataaaatttaattagaatggactccatagcgtagtgtcatctaattggtatttacattaaaagttacatacatatacctaaagtaatttataattggtagaaagtgtacaattctttacagtaacaatgtatgaaaatataatcattggaaaaggagggggtatattccatacccttctactgtttccaccgtctacatcaaccttgtttccaagtaatacaaagggaaatgcttcaggatcgttcatatctccctgaggtcaaacacaaaaatgtagataacattaaaaccagtttcacatgattaagcagaatttgatccaatcatttaaccatgtctgctcagtttgaattaaaagaaagactcatctggcttggtttggtttgacttaaactcaaggacaacgtaatccaaacaaaagacagaaaccacttattaacaagtacggaaagaagacatgaggcttgaaagaagtaacaaaacacctgcttaagaaactcatcatgccaattgtttagtgtatcaaatgttttgtgtatgttcacatcatataccagaacacagcaatctgcccctctataaaatgctgccccaagactatggaacctttcttgccctgctgtatcccaaatctgccacaatattatgttttcactttcattgtgtcactcaaaaaaataaaagtactgatgtcgatacttttttcatacactcagacataaagcaaagagaacatgtaaaaggaaagaaactttcaggaaaatttaaatagctcacctgcaatgttacgagtttatcatcaacttgtatttccttggtaacaaaatcagccccaattgtagctttatactgctggctgaattttctataaacatatctgaattcttagttaagttacacaatgactttatggtagcatgccttgtattaaaaaacttaaaaagccattttgagctattgttttaagtcaattccgatcaagataccaataactacagaaaatattatcaatatgaaaaatatcttcatttactctactaattttagttaataaaattttgccagctggtcctgaaccagtgtattccaaaacaactattgccaactcatatactacgagtgttggtcgtgactttacagagactcgttggaaatacgaaacaaaacaaaaagggaaacagtggaaagctcaaaagcattcatgatttgaaatgaataatgcacctacagcaaatcactgacaatcagaaaaactaacggactttcactttctatttgtttttttttttttttttttggctttcaaactgaaaatggatactggttcatcaaggaagtctttcccaccctgaaaataagatgaagaaaaaagaatgaattaacattcacatttagcaatggagaagcttccatgaagtaataatctcattaaagtaacagacaaaaagaaagggaattgaagatgcaaaatttggaatggaaacaatttaaaactaggtggcatacatacccactatcaccaagaacaatgatcttaagcaaagttctctttctctgtgaaatgtccatgttggagactcaaagctcaaaaggttagttggctgcaagaacaatcttctctatttctcaaggatgggaaatggaaatggaaaagaaggaaacaactggtgtggccttatgagagaaaagggaagttctcgattcctcttggttggtgatatgaatatcctcctttgtggggaattgcttttttttttttttttcttttcttcctttgattttccttttctgcatttgaatgatgcaggtgagtatcatgtgatttgcaaaccaaaacaacgttctagtgacagcggagcattattattatatttaacctataaaaaggttgtcatgtcacagttttttcttttagttgactttggaatatacgtgcttgcctctcattgttcgatctaaaatctgaatctgtatgggctgcaaataaagcagcaggctacactatgcttcacggttggacagttgagaaacgctattcagttgatcagttatgttgtaatctgatctcattctgacacactttgaaggaaccgatgatgcctgcatttaatttacagcactactatgtttttttgtgacaaccagcatttttttgtgtgacaattactagcattggagtggtggtagtaatgtctaacagactcattttcagtaatatgtttggtttagcctccggttgatataggtgaaagacaattgaaaaacagtcaaataagataaaactcatatttgtattttaatttaaaattttcatcttaaattacttttttttcattccatttcatttcattctattaaacactacaatagaaaatggtttagagaagaaagtgagaaaaaaatgaaaagtgaattgtaagaaaaaagagggctatttagccatttaaataagcaaaggttagctctttattgcttcagtggttacctaatatttgttgagagtctcactaaatatatggtaaccacttgagagagggggggggggtggtctatgtaattggaaacttggtttcatgcgatgtcactagtatatgggatgggtttcccttgtacctactgttaatacattctttttactgacaaaaaaaaaaaaacattcaaaataccatacaacctataccatcaaaaaatagtatcatacgactcatacatgttgatatgtgtctattacgccaacgacaaaactaaataaatataaataaaggaggaaaaatactctctcctatattttttcatcgaactaaattaattaatttatcgataataagaaattaattagtttagttaatagtattaaatctatccaaaatttatatattcaccatatcacgttgtaataaattgtttgctaccaaattaggatataacaatcttatcatactctttatcttattttattggtttagttattataggtgggagaagttaagttagaaagtaaaaaaaaaaaaaaaaacataattttgtgctagtataatttaattaaaattatatttttttgcatttttttataaatttaaaatttataaaattaaattaaatttacttttacaaaaattatatgtaattttatagaaataataattttggcattgagcatactttatatcagattttgtcatgaacgatgacataataatattatctgattcattatttagtgctgtaaaattaaaacttatcctttattttattatattttaatctatttttatatcttatcatgtgtttttcttatatctatcttatcatgtcttttttaaaatgttactttaaataacatttttttaaatactattttttaatttttaatttttatattttctttcattttaattctcaatatatttatttaatttctaaattatcatttctaaaaaaacataattttattatttttatgttattttacatttttcaattattttaacaattaattttatcaaacaatcataatttaataaaccaacttttcaaccaataaattttttaacttttaactagttttacagagcataacataagactgcgttgcttaattatgaataaacctaaatgaagatatttaagtatttattcaaattacagttcacaataacactaatgaaattacagtgagatacagcattagctattaactatttataaatttaatacactttatattgtagaattaattaaaaagattttttttttctagctatgagaatggtacgtggctatcactctcatgccccaacatctatctcattcactttcaaccctggaagtgcctagtcgccaaccaacaattaaagtgctcttttcacgtttaacaaaaatataaagtaatcatttctcaaaatatttatttatttatttattgtgaactagcttcctttccttttattgcttttttgcttcttgtcaattccgggtaatttcatctctacttggtgagcctcgcttttttcttccaaatcctcgcattggattttaaagtacaacacttgcacgttctttattctttttctccccccacagaagtatacttttgttctagaataattataccattaatttgatacgtcaataaaattttaataattaaacgtatgtttgctttgctgtctaaactttgatagcacaaatttcaaagcacctaaacggagaaattacaaagagcatgctgtggacaaactgagtttgaaaggatataaaggctgctccaaacatacactaagtctgcacctgaaaatatatatatatatatatatatatatatatatatatataagctttatgataaaaatgaatgtgattaaagtgactgttgctggtacgtgaccattgactcgcactaaataacattgaatcaaagaatgatgacggcgtgagtgcttggtgttgggtgggaatggcattgacgaatatattgatatatgaagtcaatgtttatcttatcatatgagttatttccttgtactttcccaaatatacatcatattagttttgatttgatgtgtcttagtctcagtaatcaaaagctctgagcagtgctctccacatacccaggatctccttcccgttatctgactagtgactaccgtcacattaattcctcctttgactagatacataattgtatgggtggtttgaaaaaataatgcttaaaaatgctataaaatatttatttacagtactccttatacagatttaaaagtcttttttatgtatatattttatgttattgatcatcataaattttgtatataaatttaataatcctaaatataatgtaaactaattttatattatcatttaattataaattattagtaatatgatttttataatagatattataaaagttaataaacttatgttatataatatttttttattttttatatatgatacttgactaacttattgcttacacttgccaagtaaacacagaaatcacgtattgcatttctgataacaacttcctagaagttttccaatcgaatttaaaaaaatggttgtctatgtgtttttttttttttttttttgtatatatgatacttgactagtttattgcttacacttgccaagtaaacacagaaatctggtattgcatttctgataacaacttcctagaagttttccaatcgaatttaaaaaaatggtttctatgtgttacgtaataatgtttatgtaaaaaacaggtatgatataattcatatggccaccaaaatcaaaagatagtgtgaactgggtattgaaattttcacaaaattaaactaataacacacccacacacccgacagatatatcttgtcttttattacatcatttcataaagtaatggtcaagtctcataccatgtattaaaaatataaattagatcttaatttttatgattaatcgtatttgatattttttttatattatttaaattaaaatataattaataactttaaacagaagtaaattaaatttaaaagaaaagatggacaaactatcaacggatttttccgatttcgataaaaatgagattgggttttaatttttcatctccatctctactctgcataattaagtggccataagctaatacaaaatacagtctttttcttttaatcttagatcatccatactctaatattatattgtacaaccatctagatctaatcctcgaatctaataagacaattatgagctacaattttttaaaacaaaactgcaattatttttctaattaagctaatcttaaagaaaagtctaattaagctagagaagcaatccaggggcaatttttgttatttttggtgaactaatatttgtcaaagaatatttctccgcccgccacaagccctcaactgttgatgctatcgtggataactagctaacgtttgatttaaatgatgagataatgaaacccaagtgctaattatttagggtaaaatccaacaacgggtcagcgatgcaattaaaatacacatatgcaaccatctatttaaagagataactaaattacattaaataatttatattatggtagtgcctttgtggccttttttacaatgacatcatcgcatgacttcaccttcgaatggttgacgttgacacgtggatccgagaggaaccttcattgcatcatctaggaaagagtttggaaggatcgttcatagaaaagcataatacggaaaactatatttatatccttctagttataattatttttaatatataaaaaccattgcctaatttaactcactcatatatcaaagggccaaatgctttacacagcatagtctttgttttcaccagctaccatatttagttatcagcaatggacttctactttggaaaccctcatccttatcccaataataatcaatatcatgctcataattctgtagttaacatgactccatcttcgcctgagatcgcactatccgattatctcatgctcgatgactatgttgatcatcaagattctcgatcatcacaaagcactgagtcatcagaaaaagcaaccttcagtgatgccactcacggattcggcactggtgcaacctctaagaacaataacatgcaagtgctttttccctctctcatttctcttccttcattaaaaacaggaaaatgatacatatcatcataattaaactcattatttctctctatttatctatgtggattgtggagcgcctgtacatgcaataatatacatacatatatatatatatatagtaatgaactgatgatatttagatatcctacaattttatacattttattaaaatacattatttctctttatttatctattcttatcatattatattacttatagatttttttatctctcgctcctctctttctcttgttaaataagtgtcatgggtgtccaaaaattaattttgtaatacatataacagaaaataacacctatagtattgaataatgttatgcagaaagtgcaaaaatgggattaatgaaaacaaaagaggagtgggtcctaggatcgcgttcagaactaaatcagagcttgagatcatggatgatggatacaagtggaggaagtacggcaagaagtccgtgaagagcagtcccaatctaaggtaaaaaaaatattactaatagtattaataaagtaagatattatttattgacatacttttttgcactttgaagcttcgttttttgagaaagaattacaaaatcactgttattatataacacatttagataaataagactaagtttaatttcaatacattgtaaaaaacagtttacactccaaaccaattagacctagtaggctatgaaacaaattaattaatacctggctatagtacttaataactcacgggacatcatttacattacaagctccttctagtgggatatattagggcaccaacatggtgtaatagcttaggttcaccaacatggctatagattaatgtttgtgcccactggtattatattaaaggtttgggatggggacggttgtgttgtccttttagtgtatatgtaagttgggtgttatcaatggaccccagtttaaatgtgtgctgtttcgacttatatagtaagcaaagtggtctctctataataagtaccaatcttgatttggattgttactaaaatttaacaaaattagttaaaaaattaattagaagttaaaaattagttagaaattttaagttaaattcaattaaaattaattgttgaagtagtttaaaaatataaaatgatagaaataataaatttttaaaaaataataaagaaattgaataaatattttaaggttaaaaatggataaaatattaaaaaactagaaattagaagttagtattttaagaaatatttcttcaaataatgttttaaaaaatattaaaagttacttaattttttttttaaattgtcaaataagtttttcaattagtaaaaaaaatagaaattagataaaatagcttggtgaatatgacatttgtgctctttagtctatttttttttctttttggatttttgtctgtttgaaattgataatagctgtttgtggggatcaaatattttgttttatttgaaagaaattaacattactgattgagagagatgaatttttaatttaatatgacaatctatttaacggataaatacgtgttaaaatttaactgtgtataaaattcttttagaccaataatgattatgcaacacaagtaaagttagtcttgaactaattagaagacatttgtgatctttgaccacccaaaaaacaaaaaaaaaaaagtataaagctttttacaatgtgagtaaatagaaattaagctcttttaaaaataattacaatgaaacataaaaatttcaaaaatgttactatataaattagggataatttttttgttatctgcacactatggccttaaagtaaaaaaaataaataaataaaaacttttactctaataactctcttttttggtccccgtctctccttcaacttttttctttctttcatccttcttcaattttgtgactctcactggaatttttttcattcctttcatgactggtctccccttgtttcatttttttagtgaaaaataaacattacacaatacagatcatggttatttttgtaccattgttttgtgaattagagaacgtataaaataaaattattatttattgatgtgtatcaataaaaaaaaaatacacaaaaacagaattttgtactaatcataatacctacatttaatcatttttttaaaaaagggtaaattagtcaataatattttataaataagtacggagggaatactatcatagttccatcccttttgacgagttaattaatgcttacagtgcaatcaatacatttaatacgttaagtttttcaagtaggtgactaattaggaaattccattaatgatgacaggaactactacaaatgttcaagtggaggatgcagtgtgaagaaaagggtggaaagggatagagatgactccagctatgtaataacaacttatgaaggtgtgcacaatcatgagagcccatttaccacatactacagccccatctccttcgtacattctgatactactttcaaatgacaccaactccaaccccttttctgctcttacacctccctagcttaattatgtgccgagaaaaggcttggaagattcgatcgagcaaggaaagctgtgtcaatgaattgtctaattaatcataattattttcatgctgtaataggttgaagagagtttctatacccttctttttccattttgtttttagatgagtttaatatctcacttaatggaaaatcaacctttgctagttcatgtggcaaggaacatgattttccatgtgtaaagttgttcaaatcttaaaatagaatggaatgctttgttttgttacagttaataaattcaaagttgtttaagctggttgacaagtgcgatgtcgaaagtgattgcgatgcttcacaaatgcacaaacacttaagttaacgggacaattattaacttgcagcaagttgggcagtacttaatgatccttaagtactacgtcttgtttgactttgacagaacggaaacagaggaaacttcttgttgggatccaccattcatatgcatgtttatgttttgctaaattaaaattttaattaggaaaatatttgcttagacattagggaggcggagacaaaaagaaaaaaaaatgtttaataggacttatgatacgatcgaaagagagaggtaaagaaaaataataagtgttaatgagatgtttaaaataaaaaaacaattcatgtatgattatttatttaattactagtattaatttttttacagcagcaaaatcagttcatttctattgcaataagattatgaatacaatgatggctgaaatgaaagatttgtgagtcaacataatttgtagaattcctagccaaagtgtgattgaacattataacattttaaaatgtaattctcaatagctccaaaacctctaataccatcctccacgaaaaagctgcatcagtattacattttaaaaaactagcaggaggtttaatccacaccacagaatctggtagcaattcaccttggatttcataagaatttatatgttgagctaatttccattcactgaaagctacatgagctctattcaacagtccaatatcctgctcatcacaagaattccaaagtctttcatttcctctcttccaaatactccataacatacatgctagattgaccctctgaaagcgagcaacataaattaaacaccatttaaagtactcaacatttagcaacacggattcaatcctttgccataaaatgatttattaaaatttaatataaatttaagtactatttaagataaggagtaataataaaatgatttatgaaaaagtataatagttaatgtaatcaatattaatgcattgttaatgtgatttttaataaaaaaatatttattattttcttaatttataatattgtaaataacaggacttaaaactaaaaaaaaatatttatcttcacattttggttataaatttgggaaaagtaataatgatgcttcatcgtcattttggttttatagggctacaatgtttaaaattatttagaataatcatataaaacttttttttggagagaaactatttgtaacattattttttttctcattaaatttattgcatgtgtttttttaagattattgttaactaatatcctaaaaaaaatgagtaagaaattaaaagaaaaatattttattaataatcaaatgagagcacatttaaaaaataataatagaacacatttttagtattttaatattttttattttcttaaccaatatgcttaagatgataattagcatctactataaaatgataaaaatattacagtacaatgtaaaaaaatctgtcaaaagtttataattttatagataatgaaacaacaatgcgagaaagtaaaaaaaaatgttgatttttgtacactcactgaatagtaacaccttatcaacaccattcatttattatcatttcacatcattaatcatatacttttataaatcactcatttgtctttcatttctatatccctctaggtataagcacctaaaataagaagagttaaggaatcatttttcataaacaaagtttaaacatagacacaagagaaatcatttatatcattcatagggattaaaatttcatgataaatgttaattaatatcatataatttttaaatatgttctcatgtgttttcaataaaatctttgatattttaatttcttaaacaattagttgacaagaccctaaattaagtaagaattaagttgactcaaactacagtatttttgttaataaatttatggattttgttaaccaattacctaaaacacattaaaaaaaattttaaaaaacttttttttataaaaaaaaacaagagcatatttaaaagtaataaggaaacacatttttcttcattataataactttttttatttctttaaccagtaacattagagtattggttgccatttccctttaatttaaactccatcttaatcaaatcaatatataatcaatttttcccaagtttacaaattcaaaatgtcaatttaatcaaaatttaagggttgcgaaagtaaatactactactagtattttaattaccgagacacatggacatcacgtgctattggatcgcgtggctttcacgaatgagtagcgagagatggcatgattacgatcatcccaaaacaatttcaagacactacacacccctcccaacccaatcaaatcaaatcttcgttcgaatccttttctctttctcgttcaccgcatcccaaactcaccagatccgtcgtcgattcggttttccccctttctatttttcgtttcccattttctcccggaacgtgaaattctcgctctgatctcacgtgagggttttggaacctgatgagtccgtatatgtggatgtgtcgtagtgaaggcgtgttttgaattatcgtcggtgtagaaggaatcatgttctggagggaccgtgagagagagaacaaagagttgaacggtggggtcctatgtggccaggtcagagtcctcgttgttggtgattcaggtgcgtgcgtctttctgttaccaattttattttacgtcttttcattttttagaataaaacttgtttgcactactagagtgtgtctactgctgttcatttaattttaaaattatgtatgataatcttattgcattaacatgtttacatagatacacatttaattgtagctttaatttttattgtgagtttaatactgggagattttgtgattgtgaggtgtggagaaaagtgaagttgattgaatgcgggaggttgtactgtaaagattggggggctgagaaaagtactcattgtggtgataccgttattataacactcaatgggagctccaagagttatgttaatgatattagctgccatgtggtgtgttgtgcgtaaggttatggattttcaatttgaaatgattttgttgatagttatttccttttggtctgtggtttagagaattgatttacgtaggctgctttaagaggattgggaacttaatgtaagagaaacgactaggaatatggtggaggttgctgagaaaccttacggctgatgcgagtatgtcccgaattagtttgacaatatatttggacatacttttgaggtgtgtatgcgtgagctttcaaagttattcagaatcaagtattcaaggatagcaggacaacttcaaatattggaagtctttgactccacaaagtttggatttattatttggattgtagttctactattaattggtgcgagcataattggattacaattaatatatttttaaatatcatcttaaggacatactcaatcctaatgattgagagcaacagaaggctagattttttttttttatgttatattatttaactaagggcgaaccctggcacagcggtaaagttgtgtcttagtgacttgttagtcatgggttcgaatccggaaacagcctatttgcatatgcaagagtaagactacatacaatatcacttacctgcgcatagcatggagcctccggacaatggggtacgtagttttttttatattatttaactgaaacagtaaagatcaggaactgagcgaatgatgagctacctcatttttgacagactgtagtacatgcagtgaatcttaagtaaaacctgtttatataaatcaactctgcgcaaaaggaaataaaaatctaatgttgcttaataggttgaggatggaaatatctcttgcgtagtattctgtaagatctggctcagaatatagagatagaaatggaaatctttattgaaaggtggaaatcgctggtagttcgagagtccagatcctcccctttcactaactaactagtccaaaatgtgtcctctctcttctgcccttctcctctttattctattattcaattccatccccctgtaacctccctgtctaactaactgccatccctagcaagcttagcatagactttcttattggttagattgctgacatattccattgctactgttaagttgctgcatatgttgtcataggggcaatatgctaagggcctacttggtttaatgaaattttttctgtttctacattatatttttaataataattataaatgttgcctcttttcacttttgtttctcattttcaccatttctagtacaaattttcaaacaccagaaacaaactgaaatcaaggttgtggtttgtaattagttaaaagaaaagatagaatagaggtagaaaacatttccttaaacccaacaggcccataagttgtcggtctttggacataattggtggtacttcccatctctaaacttcataagcctggatgtgcattagtcaaccatagctaaatgttgaaagaaaaaaaaattctgagcttgtgattgcttgcaccttcatgaacatttttcagagatatcgtagttgcatatttgtcatattttctcatccttgcaggtgttgggaagacttctttagttaacctgattgtaaaaggttctccaattgcttgccctcctcaaacaattggttgttcagttgatgtgaaggtaaataccccccttctatggttacatgagtgtacattatttctgtaccatattcttcatcaaatttcctgtttctttttccagcatataacttatggaaattcaggcagctcttccagtagccttaagggtgattctgagagagatttcttcgttgaactgtgggatgtctcaggacatgaacggtacaaagattgtcggtctctgttttattcacagattaatggtgagttaaaaaaactccattattttagttttctaaaatgtattattgcttatattgcatgaggtagttgtgtataatcaatttaatcatgtggcagtgtacaaaacgaagggtcaagatttgtggccaagggggaaagtaaataaggaagaggatttccaatatttaacagtcaccatatatatctttggtttctctttttcaagtcttgcatgctgaaaataaaagaattttaatatggaacatttagcaaaaatattttaaatctgcaataagaaatcatacatgtttggctgtctaaactctaaacttcatttatctgcaaattatcttaattaccactattctggataattgcattagtctcttaattaatggcatttgggtattctggaacttttgacaattaaaatcagtaacagtcagtgcatattagagagttggctgtctgatattttaaactgtgaaaccttgttttgacatcgtttgcaggtgtaatttttgttcatgatctttcacaaagaagaacaaagactagcttgcagaagtgggcagctgagattgctgcaactgggacattttcagctcctttgggatctggtggtcctggtggccttcctgttccatatatttttattggtaacaaagctgatattgctgccaaagagggtacaagaggaagcagtgggaatcttgttgatgttgctcgccaatgggttgagaagcagggtttgcttccttccagtgaggagcttcctttgactgagagttttcctggtaatgggggccttattgctgtaagtgtctcaactaaaaaattgtctgtcttgccgatttgttttgcaccactttcaatgcttgagataatatgctaccctcgtgttaattagtatgttgtattcaggtcaatttgaacaaatccgatgttaatgctaattactagggagtttcaactactagcaagtagcaatttttagttttgcttgtttggtactttaaagctggctgttgctttttaaatacaatgtgttagtgttacacttgaatattttccacttttttttttttttgtctgaccatatatatgaaagggtgttttagctgatggaaggggatgggatttaatgagaaccataaaaaaagcttctcctaactgcctccttttccctgtcaggcacactgaatattatggatgacccgcattgaaacttcacatttcactttggtgccatctatcttgattaaaagaagatttttcagctttcattcattttcaaaattgagaggcaaaccattaaacattttatcttaactgatcttgaagcttatcaatgcatatttctttgagccactcagtatgaataatgaatttagcttagccattgcccgctgtgctgtgctttagaaaatgttagactggagatgctatactgcctgagaatctttatttctcatgttgtcattctaaaccgaaatactggttgttccaatgaagtgacacatcatgtctgatataattggatgcagagatctgccctgtttttgcattctgttgaatagttgccatccaattcattcttcttataacggttatgatttttatgttggatatctacaggctgccaaagaagcaaggcatgacaaggaggctgtggtgaaatttttccgcatggtcagtatggtctttgagctctgtcttttttatttttaatgtatgggttttcatctaagttttgtggctcatctcctttcagttgatcaggagaagatatttctcagatgaaatacaaataccttcaccagcatggtccattccttctgttcagagacaagctcagcgtatagatgaaaatttcacagaagatgatcaatcttataatacaaggtattttctacttgtcttctaaaataattttggagatggaattatattataatacttgcttatttcattatcaattcatcatagtgcgcgcatgtgtttgctcttttttcagcttgttttatgccacttgttacaaagttcattgttgattgcagtctaagcagtgatccttacaagtataacatgcttccgccacttccagcacaacgcaatctaacaccgccaccgacactctatcctcaacagccagtttcggtgtcggaaaactacagtttccctagattttccttgtcaggctcctcagaaatcagtactgtggcgagaacaaagcgatcagatattaatgtctgaagatctgtgtatttggtaattagtcattgctaatacatggatgtatacttgcatggaacaaagttatatgcttgtttaaattctttgttcctattgtaacttgtccattgattcattcgtttttaagaggctttctcagtagacggaggagctacttgttcaaagtttgggaagaatttaaatgatacatactcgattcttttatatcatacttttttttcctgccattgaaactatcaacactcaacagtattatggctaacaacactctccaaataagaaggattccactttgataaaaccgttgatgctatcccgtaaattgggtttttcttttaaaattgagtttgaatattatacaaattggcgtttaggtccaggagtgtaagagtagtgtcaagctgaatatttttcgtggagacattattagatgttctaagattataatagtcttgactaatttttatataatgcttaattgagtgttatttaattgttattcataaattgaaaactaagtacctatcacataaagattggttgaaattatggataagtaaaatagtgggtttagattagatttatggtaataattaattattttttcacggaaattttactttttttttggtaccaccattaagaaatagaattgtttcttagggttaccaaatacattagaagtcttaggctatctattaatctatcttgtcgggcatactttaaaaaagatttaaatcatgtcttctgcggtgactttttacatgagatattagcaataaaagaatttaagtgaaaaaaaaaaagaatgtaatttttattgatttaactattgaattatatttatatattatcaatattatttgtgttaaattttgtcaaaattaagtaacataaaaaagaaagtaatcaaataatttatattttaatatattttaaaatatttatattatattaattttaatctataaaaatgaagtgacatgattagattaatatgaaattttgcatatgtaatttatgtgaaaggaactttcaattcaacagtgagttttaagaaaatattattcaattaaaagttatagaataatataataattgtcaaagttacacttatataatttgataattctagtaattgaaataatgaaacataaagtataaatttacatttttatttaaacatagattgttatttgattaaaattattggtttttgtaatagttatttaaaaattatatctactataatgatttttaattacttgataatgtaaaatatttatactaatagtgcattaaaattaaaattgttatactataaaaatttattaattgatatattttaatatatttcatttgttagatctaatattgtccttctagagtttaattaattttgaaatattgtcctcataaatattttttattaattaattcgaaattactctatatatggttttcaaaataaatatatgacactctttcattggatgacagtgttttttattttatttttacctattatattctaattaaattctaagattaaagcatgttgttacgaattaatttcgtgccaaaagatttcttaccctatgtatagaaccaccagaaataaaattgtccacaacttttatttctggcattgttacttgttagtttttatttctctttatttttgaagaaataataaaaatgtttgaattttgaaatattcaagtatatatgggcatggaccactacatgcaagaagcgagccccacgtagtagaacgtgttcaacgtcgagagatcggcgaactactaacaaccaaatcagccaaaatacctaataggcatccctcttctctaacttagctcgaataattaatttgttactgattaacatggataaattcagcagaacaattctattctttcttcttttctgggtcctaatcagtctccaattccaacgtgcaacacctgatcatgaagaaggtggccaaaatgttgctcaagaccacccagaaaaaccacttctttctaagatgttgatggataccgttgctctactcagaaagtcacatcaaagttcctgggagaaaatcaaaactgtcaaacatgatctgcaaatgcagttttctccaccaaatttggagtaagttaattaagaggtccttcctgttacaaacccatgacccatttctgttcttcttcacaaggttaaatatgcatgtttcttgttcttgtaaattttttgttcattttttatttttataattaatcaaatgatgtagttttggtctcgttgtgaattaaaaaaacatgtataacaagagattaaaactacaacattttgcaattgggacccgcatgttatcttgagaggggtgcaatgagttcgagagaaacctaagaatatagatagtgttgttattttttacatgaccttctggttttataattggatcgacccctctgcttttaattttttagttattatcaatttttatattttgttccttttatacttcttttggttagatatttcattttgttttatatttattttcatatgtatgatagaaaatactttatttttaaataaaaaataatccctactgtctccgggttctggatgacactttgttcaatataagaattaaaaatgaataaaatttttatagtgacaaacaaaaagttatgatatttttgggaatcaaaaacatttaaacttttatttagttatcattcatatttccatataagtaggaattatgtatttttttttttttcttctcagtttcaggggtacgggatgggtagaatatgatggtgtcgaaggaacgttcaaagaagcaattgagaagatttttggcaaaagcaaagagacagttgaggagagtgctgaaggagcagcaaaagtagttgaagaagcaattcataagacaacagaaaaggtgaaggagagttctgactctgagcatgagtctaaggcagaactttaatttttccgggggttggatttaatcgaaattgtatggctgttgcttaaattggagatagctatctctatatgaaacaatttatttatattaacactgttcccactttcggccaaatgcttggttggaagaatgagaaaagaaaagaaaaaaagaagctggaaagcattaatttctaatactgaagaatagataacaagaacctaattgcaacatatatttaattgctttaagaaaattatacaagttatggatggtaatttaatgaacaaagttctttcttctattagtcttttaaaataatgatatgaagttatggatttcatgaagcaaaagttccactatctatttgcattgcattatagttttcgcttatttgtactttttgtctctagagttatacaatcactcaaattttgccaagtctctgttattaaatgccactaacacacatgtataaaataattattttaaacaaagtgtagatttttaatcgcaaccattaacgagttttattttctattggggagagggcttgaggtagctgacaccacccatggctacacttcactgctcaatgtcaagtcggtacatcaacaagccgctgccagaaccaaacccccaccaaaaaccttcagttgcatacccaaaaagaagagtaaaaaaagaaaaaacagaaaataaaaatcaaagaaaaaaaagagatctgattattggaatattccatttgtaataaactataactgtataactgtacaaaccgcatttttctttttctgttaaaaatcagttatgaagcttactggtgtgtataaatagcttccctttgtatgtaatcgttaatgatgaataatgaatttttctcatccacaaaccattattcatttgtaagatggtatcagttgatattcctctctgatttttctcgcttccgcaatctttttcctcacaaccatggcagcaccatcggctttccctgagccaataaccaaccctgctaatcctctctaccttcatcccaatgagaatccttccctagttctcgtctctcctccgatgaatggcaagaattatcacacttgggttcgagccatgaaacaagctctaatctccaagaacaaattcgctttagtcaatggcagttatcccattccagattattctgctcctaattactatgattggcagagatgcaataccacagttctctcctggataagatgttctcttacagattcaattgccaaatctattctctctgtagaacgtgccgataaagcatggaaggatttaagagattgtttttcagaggctgacatatttcgaatttctgatttacttgaagaaatctaccatcttcagcaaggtgagctatcggtaggtgattatttcacagagttgaaaattctttgggatgaatatgatgctttggatccaattccttcatgtcattgcaattcatcttctatgctgcgtaattctagggatcgcaatcatgtcgtgcgatttttaaaaggtttgaatgaatcatactctgcagttagatctcaaataatgctcattgatccttttcccagcataaataaagtgttttcattagtgattcaacaagaacgacagctacatgttgataatgtttccctatctgaacctcgagcattcactcacagcatagatcctcgaaataggcataatcacaataaaggcaggggtcgaggaagaaatacaaagctttgtacacactgtgggagaaataatcatactattgatacatgttttgttaaaaatggttttcctccaggtttccaatccaagcttgcaccaaaaactgccaatcatactgattctaatctggctaattcttctactgacactatggtttttttccagagatcaatatcaaagcattattgatttaataaacagatccaagatgaatgacaatggatcagatgcttcacacgcttctaacctggtgcaagtcaatgcttcttcttcttgtattggtcctgagaattctggtaagtgcttaatcgaatggattttggatactggagctacagactatattaccaattccataaaacatttttcctccttttctgctataaaaccagtttcaataaaacttccaaatggctcacatgtgttcgcatatcatttaggcattattaaattttcaaatgatctcatactgcatgatgtgctttatgtaaaagagtttcatgttaatctcatatctgtcccaaaactattaccttcatgcaaacttattttttctggttcctcttgcatcattacacagataaattcccagaagatgattggttcagctaatctcagaaatggtcttttcattctcatggaatccttggtgcctcaagttcacaattgcagagcttgtcccaccaatgattctattttatggcatttgagattaggtcacatttctcaaactaatatgaaacaaatgtgtactaaattctctttcttatcttcacatcatagtataccttgtgatacatgtcactttgcaaaacagcacaagcttccttatacaacaagcacaactttcacttcctgtatttttgaaattctgcatatagatatatggggaccatttatgactccctctattaatggtcatagatattttcttaccttggttgatgattattctcgttttacttggattatacttatgaaaactaaggctgaaactcgtgatcatttaaagaacttcattaacatggttgaaaatcattttcatacaaatattcaaaccattcgcagtgataatggtgcagaattttccatacctgatttttttaattctaaagggatcattcatcaaactacttgtgttgaatccccacaacaaaatggggttgttgaaagaaagcatcaacacattctaaatgttgctagagctatattttttcaagcaaacttaccttcaactctatggtctttttctgtaattcatgcagtccatataattaataggttaaccactcctctgctttccaactgtactccctatgaatcattacataaaacccttcctacattggagcatttgaaagtttttggatgtctatgctatgcgagcacaattacttcccatcgacataaattctctactagagccagaaaagctatttttcttggatacaaagatggaaccaaaggttatcttctctttgatttaacttctcacagtctttttacttctagaaatgttgttttttatgagaatcaatttccttttgtcaaaacctcttcatcagatttattaaacactgccacacattctcagccaaccattaatcttgatttcactcctttaaatcatgaaacaccagatcttatcaattctcaaacatctgattctataaattcccaaaattctgaaatacctgactcctcttcacccacacatctcagaaaatcatcccgtaatcgagtgcctccaactcgtttacaagactatatttgcaattcttctactacaacctcttatcctctggaatctgtaatgtcatttgctcggtgttcaaaatcctacacgcgattctgtaattctatcacttcaaatgaagaaccaagatcatacacagaagctgctaagcattcttgttggcaggaagcaatgcgtgctgaaataaaagctcttgagcagaacaaaacatggaccatagttgatttatcacccaacaaagaacccataggctgtaagtgggtttttaaaattaaatatcgtcctgatggtactattgaacatcataaagccagattggttgctaagggatataatcaacttgaaggtgttgatttctttgataccttttctcctgtagcaaaaatatcaaccatttgtgttttattatcacttgcggtttcacaaggatgcatccttgaacagcttgatataaataatgcttttcttcatggtgaattggatgaagaagtttacatgacattgcctcctggatcacgtactcagagttccaaacaagtatgtaagttacacaagtcactttatggattgagacaagctagcagacagtggtactccaagttatcacaggctcttatatttttaggatacaaacaatctaatgcagatcattccttatttgttaaaatcacagaaaaatcatccactgctttattggtctatgttgatgacattgtacttgctggaaatgattatgtagaaatccagcatgttaaaacttatcttgattctcaattctctattaaagatcttggaacacttcgatattttcttggactggaaatttctcgatccacaaaaggattagttcttaatcaacgaaaatatactttggaacttatcaaagatgctgggttattaggtgctaaaccagtttcaacacctatggaggtttcgactaaactaacatctgatgcaggagttccttgtcaggatgcttctcaatacagaagattgatagggcgattactgtatttaacaataactcgtccagatatttcctttgctgttcaacagttaagtcaatttgtttcaaacccaatggatgctcatatgaatgctgcaactcgagtacttcgatacctcaaaagctctcctggacttggactattttttagctcagataactctatcattccctctggtttttcagactcagactgggcttgttgcctggaaagcagaaaatccattacaggatattgtgtttttattggatcatctcttgtttcctggaaaacaaagaaacagacaactgtgtcacgctcttcctcagaagctgaatatagagcccttgccagcctcacatgtgaattacagtggctctcatttcttttcaaagacttgggcattggtttatcaaaaccaatttcggtttattgtgacaatcaatctgccattcatcttgcccataacccaagtttccatgaaagaaccaaacatatagaaatagattgtcatgtcattcaggaacgcattcaaagaggccttatacatttgtttccagttacttcttcaacacaacttgcagatgtactcaccaaagccttgcatccaaatcagtttcgacaccttatttccaagttgaatcttattgacattcatgatccaacttgagggggcatattggaatattccatttgtaacaaactataactgtataactgtacaaaccacatttttctttttctgttaaaaaaccagttatgaagcttactggtgtgtataaatagcttccctttgtatgcaatcgttaatgatgaataatgaatttttctcattcacaaaccattattcatttgtaaaactgatcagttattttaattatatatatgtttggattcaaggttagaaatgtctttgaaagttttattggtgaaaaaattttatatttttaataaaaaattctcaaaaacacttttagtttatattcaaaaacagaccatatgttgaatccgaattttcttcatttactcgaggagtccaatctcatgtctctctcctattggatcttccggtaaatagagaatatattttttgagctaattggccattcatatttcatcaagacttatagttcttaggatgaaaaaaatcgaaaactcttattcaaaattatcttgattcagccctgtaaaaaattgccaaatcatttgactgtttgtccattccaatataaaggattaaaaatcaatgattgtcatgcatatattataaggtcagttacgatgagtgaaatttctttttaatgattatcgtctcttaataaatattgttgacaggagaaggaaaatctcaaaacctgatgaattaaaactatatataacaataaattagccaattgagtaatgacacggaattttaaaaaattaacttaattttatatgattaaaaaatatgcaattgtattcgctgatcacacgctactgtgaagaattcaagttttaatatcaacgtcaagctcaaacttaatttattcgtggatgtacatgacttttctatttattaattgttcaacgaaagaattaaatccggtttaatagtcaaacgtgacaatttgaatcaaatccattgaccgatcaattgcttatttattaacacctatcatatttacctattaattgtagttcattctccggcaaagataataactaatgaactagaaatgcctttataataattagggtgtggttggcaacgcacgaacagtagcaaacaattaatacttacaatcgacatcgacagaaaaaactaaatagtatttttttaataaaaaaatattaatttatgattgttttgaaattatttattaatatgagacagtgatcatatctaatttgggtgtgttattccatgaaatacgtctaaattgagcatgtttcaccctgttgtgacacgtatcacatacataaattgatggttatataaatttcagataagttttaataaaaatgttcgattgaggcgtatcttgtgtcaaaaagctcgaaattgagaagagaagtcctgagcaaatcccaaaactattatttccaaaaaatgactctaagtacctcaaaattaggatttaatcttcaatcatccaaaaatttccttgttttctacttttttaattatttaattagttaatttaatgctattatttattttttaattacttctcataattttgagcattttaattacttctatcaaaagttagatcatttgaaaaatatatcgtacgtttttgtaatttttttcgatattctaaattcttatatggttttgtttaatatttttttgattttttatataactaatttttaatataatattttatttaaaatgatttctatattaaaaattatttacaatttagaaaaataaaaattttcaattttttcagattccaaaataaaattgaaattttttattacataaaatattatattaaaaattggttatataaaaaatctaaaaaatattaaacaaaatcatataaaaatttagaaattatattaaataaaataatatattacaaattagatataccaaaaatccataatatattaaataaaatcatataaaattaaaaaaaatattctaaataaaataatattaaaaaaaaagtaaagaagatcatatctatgatgaagatcggtttaaaaatattttaaaattagataaaaataaaaattaataatattaaatcatattttacatcaaaaattaaaacacgtctaattttggtctttatttcagtcgctaacagtttttgcgacaacatattgtggtcgcaaacataaaaaaataaaaaactataacattctttctaaaaaattattagcgactaaattagtgacagaattagtcacgcccaatttaaacatgttctggtgggtaacacatccaaattagacgtaaccagtcacgtctaatttggatgtgtctcacagtcctatgatagtaaatagttttaaaataatctcaaactaataatcttttattaaataaagtattatttaggttctttttccacttatcatacttgaagttgaagtacaaaagaggatgaatatttagaaccaaaagcatgcagtgatatctattttcattcaaggaaaagatactattgttatactattatttttattattattaactgaaatttattaaaaaatatcattttttgtaggtattactttttttaatgagcttttttattattttataatttccacaaacatttaattaattataagttagaaagtatgttgataactatcatcttaaaaaaaacttatttggaacagattactattttaattatatttttcaggaacctattgaggaagaagaaaaagacaccgaaggctgaagggaaagataagtgtaaaagtcgtgagcacactgctgtgttgggtaagcatagcgtgtctaagagtggcattttcgtaaatgaactgacaaaacgttacaaaagtcttcaattaaaaaaaaaaaaaaagagaagagaaattatacttataaaatgatcttaaaacagagagaaggaaaggggaaaaaagtgacgagagaaaaaaatttgaaatgttataaataaatatataaattattgtaagaattattatatatatatatatatatcatattattaataaaaatgctggtcaatgcagtttttttcggtggtaagtattatacaaactagagacacaatcaatgatttaatataaataattaatatattaaaattaagattaagttttatttaaataatatttgagtttgaattttgactaaaataattttaatcaaattttatttatttttcaatcaagtcagattaataaagattttctgataaaactgaagggttaatacacatgatataacgttactgcaatcgaatgagattgaatcgcattgttcaataagtttcgtatttcacatcatcgccaactaacggggacctctcgtttctttctcttctttcacattctcctatcttttgtttgtttcacttcattattacttgcaatttccaaacctctttcgagatctgaaaaacactctcatggaccgtcgtaaagaggttagtttctccctctctctctctaattagcttcttcttcacacactgttcgattcataaaataagtaatcgctgtattgtttacgtcacgctaaatcgccaatctggagattaaattgaagcagaaacagagagagcagagtcttcttctcctttaattttgaaaaggatatactatatatatatatatatatatatatttatgaattacatatcacacctcaactcaaaattttaatgttcaggatttatgagtcttcacctctttcaacttatttatttttatcctatatgtaactttaactcacttgtaatccaacatatttaaccagattaattactgcttaaagtagtttaaaggtcgaaaatcttacttacatgcaattctttacctgcttttggttctattctctttgttaaattaaggtgaaattctatggttaattaatctgagaagactacaaaaattatctaaagaattgaatgttttatccgcctgtaaaatccgtagtttgtttctcgtctgatttaatatttatttttggtcatttaattaataatagctgttattcaacattcatctgcagagattgttgtatttttcttcttcgcttgtttctttcgtattttctttaatctgtttaaagggagacacgggtaccatgattcatgagcttccctttacagctcggcttaattaatcattttcttttactattgcattttctctttctattatttcatgtaaacttttttaaaggatgaagattctctacaattgtttttaaccgcgaacgaaccttgttttgctttgaaacgttgatgacagtgttacagtcgtacaagtaatcataaactccttaatttctaaagcaaagaaatagtcaaattcatccctaacattcgttcttttcccacgtttgctttatatatagtttgttatattttcctatgctgtctaagtgtgtgtatgcgaaaaaagaaattgattattgtagaattgattttgatagaagtacttcttcaattctaacaatttttatgtatcataattaattttattatcattgtaaaaacaattaaaatatgtaaaatttggtcaaaattaagattgacccaactcatcataatatactataattttagaaattatccaaacatgcacttagtaacaactcgtaataagtaataatactaataatatttcctcttatatattttaaatctttcaattacattttgttttgtatgctacattttaactaatattaaattcattacaaatgaaagagaatttaattcagttagttgaattggatgcttaaattattataattattgatgatagtttcttcgatttctaagtattaaaaaaaagttcattacaaattatgaaccccttaatactgtgattagctgactaagttgtaaacatatatagaaaaatggtccatggttatcggtgccacaatttggggactgggatcagaagggccaagtgccggactactcacttgatttctcaaagatccgggaaactaggaagcagaacaagaccaatatatccagggctagtcttggcaatgaagaagagttcatggattcaacaacctccagcagcgtcaacactggccacagcagtgagcaccctcaagcgcactaccatcaaacccactctccaactgtaagattcttgtcttcacaagcttcgctgttcactacaaaaaaatcgctatttccgacggacaaaatccgtcgctaaactcgaaaatccgtcggaaaacggaatttccgacggcatttccgacggacaaaaatccgtcggtaaaacgctcgtaggaaatgttggccgtcggaatttttttccgtccgtcggaaatttccgacggaactatccgtcggtaatcacctgtgggaaatttccgacagataaatccgtcggaaatacacgtacaagcgctttctacatcgacaccttctaagacggtttttgaaataaccgtcttagaatgtaattttgaaaagaaaaaaattgaggattctaagacggtttttttcagaaccgtcttagaatgcgttttaaaaaaaaaatcaaattgtatttttttcattcaatgcttacacacattcaatgtctattaactatatttttaatttacaaaatcaacaaagcaatccaatataaacaaggttacacaactaatcaaaatcaacaaaagttattacaaagaaacacaatataaacattcttacaaacaaagcaatccaatatatgcaggggaaggaattgaatacagaatgaaccatagggattgatccactccatttatttaaacttctaaatgtaattttatttcattagatgcatacgattctggactttttccaccttccacaagctaaaaccaggaggacatcatttctcataataacagagctttccacatccaaaaggttcacaagactcctactcagtagcatctacaaaagagaatttgccaaggaaaatagaaaatacatacagaaatcataaaagctctcttagctaaattctccaaaagccactcaggtatgatgttaagctctcttatctaaacatagcaagaaacaaatatttatattaaaattaatataataccttgctgaagtaaaaaaatcacaggaatgcaaaagtaaacatagtaaaaaatatgtagagaaataatgtcacatacataaaagtacataaaataaaataaaaattactatatttggactagtgtttttacagccaaaaaaattctagcatttaggattgtgtttacagtaaggacacttaggcaaatatcttagacagttaattagatacaagaatattgtgtggttgtgaccaagaaataaaatggacaattaagaaaagaaggaaattaatcaaattgtgatcgtgaatcccgaggaaatatgagactggatactttaaaagtctagtcaaggtatctttcaagtttcatgtctattcttttctattcttattttcctttataactgtccactttttcttatttttataaatgaaatgactaaagttaaaaggatagaaaaagaagaaaggatgaatgaaatggaagattaatagtataagtgatacatgatacaactattgttaccttatgcacaatggaaaacagataatgttaagcacctgaagttgtaataggctaagaattagattttctgacaatccatgaatagcttatagactaacattgaagcaaatctacattaaaataagactaaaaattaaataacataaagctttgaccatcattctctcattcttttaataaaaaatggcattgcttaatcatttaccatttcaattttcagggcattgcttaatcacttttcaacacacctaaacaaaaattcagatttcacagctatttcaaacacaccgtacccttagtattttattgtctcaaataggatggtttgtatctagaagaagatatctaaatgaaggggggaaaaatgaaggagagttcattgaaagaataaagaaaattctcaaactttgaaaatatcctaaaccagaatctaatcttgatgagtaccaacatcctcttcaattccacttgtacgttgaaaattatgtcattcctatcaagccatatagaccaaatagcaaccaaccaaattatcattcaaattctccaaagagttttcccttttactagacccaaatgattagtgaagtgagttttccctaattcagtgctactataaattatgtcattcctatcaagccatataaactttttattaaaacttataaaaaataaatacaatgtatatttatacttaaattattttttttgttatttttaatgatataaatttatgtataaatattattctcattactccaaaatcattgcacgaaaagcattgcattctacctactacatcacattattttcaccgaaattcatcatgatcttatgctaagactttcctatacatgccatttacacctttttccttcattaatccaagcccgtaccaaatatgacccctaaacatgctagtggagtgaaactccactttcctcgatgtaagccaattctaggacaacataatatttacatattcaataatttccatgacttgcacttgattgtcatgaagaaactgttatattaaccacctgccaactatccccatccactcataagcatgttcaagtataagttatttaaaaaaaacatggaaatcaggtaatgcattaagcaatacacattgtagacattatttaaataatataaaaatataatatatattattattagatttttaaatataaattataaaaattagacaattaaatataaaaacaacaaattaaattaatgtcataacttatcaatagtgaacaaaggaaattaaatatataaaactattatgaatgacatgtctggaaggtaaaagaatgaaaaggaatgaaggaaaataactaatattgttctcattatttggtattaaatttttccaacaaaaattaaaactaaattattgttatgttttaaaattgttataaaaattttatgtgatactatacatatataattatatattttgatatatatatatatatatatatatatatagatatttacctctattatatgttttattcatgatcaaatattcttttaatcaagcttcttcgaattcctggaaatatatgcttatgtaattatgcaaagaaagcaaaaataaaaaagatgctagaaagctacatgtaattaataaactgagaggcatacattaatacaactaaaaattcatatatttgaattatttaatacactaatctttaacacttacaagttacaccactaaataaggtatacttaagagagaaaatattaattagattttaaaattgtaaaaatcaattatttttgaaaaaaataaaaagccaagaacaatctggaaaatttgacagtaacaaactacaatttaaaatgcataaatgacatcaaaagatgacattctacatgtctgccaaaaaacaaaagagtagcgtgcgcacacaatgattgccctttcgcctccaacattaaaggaccaatagcatctaaaatgaacagatttaaattttgctctcctaaattaatcaaatatagagctaatgaaaagcttcatatttgagctacagaagaacttaaagtctaatttaactctaccagtctacttatccattacgttaaatgtgtactcttacactacaggttaaaagagtatcataagttaagaatcatatttaacaattatcacttgtcaaacatgaaatgcaacagttttctatataatcaattaatattattttataaatatgtgaacaaactaatgaagaataatatgaattttctactctttatttttttcttaatataaggcatatgattaatttgcattattactttgtcaaatgcatagagtagaaatgaaaaaaaatatatatatacaattttaagctgaaaaatacttactgatgccaaatggcattcaaaaaccatattattataatttgtagtggcggtgacagccttttgagactcagccaaagaatgagctattacaaatgtcccaccagcaggaagttgcaaatctgttgtacagattgcagagcctatatgttgtgtgacagggggtagcaaagaaagtgagacaagggagtttgattataaaatcacgcataatccatcccaacccaccttcaccatttgcagtgatcccgactaggttgtcatccatacaacaacccaacaaggaagccaactcccgaatttattaaatcaaaagaaaatataggggatctacaattgtaaactgatatacaacctacaagtgtattcagtgcatatatttttcaagattttgatacatgatatatatgttttgtagttgatttagatcaccatgggattcttccattattcatgactctttccaaacaaaaagataacaaaccagcataattattagtcttctagtcctcaatttgtttttgatccaaattcttatttctaaacgctatacatatgttttcatgaccaatgctattattttcctaatttctatgcataagtaaatctacaccaccgttagagtgctgcagggctccatcaaacactgacaagaaaacaagttaccaaattcatgtttattcatcatcaatatgaaaaacagaaaggaaagaacatacccgaagcctggcaatatttgctgtgatgttagcgtttttaatcttaagcctctgcaccctgatccacaaaattatgtaacgaatcctcatctcctttaatgggaaagaagattgtctgttagcaagaatccagcaaacacacaataatccaataattttcccacaatccaaacaccccttagccaatgctgtaataccctaaggagtattatcttagctttcattttaaccatcaaatgtggataataaaaaaatatattattctcaagtaacatcatcatatacatatcaaagggaattttccaacataggaaaccatataccaaaggaatagcagaggtacaatatttttatcttttattattgtcttcttatttctctcatattctcttccaattttcttttcacctaacccaaaacaagttaaaatataaatttctttttgttcaggtagccttttctcagttcattccaagatttgattttcttagctcaaatttctccttaattcaattccaaagctgaccctgcaatcttcacttaaattttgtatggtttttgtaactatacttgataacattctaatgctgccctgtatggaatcaacaaagttttcaacattttcgtcaaacaaaaattccattgatgcccttgagcccatatctcagattctcaaccagaattctcaaccagaattcaattcccatttaaataattttttaaaaatgacaaacatttacaaattgttctcatgtacaaaatacaaggacaaagcatgtgttgtaaatgttaaccgtgtaatctaggaagcatgaattatttaattttagatggaacattgtaacagcaacatgtatgacttcaactctaaaaggggcaccaaagtaagtgttgcggtctgatgaatggaggttgctgtcttttgttgatcatacttcagattcacaatagctaactatacataatttgatctgttttaatttcatttaatgaaatacttttcaaaatcattttaatctgcctcaagagtcactaaaaggcaggttcatatgaagctattacaatgttgtttgaagattataggagcaaaatagtttaaatcgtgtaacagataattaaacttaaatcaatatgcaagtttatttaattaaaaattaatatgcaagttaaaagagataaggctaattttttattattaataatagtgatttagataaaatcaaatggagaaattacgctaggttgctgcaactaatcacaaacaactacattaataagcttaatgtatatattaatctgctaaaaatttaacacatttttatgtataataaagctgatattacctttgtggacctcacttgcttcagagatgaatccaattgccgttcaagatgctcaacttctttggtattcagtgggcctaagtcttcccctaaaaggtttctgcagcagcaggggcaaatgcaacggtcaaagaaattaaatcttgccaaactaattatgaaaaaatatgacaactttatttggtgaaaggaccactacaagttttttctcagatcttaaatgttaacgcacaagaaatctgtagaaataggcgaaagttataattgttataatcacctttgggtcttttgaagtgattcaaatcttggtttcagcttcaagtattcacggtagctgctctgctacaaatgaaaaataaccagaacttatgtttaagttttgaacttatataatcatgcaatgcaataacttacataacactacacgcatactagctaccttattacaaacacataccctatttaacttaaaaatctcagataaggggacctccaaggctccaagtttgtttgttgaaagctgggttttaaggtatgtatcagttcgatggtagaataaagctgagaaacacgcactgtgtcaatcatatacaagaataatgaaacaacttctttaattaggtgtgttgagtaatgaatttaatcaaatacttagttatccctaatgttctgtgaaatgttgttacttgtttgtgggactagagaaaccccaaagaggcaaagcgtacctggtcgtggctggtgtggtgctgccgtgccggcgcttggtggtgtgtgtttggcttctgagtcaccggagacagaggaacaagacaccacaggttgagcttcgcgggactgcggtgcgctgatggaggaagaagacaccaacaagacgcgtgcgaggcaacaaaacgcgtgcgacggtgcgctgatggtggttgagctcttgctgcggcgacgacacacagggtcagaaggcaacatgctttcacgaaacaaggaccttgtgtggtacattagggttgggccttttgtcttccatataaatgaaatttccgacggacagaacggctatcgaaaatccccgtcggaaatacccaatttttcccacaaatatgctttgtcggtatcgtccgtgggtaacgattacaattccgacggatttgtcattgccgaaaatggtccgtcggaagcaagcggtttttttgtagtggaggataccggctagttgaaactgcctgccagtttagagtggatctccacacactttgcttggtcaatttgaagccctgtccacaaaacaataccacagcagccatattatatctacaaacccaaaagagttcactaaacagtgaaacaaaatataagaatggtgaaactaaaacaaattgcctaattaagaaaggggcacggaaggaaatagaagttaatgacaatgttaaactgtcaacattcaatatcctcttcaagaggaaatttcccagaaaaagggttcatatatccttgtagttactgtttctgagtattagtattgttattgttgtctcctatacaattcaatttttaaaatgtgagaacaaaccttcccatcctgcaagtaccattacccacaactatgacaacaaaaccaaaaactaagaatttcccaactctggatgcattttatcagtaattaattacaacaacaccacaaaaacaaaagcaaaagctttatcagtaattaattacaacaacaccacaaaaacaaaccagcaaacccacatcaccaatgaatgtagtttacatgaacttcataaactgaaaaacagcttttttatgtacgcaactagaagcagggcactaaattcacatcatctactcaccaactctacacgaacttcatacacatcggatctaacaaaatagagagaaacagtggcaaacactgaacaataagtaaacgacaaacctaaattccttaaaaaaagtaaagattccaaaaactaagaatttgaacgagtattcagtatcatgaaagaagagtaaaaacaacagagaagttttaaaaaaggtgatataattgaatcaaaacctgatacatcaaaggcggtggcgccatcaatttgtgccgaacaagcttccacggtttctccgcgagtgacagagtgggccgaagccgatttgtccctgaagcaaccatttttacgaacaagatatcaaagaaagccaaagccaaagcaaggaagtgtgcgatgaaataacattgggagaggaatgtgggacccacgattgaggaacgcagacatggacgttgcagaggccctggtgcacgagggcttcgacgaggtgaacgacgcccggagactcaatgccgttagtgttggtgaccgacacgatgggcttcgagttggagttggagccatcgttggtgagggaagagggttctgagtgtcaatttgagggttcggcattgatgttgggttcttcatgttcttcttgttcggggcgttttcggttgagaagcacttcttcgaggcctgcaggcttcgcgttcttcacggaaccggacgacgtcgtcatggggcagagaggaaagagttggattggtagtaggttgaaaacgcggtgccacattaaagattgggcggtgggctgagaagatgaagggttttcaaatttttatttcaaaattttggtgaaaaatacaattatttcggatggaatatattccgtgggaattataaaaacacaatttttatttttgcgaagctcttcaacactattattgttgatccacacaaatattgtagttacagtttatatgtaaccagcaaatcttcatcagtatgatattataaaaagaataaactaaaaagattccagaatatatataattgaagtggggaagatggggtggatggggaatgcatgtggtataaaatcaaaagatggtataaaatcaaaagatggtatgagacaaaaacattcttattgtactttttcgttaaaaattactaacaagtttaaaataaactcaatcttaatttgtgtgaccgtgaatgtgtttgtgtccattttattttatattggagtaattgattttcgcctgaaaacctagctatttagggaaggttttatcctaaccacatttatgttcatgttatgtcctagctatgttagagaagaaaaaatcacatataatcgtcacacgtcacaataccaaaatgatgtgtctcagcttttttagaatgatactaataagaaaatatgttttttgcaataaaaattgtataatttttaatacctcaaaaagtcaagaaaatatgtggtctctatagaaaagaaaaaagtcaagaaagaagagagagaagtctcacgtaagacaattaatatgatagataaattaatgaaaaaagtattattataaaatataataataatagtctgatcctattaaatgaaattgactatatgaatcaatgatgttataataaagcttggtcaaaatcaaattatgagaaattttatttattatgaaatctcttaatattttttcccaatatctttcttgatttccctctactccttttcatatgattaacatgtattaactacattaaccaatttataaatgaatgttatattataaaaaatgttttacaaataatataactcaatataattgaagaagattgtgttgatgaacatatatatctttatgagtaatattattcttactcacttttcccacatcactattttaattggttatcttattctacacttctctctcacacgcttgtaaaatgtgcattataaagttgtcctatgaattccacttttctactaagtaggtacagttaatgtatgaaactatgggatgagaagtatttgctctccctttttgactttttctctttctctctcctctccttgaccttgagctgttgagcatttagcaaacattttcaaactagtaacctgtctgtctccacatagaaaaaggcaccgattagttcatatttggatttaaaaactcgagttgacatagagggtttctcgccaaaaaattccgttactctttaagaaatatcatttatataattttttttccctcttcaagtttaatttcatatatattctcctttcatttctagcattaggactcgggatgaacctagccatacaaatcttcatcatgataaattaaacactattactggataaactaatgacatatacacaatcttccatctaccccgtcactgaaaagctttgagactctggaaaagaaaatgaagtagatcaaaataatataggtttatgttgaacaagtaagggacatagatccgtggttttctacttttccagcagctgtaccatatattaatgaacacaatatggagagaaagtagtgaagaataatgtagtgaaaaaatatacaaacatttttcaccaaagaaagaagaggatacactaaattatacaataaagagaatattatggtgggacccaaattattgttgtgtatcatctagataccaaggcaacacgcaattctagttgttgcacatgcgatggatgtttggggcaattgcattctattcaattcaatagtaagagggccacacattatatagtttgctcgtattttgttggagatgatgtccctttatgtggttatgagaagcctaatagaaaacaatccaaataaaatgtatcaaaaacataaaagaaaagaaaacaacccaatgtctttggtggaatttttttaaaaaaagaactttactgcatttcagattcattctgtagatccgctgtaggttgccctcaggtagtacatttgtggtttctgatcaatattactcaattatgcttttcaaaaaaatatacatatattgctcaataatgtcgtatatacgtatggtgcacatcttttacatcattatttatttattttccctgacaggcaaagaagagcttcctcagctacttcaattgttgtgtgaaagcctaacatttaagggcaagtgcaatctttcgctagttttctgaagattatggataggaacagctatgcttctctgttcatttagtgataaatattaaatacttattagctattgatcttgatttaaaaacaaaccttacgttttcagtcctaatctttctttggcgatgatgctctctctgttacttcttatggtagctaaaaatttggtcaatcgaagtacaggtaaagatgataaccatttaaacggcgctcatgagttctgaccaaaaaacttgtaaagctagctccaaaaacacgatgaatattttccattttatcactcttccagtcttattcttaaattaaatttcctctgacgcttgcttcgaaaatccttatttattttaatattaagcaagtttggaacctgtagctcaatattaaagagtacataagtattcaaaaattgtgttgctaatattttcattttctcttctacaatttcatcagtaattcgcttccagtttaatagaagagtaaccggcaataaccaaaagaggaagtgtatttagagttagacgttgtgactcatcggtttttatttttctgacctttgtagcatacaaaatctacaatttgcaaggcatagaactatagaagggtttccgctatatatcagctctacggtcatcgtggctgttgttaactgttactgagatttagtcgttgtacatttaataattattagcggtcatgcgttaattgcaattcctgccagcctgtaatgttccatttttatgatgacaaccaaataaatgttgcgttggaggctttacaacttgaacccaatttgcaagagtgctttaatttctaatagcatctccaaatgagaatttcttaaataaaatttttaaattattttttatggtttctagtattttttgttatattattataagaaatttatagataattatactccaatgataaaaaaaactctaaaaaaatttcaaaaaatccacacttttatatttttttatttttccttaattatgatattattgtgtcaagataaatattattttttattgttaaaaaaacaattttttgtagaagatataaattttatttacagatttattctaatgaaaaagaaattataagagtttttttcacttaagaaatctttcaataaaatctgaggaataagattgttttaggccattgtgtattatctaaactgggagtaggaccaccagcacacggcaacatccatccaaccaaattttcctcttcaggaaattccaacaagatttagcatcaataaatgttttgcaagttctctaacaaacccctcatcataaaattgatatgcagtctctggagactccaactgacctgttagttttaccacaatcattccatctatcatagctaatttctttgggattagtccagcaaagtttccaaaactgacaaaccacacttctttaatattaaagataaaaaaaaatacaaaaaaaaaaaactattgtttaaaatatggctttagttgtccaaaaaaaaatgactttagtctctttaagtacgaattcatcttatttgttacttttattttatcattttagttttaactatgatttattttagaatattcacatatcagattgagtcatatttatctaaattcaagatttatctaaactcattaccaatccaattaaaattttaaggttccgtcagatctatgcaattttttacatattcaactcaaaccaacttgatcatgatagaatctgaatatttttaaaaaattataaaaattacaatttttttttgaacaatttctttttgcttaaaactttgtaagcatatatttccttcacccataattatatgattcttttaactaattcacattccttaaaaaaaaataaaagctaatttaattcatctcatttaacttgtcaattatttatattatcattcctaaattacatttttcttatttctctatccacataattacttttaattaatgtttgaaaatagaataattaagaaagaatatgtaaaaataataataaataatatatctagaagtcttttaaaaattataaaaagaaacaaataaattttaaagagtcttgtaattaaaaacaaaagaagtaatactaaaatgcacttttgagaccaaattgtgataatatttaattaataataatttcaatactaatacaatatatttattttagataaaatattgtattaactagaaaaaatataaacaaaatcaagacaaaaataaaaccaactcaaaataaatcatagacaattaaataattaattactataatactaaatttaattatatggtataaattgaatcaaacttaaaaggataaaacatgttatctaacttataaatgaacgagtcttaattgaattatgctaaactcatctcaaacacttaaaaaaaactgaatataattaaatcagattgaattgcaactggacccgaacatgtgaatatccctcattttttcattaaaactgttatttcatactttattttttgaatttttaaatttaaatccaaaaataaatcatccaataacttttaattaggtaatattatgtcaacttattctgttagattaaaagtttcattcacaaaattttagattaacccagaatgatttgatacctcatgcatgtgtatcattcctacatactggcaggatcaaccgggtacctcattcatgtctatcattccagcatactggcaggaggatcaaccgggtagcatccactaatgaccatgcacaacttcatttgacatgacaacatgaaagccccaaaatacaatcaacaaaacgtgaaaaggattgcaggaaggaatatccgagaaacaattggttgcctaacaaaatttttaagtacttaatttgtctgtcgacaaggaagttataaaactgcagctattaggaccaaaatcaataaaataagaggatatggaaacaagaaaaacacccctctttcctctagaagactagctcatgaggtttcacgccagcctttaaagaaaacctggcatacagataagtcttcaaatctggaacactctcgatggcttttatcaatgcagagtcaacagttttctggtcatctttcttctgctggggcaacacactcttttcctgcattataaagaagaaaaagacagagatcagcacgcagaagcaactaaaaataacaagaacttcaacaaaataagaaaatagacaatcccacctccttttctgcctcaaagaactcgccctctcccttcttcttcttcttcttctgggcttcctttgcaaagtatttgtcatcaaactggtcaacattaacagcagacacatctactttggttgatgtgccaataacatacgactgattgacacgtctcaaaggaactccattaatcttgaaaggacctgacgttgcaagtgagaaacataagccaaaccagaaatgggtggagcacagagtacatctcagaaaagcagagtctagtaccattaaaatttgagatcaatatgcatcaaaaatcaatgtcaaacaacgacttcaacaatgactaatacataaattcaattgatgataacaagagtcaaagcataagaaattaacaatatgctaaagtaacataattaatgacaaaactcaccagtcacaagaagcagcccagaaggaagctgcttcaaaaagactaccctctttcccttaaatctaccggcaagaagaatcaacactgtcccgggagtaatgctagccctgaacacacacacccaacacaaatcacacgccataagctacacatataaataaaaaaatgtcattaatccaaagaaattttattaaaaaaaaaacaaacttcattttatcaattagcagtaacatgcatttcactcaccagatcccaaatcaatttactagcatcatcataaaataagtcaaaataaataaaaacacaaataaaaaaacaaattaaggcgaggatgggattgacgtgaaaatgcacctgagcttagcaggtttcggtttgtgcttgttgacaaggggcttcttgatatcatcagcagggtaaaatttgggtggtttttcagcaggagcttcaggtttgggtttagggtcgtggcgaggtaaaacgccaccgtttttagccttgatagcccaaatgcccctcttgtggtacatctgcgacctcgagtactttccgattccccttatcaattcaggatttctgctaaccttacgtgttatcttcggcgccattgctgcttcttcctgctacactacaaaccctaattatcgttcaatgcgcaaatgaaaatcagacatacctgctctgtataaatcctatctaacgggccttgacccgactcgaagggtccatgttccaggcccaagaaatgttggcttacgtctgtggttccaagcccagtctaatatgtgtccataaattttttaatatgccgatcttcattttactaattaaaatttaatttgtttaaattgacacgtgccatcaaactatttaaatgatttgatttttgataagtaaggtcttagttttggatttgtttagatgagagaattagtcttattgtgcatgatgtccgactcaaataagattgaatattttacctatggtttaaatgaaaaaacatggtttttttcctctttgtctcacacatatcatacttttatcttttaaagtgtaaatttcatttcattcaaattcaaaaagaaacttttcatttttatttatacttttttttagtatatattaaatgcatattcaatttattatgaagaaataatacttcacgtttatcagcttttaaaaaataaaggattattttttcaaatttagtctaaacatgaatattaaagttttccaaaagcaaaattacttaactgcaagtcaatagaaaattctaaaaagccgccaagggcaaaaaaaaataatactcgggaaggctcattcttgtcattgtcgattttctaatatcttaaaattttatgaatgtattatggaaagatttccatgtaaacctaaacttgggtcttgaatttggcaaaggagccactttagtacgtaaaattaatgaaacaaaaaatattctctaaattcgtaattcgtcattcgtgttattcgttttattaagtggaacatcattatgtattatgcaaaaccttttgctattaattagattatgaatgttatttcacataaatattacgaaagcactcaaggtgcaaactaagatatactgtcaaaaatagcatacacaagtcaaatgttcacactaatacaataatacgtagtattcattttctacaaacacttaacaaaattgacccttcagattatgaaagacgtgataactaaaaaaaatcctggacgcaaatttgacaagtttagaaaattttgcatgataattgtaatcttaaaaacgctaatgtaataacccgtgtcgttttagaacaaatattcctataaatttaatattatttacattggagtatggatgacctattaatattttatgcccattttactactaccacggttcttgataatagtaccattcaccagccttgccacacgtacatctgtttccaatttttttcattggccatgctaaaggtctacacaatatctaaaattcacacaatcaacaaaatttaaagagcacgcgtcacaatttgactaacaaaattttaggttcttcatttgtctgctaacaagaacgttacaagagggcaactataacgaccagcatcaataaacaaacacgatatcaaaaacaagagtagcacccctctttcctctagaagactagctcatgaggtttcacacccgccttcagagaaaacctggcacccaaataagacttcaagtctgggacactctcaatggcttttaacaatgcagcgtccacagttttctggtcatctttcttctgctggggcaacacactcttttcctgcatcatgggaaaaaagaatgcagagatcagcatgcagaagcaagtaagaataacaggaagaacatcaacaaaatccaaaaattgataatcccacctctttctctgcctcaaagaactcgccttctcccttcttcttctttttctgggcttcctttgcaaagtatttgtcgtcaaagctgtcgacattaacagcagagacatctactttggttgatgtgccaataacataggcctgattcacacgtctcaaaggaactccattaaccttgaaaggacctgaaatggcaagtgagatataagacagaccagaaatgggtggagaacagagtgcatctcaaactacaattggtgagcaataggtatttaggtaccaaagaccaatgtcaaactacattctagagcacacccaccaacatattactcactagcattttcacccacatgcccagaaaactacacaagttgggaaataaagggatcaattggtttgagaatattttttatttatttcactattaattacaaaagcacctccttgctttcatttaatttcctgttttcaaaagtttaaagcatcttattattgttttctattttcactgtttcctatacaattttaaatcagaaaatgaaatccctaatataatgagactaacattgtgagaaaaaacaggagtatacaccccaagcaataataaagaagcaacatttacatacaagagtaataattgattattactcatcaagagtaaaataaaaaattcaattgattattacaatggcacatgaacaaaatgcttagcatgcaaaatcttggcactaagaagtatcatgtttaacaacaaaactcaccagttacaagaagcaatcccgaaggaagctgcttcaaaaagactaccctctttcccttaaatctaccagcaagaagaatcaacactgttccgggagtaatgctagccctgaaacacatccaacattctacttagttacatgttagtgaattggttagttataaatttaccctgagctttgtatcagcacattatattattcaatcattaaatttcagagtttcctatagatactctttctactttaatctcaatgacatgtcacctttctaacatctcaaactccaaatcaaatcaattaaacaaactaaactataatcaaataaaaaatacaaaccttaaaatccattacacataacaagtgagaatgagattgataatgcacctgagcttagcgggtttgggtttgtgcttgttgacaaggggcttcttgacatcatcagcagggtaaaatttgggttgtttttcagcgggtatttcaggtttgggtttagggtcgtggcgaggtaaaacgccaccgtttttggccttgatagcccaaatgcccctcttgtggtacatctgcgaccttgagtactttccaattccccttatcaattcggggtttctgctaaccttgcgtgttaccttcggcgccattgctgtttgttcctgctacactacaaaccctaattttagttcaatgcgcaaatgaaatcacagaagtgcctcattttgtataaaccctatctaacgggccctgaccggactcaaaggatccatgtctcaggcccatgagctgttttgtcattataaacgtaacaacatgagaaaattgtctttttttttttttttttaagaaattactttcatgtcttattctcaatttctgtgactctgatttgttactaagtaattttaaaatatcccaattgtatattattaattatacatagaattaattttaaaaaaattgtccatagaatcattgcttagtatttccattaagcggttaatttgaaactaatttattttagaaaaatgctttgaattgactcttatttaagacacagattaatattttaaataatgttaaagcacgccagtccaaattaaaagagattcttcactactccttgtccgaagagctaaaggaagataagttcaaatgtaactatgactcggttgagcataaaaataatcaattgtttcttttggagaggatggatggtgccaccatttacattgctttcttcaacaaaaaattgtcctatccttgggacttcggagtaaagctagaaatacaaattttacatgcacaaagtcgtcggttctattagaagaatctatagttgcaagttcacatttgcattcatgtaccagttaacacataatcaacaattctgcctattagttgagtctttgtccacctaaacttaagcttagcgttgccttccttgaccagtcacccacaagagaacacctccatctctttggtatgtgctgtagaagttcgttgtcatgtttcaacctcaaggaaaaatcactgcacagtctcatcctttgtctacagagaggtgagcttgaatttaattgaatcacaaaattaaccttgttaaaaaatgtcttcaggatgaaaaaagcatgaagcccaatactgttgcctaatgaaatagcaagctatgtacagtttgattaatatcaatcatcaagaaaaaatgtggcagtattaggcacataaccaaaccctttgatctgtagaatcaaattgtctaaactagagatataagtatagagtcacgatgggctgtctctggcaataaatctttgaacttcattattcacttcaatccagctccaacctggttccttcactaccctgctcaaagcaatggtggcgctcctagtggcaactacatccgaccctgcttccatcaacccggccaacgcgctgttgggcatgcccgggtggaaggtccccattttcaggttcaaaccattaaaattatgcccttttttgctggttatttgtttgtttgaattgactgttatttgttggaacttactaggatgatatgaagagctatgtgaatgaaggggtgagggtgttggtacatgggaagagcatagtagtggaagatgagttggacaagaggtgggaagaagttactggggaggttattgatgaagtgatcttcttcagcaagcacactgctgcctccaagaaccctgccctgattgttcaccctattggagttcctcatttgtgccaaggcgatgttccgccccaaggcggcagacctggatgggcagctcttccaaatcctaggatggggccttggcttcgccttttgaaaaaccttgcccaagctcataatcttgtccctgaatttgaggtgctcatgtgtttttttgctattcaactaaattggctttagatctattcgacattcctgcttgcaaatgcatagcttgtttcctatggatggaagcttcaatttttatatgcatttctgagactgtttcctcaatttagaccatggaccgttgaccaataagccaaccatgtttttggagattggtcagtgttttttccttcataaacttattttgtaagcacgttagcaatttgaccctcataaacttttggatcgttacattattcataaaattctattatcaaatttaatgaccctgtgatggaaggctgtaaatagtacattcagatagattatgaaaatatattgactacaaagttttgttttataatgcatcttgactttgggtgaataaatttctactaaatccatttgagaagatatttaataaaattttatgattaacaaaatgctttgtgtgcttaaattagtcactttgtaattacatggcctttattttgaaagctctgtaaattttataagctttctcatactagatctcatattgtatcagttacctgagggtgattttggaattgaaattctaaacattttgtgtgccttatattttctcttggatgtgttttactcaaatgaaatatggatacttactctgctcatccgatctaggaaagataatgtatgggtgggtcacctactttctggatattcgctgtcaatggaagatccaaaccagtcaaaaggataaacaaatgtggatagtggtggaacatggagacagtctataaaagctgcatatgaaaccacttattctgcgtttcctggtggtgaaattcttgcacatctagaccacaagtgagcttaatgagcattgtccttatgccatcagcaatctgtttgtattgctaatgccaaagcaagaactgaatgctatttcatccacaaccacaaggcaccttgatttgaaacacttaatcaatgttgttacttagaccacaatctgtttaagactttccacctaccattctcttgcagtaatagattgtaaagaaaaatggtagaacagctttctttgggttagggaaaagtgggaaaagagtgataaatccttttccaccatcccttccacactccctgacccccactagttcacagcccttccccactaatggaaaatgtcagagaacaagttccttgtagaaccaacctggaccctacctagttcctgttcctgccattggttatcatgttcacttgttaagatttaagagtcatctgcactctttgtggtgaggggactagcccaaaggttacccactttccaaattaattgtcatatacactccacatcccctccattgctgactgatttttattactgggtttgcttgttagtatagtaatttgcttaaaactaagttaacacttcggtgctatgttcatgtcaactgcaaaattttgaaattcaaatgagtctggaatgagggttttgtgcactaggagaaaaaggaagaaataagaaaacactattttagcagggtatgctgctgtcatattgaccttgtttttgtagccaattacacatgtttgtccttgagtactaaaatgatgatctggtaatgctagaaagcgatattcttaggagtacattcatcgtttcctgtgtctgtcatttgtttagcttatttatggttttacatgaaggaagaaggcatgttatgggcatatgttgaaagttaagaaaactaattatgattttagctgtgccaaggtgatcccagctttgacatcaaagatagaacctaataccttttgcttttacacaagttaatctttaccctaaactagttctttattgcaggagtttcaagggctggcagaagaatgccataacagaattccttgcggagcacaacattaaaattggaaaacccaataacttctattgagtgttgaccttggtggatgctatgtgaacaacatagttgaacaacataacttctgcagagtgcagaatgagtcaggctgaagattttggtagaccatactagcaatttaattcagttctctttagatcacagtgatagttaatgaatgactgaagtttgagataaactgatatatacctaaatccaattcaaatgaaaaacaatatttacaattacattaattaaaaccatataaagcaatagtactttatagaatgtttgcttttatgtaatgtttccaatgtttttaatgttagaccagtcattaaactgatcaatgattcaaccgtgatcgaattggtattgataataataatgataatattgtaattttataatactaaacactaaaataaaacatcattttaaatgttcttgatatttgaggttcatataaaagttcaaatcaaatatatcttaaagtataggttgaataaaaaaaaaagtttttacaaaacatatgttcattgactataataagtttatgtcgaaaaaaaatagcaagttgatataataaaattattagaaatcaagatataaaaaatgttaattaatataaataattaaattatagttttattagataaaaatttaatagtaattggtaaaataatttatacttatgtaattgttattaaatatgctttttttattgaccttaaaaatgtttaagaataaatgaaaaattaaaagtactaatttaaaccaattaaaaaaaataagtttatatctttattaatttttctctgttttattttacttatatgctttatttgtttgggtggagtgacaaatgaatggttaaggagacatggaaaacaacttcatataatttagactgttcatcgtttagaacattctaacaaaatgaataaatgggaagttgtttgtcgatcttatgtcaactttatgttccgtccaatttttcatggaaaggaaaagaaaaagaaaatacaaaataatacaactttacttatatctcatttttaaggaaatgttatagcattctttatttaacacacacgtttaaggtttcttaaaatttgaaacacacacacacaaaagggaaaccacttaaggacaatcatgtagattctaaaatatttcaacttttgacaccatagctttatattgtcaaacccaaaaggaaaccacttttatgtaacctgccaaagtgccaagctacttgtatataaaaccttatctttacttttgatgaaatcttaaccttatcttggatatataaaaagggataggaataattaatatagggggagagtacattaaataaaatactaaataaaatttggcgttaatgttgtcactttatttttattttacatttttttacatttataagctataatttgattgaaaagtaggaatttgttgtgcaatttgttctatagaaattttgtgggggaaaacgtgatatataaattgatttacatgcgatttgtttaattattaccttcaaatatattttatttttatttattttgaattttgcttcatcaggagaaaaagagaatttgattaatttaaaattcagttgagaagtaactaaattctgaagaagaaaaaattaacatgatggttttgaagagcaaaaagtaaatactactattcaagaagagaagtcttcgattatagcttatttatatatgacacacgagacaaaactaataaaatcatgcagcaacccgaaatcccaaaaaaagttaaaaataaaaatcaataaagacataagtgggtaggtaggttttggttcacaaatattaggtaagagctttcttctaatcaaacatttcaccctattagtcccagtagaagatcttaaatctgattaattggccacaccaagaaaaggagatgaccgattcaaaagtctaagcttagtcttcatcaaaataatgacctggacctactcttttccattgtgccgacgttttttattctcctcgttgcatcaccgatattcccacacattatagatgcaaaatacattttaatccacatgtgccagcggattttccgtttggataacatattaaaactattttatctatcgtgtcacacgttttaatgtgaatttgtagttaaaattataatactcgtttccaattacatttaatttaagaataatacatcaaattagtttataagattacgaatatccatcaatttattcattgaaattacaaaaaatgtcatcttatatttattaaaagaataaaatatatatttgatccctcttgtgaaacccggaatttgtttcttaaaaaaactttgtcctatgttatttccgttaaaagacccactgtgttcatctaacattttaacgtctacctttaccaaattttttaaaagcattttacaaatgcctcacatcacacataatttgtgttcaaccctgtctattactaagcaaattcactaacagagttaatatattagatgaataaaaaacaaaagcatattttactcttattaaaattaccaaacatagattgtttttaaatctttattattataacttcaataattataataactgtcattagtaattttagagagtaaactgaattttatttaacaattttataattaaaatgaaactttgatttttttaagaagaaaaaaatgaattttctataattttaagaactaaattgatagatgttcaaattttcgtaaactaagttgatatattattttacattcattcaatagtttaaaatcaattatatgttaatacaatacaatagtaaaatcagttatactaaaataatgtttaagggattagaaaatttgtagaagtatcacatgctcacataatattgcaaacattgatgactgtcatgtgacatgatcacttaacctattgttagatacataaatagttaacaagtatcacagccaatagtggatccataaagtttttttagtaggagaaaaaatagtctaatattttttgaaacaaaaaatataatctttattaaaaattataataaaaaataaaaaattaaaatttaaaaggataaaattaataataatttattattttttatctttaataactatttacattcatcttattaaaaaattatcttataagaataaaatttatttttctattagacaaatttttctattatatataaataaataaataaattatagtggggtaattgccccacaatgatgtatgtgcatccaccaataatcacaataattaaataaaaaaaaagtaattcttgcaaaattaataccagagtgcataaactaaacaacaaattgtgaacttattattatcgagatatgtagattaattagtataaagttatttaaatttaaccaataatcttaaattttaatagcagcatataactatcttaaataataagagagttatattgtctataataatcctacaagctcaaatataataatctttaataaaaatatatatagtccaaaaaaatgtaaaactattaatgtcaagtaaaacatattggctaataaccggtattttatgtagtcaaactagcatatgatgtatgcatgggtggaataatttcctccaagaggctttacatctctatatatgatatttaaaatttgacttgatcttatgtttgacaaattaattttacaatcatcttatatttttataaattaatatatttttaaaaaatattagtaacatttttttattgattaaaatttattaaaaaatataatttttatattttttaaattgtttttgatacgacatattcattaattttaatgattattgattttcatctagaacttaagtgaatgccattgataaagtcactattctcaaccacatttgattgaatccaaaattttgctattagaacttatttttacttaagccaaccaacgacgtagtatacgtttggagatccattagaaaggctacaaatgtattgaagatgaaggagcgatcgctatctcaccagaatcgttgtggtgctgatgttgcgtcaaatttgtcactctttctttgttggaaaagagaatgcacgcactctcctacccgtacggcttgcaccactacttccaccaacttcccaactcgtggtaggtggtcaccagagcacgtgctactgccacgtgacatctccattccgttcccttttgcctgcctaatcagcaatctggacaacaaaacccttttattctcctaattaatttctaaattcttattcattttaattttggttttcttattttcgtaattttaaatatagtcattcagattataaatgatcaaaatgctcattattaaaagtaaaaccaaaatctaccattcctggtcatactcacaccaaatcctaatgaacaaattatttattcactttcgtactcattcaatttataaccattcaatcgataaccgcccaaacgtataatttattacgctttacaataataaacacacattaaatatgacctctatggctcaatgtaattttttggtaaataaaaaagatgaatgtgacttttttattcatattaaatatgacttctttttttacaaaaaatatgacttctatgtagttgatatttaaatattttttttactatatatgcctcattcaattcaataacactttgagttaagttaataatacatatcaagattgtaagagagaacaattttctaaagatttggtatctacaaaatgtattattttttgaaagagataataaatttcgtgcaactaaatctaatacactaaaatcagtttaatagtaagaagattctaatttaatatgagaaaataagatatatattgatatttttatattattgtttatagtttattaactttgataataattattttaaactcatattaaacatgatttttaataagttgagctgatacaattttctctctcccatttgttagtgatcaaaagaaggaaaaataattagagtgcggaatggtgaaaattggattggatctctttaggcataagaaacagaatgagagggaattatgcagaaagaaaaataatctgaaaaccatttgacttcacaatcatccctttttccagtctgacgccattttattattcattcatatatattaggctttctcaccatccattccaattactattagattctgcttcctcagcagagcacctcttcttcacttcctctttactattacttcaatttagtgattcgttcgttctggattcagtcgaggggaaaaaactgcgtggtttgagcaatggatgttaaagctgcacagaggttacagctttcagcggtggttcaacccgaaaggattgggagaagaccaccattcagtacatgtcgtttgggtgtgtctcgggaaccacatagccttcgggtttttgtttcgccaacgatgatgcggagcagaacaaccgctttggaagtttcctgttcttacgacaacgtttcgggtttccattcaaaccaatcaccccattactttattttattttattttaattttgctcttttggtgttgttgaatttcgttcttgctgctttccacacgcttttgttgttgaagggtcattttgccttattttattatttaattttgctgaaaggattgttagttctgagctatctttctttcaaacaaaatgaaggattggtatttgggttaggaagtgtaaattgtcaatgaatcggaaacaacgatctgtccttttcgtgtgccatattgtatatctgcctccaaaggtacctgataaataatatctcggaatatttggtctttaaccgtgccaaatagcatcgtatggtgtgatccatgtaggataaggcttttgttgttgttggtggtggtggtgaaaagattttacactatcaacaaatagatagaaatcatcatagaaatgatttttaaagtaattttctggtagtcaataattttaaattatatgacagtctatgattgaataatagtgtgaaaaaaaaactttatactggtagtatattctaattaaattatagatattttgtccatttcattattttcctgtctgaattgtgtacataaacataggttttcccaaggttgtgttttatttttccagcaatatctatattgaaaaacattatatgattaatatgaaaagataatgctagtggtcccaggttttcaatccagcaataactacattgtccagttttgtcttgaactagcttttattatctgcagattgaattacttttccttttctattgattactgattagttaagaaaattatgttaccacatcttctgagggaaagcatggtgtttgagaagatgtaatatgtattatgcctggattggatctagtttcttactggataaaacaagtgctgcccattttgaatttttacatattattcctaatgttattcttgtagcttcaatattggaatctggaagcatttgtgctcctcttgatgaagagctgattctaaaggtaaaacaatgatattgtttgtcattttttgttaatttagtaaattcaccaataaattaatattaggtcaattgttgcttatttaagtatctacatgccattatcttacttgaatcaataaaattgcagaatagatcacaggagatccagccatatttaaatggacgctgtatttatcttgttggtcagtttcttggttgacttcttgtgcttacatggtatgctttggaaattactttggcattaaaaatgctttgaacttgacatgcaggaatgatgggctctgggaaaacaacagtggggaagataatgtcgcaagtgcttggttattcattttgtgataggttagtatgttaattgctcatcttctcttcatggggagaaaatgcatttaattaatagcaagtaaattatgtgtaattggaatgcacaatagacccgtagaataaagaaagaatgatcaatggttgtaaagaagctctattatttttatttgtgcaattatttcgttatattttagtatctgatatgagcttcaaccgaccaatattcatattcatttgatattagagggaactgaggacatgtaaaagatgtatgtgtgtgtgattgtattcaatagatgaaaacagggtgtgtctcagttaagctggggaatatgatctactgatctactctgctgtgtaatgtatctgctcagatctttatgctacagtgtacatgttctatcacaatacaattaatctgtttcatgaccatattagaggtcttgctgaatattttctctattttttgaacttatgggtgtgtagtgatgcattggtggaggaggaggttggtggaaactctgtagctgatatattccagcaacatggtgagactttctttcgtaataaggaggtcagttggaaagcactatgattttagttgttatattcttcagtgttcagagagtgtgtttagttgtgttgaaattttagattctcctgtttgtttaatctcatccagcatcctcatcgtcatctatcttcatattatcctatattataagcagcagtggtgctggattgttttaattggagtggccacatagaaaaagtaggcttacatatgtttttagtccttgaaaatataatttttcattttagtccctttatttgtttttaattcttgcatttagcaatgtgtttttagtccttcattagagactaaaagcacataattttaaaccaattgaggtcagatttggcggaaggggccagtcatccacaaagtagcaaatcaagtaattattatcagtgtctttgatggccagacatgtctgtaattgttgcatggcacttccttgggccgctggctatatgacatgagctcccacatgttcattgagctattcctcttcaacctgtcctgtggcacaattctgctgccttattcctaaaatatggatctgttctgaattctgattttgtgtagctttctcctctcattccagtagctttcttctctattttacatcttcttcccactagtacttcccctgctgtcaatccattctggcaacattgtccagtaatttgcaactgctggtgacttctccagccactctctggtgcctttttcttggtaacaagcttaaagcttagtaagctttggcttgagggggaagtgttagaattatgtgcagttcatttatcacatgttaaaatgcctttagtattcataggatttgatatttaggaaattgcacctatttaatctttgcctatagtgtctatatatggatgttttgactgttgcatgatggaggtactgaataagaaagcattttgttcagatcttactctctagaatatcctatctatatttctctcttcctccccctctaaattcaacagaactttggtatcacgaattgttctggattatttttggggttctgttattgcattcgtcattctgtttccctgcttaccatttcagactgaggtgttgcataagctatccctgctgcatcgacttgttatatctactggtggaggtgctgttacaaggcccatcaattggtataagaattagctcgctggtcgctactgagaaaagtttaaacttcgctctttctcaattaaatctttcctcatctttacatgtgaatgaatttccaggaaatatatgcacaagggggttagtgtttggttggatgtaccagtggaagccctggcacagagaattgcagctgtaggaactaattctcgtccccttctacactatgaagcaggggatccttacacacgggtaattatttatgttccatagtaggggtttttttcttttctaaacataacacattagtttaagaatttaagctaccaagttggaccaacttatcatcataggaatttgcatcaaaattatttttccactaaataattttaccctttggaattcgcattcaggcttttatgcgtttgtctgctatttttgaagagagaggtgaagcatatgccaacgccaatgccagggtctcattaaaaagtatgtctattaatcttttgttaatgttttgaaatatatatatatatatatatatatatatatatatatatatatatatataaaagtgtggaattgtccagaatatatgggaaagaataaacatgctttgtatttattgttgaatgcttcttagatgataacattaaaatgcaatatctgatgctgcttttgtctgtgacagatatagcaataaaactgagcaaaagagatgtgtccgaattgtctccaactgatattgcaattgaggtcttgagcaatttctgcctcatgcccttccttctaactccattttgttggcttcaggcaaactgaaaagttcctggagctaaagttgaatctaacttttgtattgatgcttatcttatgttatccctttttatcttgcaggcgctagaacaaattgacaactttttgaagggtgaaggaggccgttctgcagaatgctagtaaaagctttggtcacaagcttctttttgattgttcatattttttttcatgcaattgcaattaaggtcatgctgttgacctctctttggtaaaaaaaaaagggtagtaatgcaacatggcacttgtttatgcataatttgtgttggcaaattagcacaatccgacagccaatagcaacatttaatttttgttctgtttattgttgaatgttgatgtatatacacatacacactggtaaacgaggtgttgtaatccgagttcggttgatcaatttatgtatgccttcctctaaagaggtttgtatgttgtaaagtgacactcgcatattttaaattctgctttatcttatatttatctcatgctagttctaatgttccatgcgaaagatctttatgaaacatattgttttttttttgttttttttttttttaatttttagaacgtttcttattttaacggtcattgtagggatgaaaatgttagccgctgtattgaacttgtttattgaattgcagtgtcatcacattagtaatttgtgcatttaaggacatcttatttcatatcattaggttgatatcatataaataggagttttgtgagatccaactcttcacaatatcttctgccaaaaaaaaaaaaaaaaaaaaaccctccataataatatccaagatctaacccaacatatcttcttcccaaaaaccctccataatatccaagaccaaacctaacataacgtttagtagcctcggctatgtaggaaaattaatacaaggtctgcttttaaagaattggaaataaaagaagcataaaaaatacgtaaagaaatttggagatcaggcatatatgtttagtgaaccatatagttgcttcaagcaaaacatgaaaccgaagtacctaggcccaatattgatgaatattgtggatggctttaggttggtttgccaacctctgctatgtagtttgctcctaatttgggtacaatcttttacgtgggtgactggttttttttttttttttggtaagtaagcaagaaagttgaaagagacccaaagcccaaaggttttttattttttagatgaaaatttagggtgaagaaataacctgtagtgtcccaatataatgcattcgggtttaaagaacacttataaataaacttacatttagcacatgtttagttggtaggcaaataaaaaccgtgtggaaatccggaagtgacattgggttaatttactataaacatgaaaaattaatcaaatttctttcaaatataccgcaaaaccaaacacacgcttacttcatagagatgactataagttaaaacttaaaatctgtcacatataagatgttgctttacttcactcaaccaatcccttgaattaggttttattcaaattagtttttttgcattccttgatattaatttaagagaatttcattaataataataaaacgatagttatttagcttaggtgtccgcatttggtggtacgcatatattttgtacagacactgtaatgctgtcaaataggcccttgatcgaatgcgtgagaagcccttcatacgaaattctggaacatctttgcatatgtaactctatatcactcaagtctcaagccattaatatcttgttaaaattttctgaagagtttaagctattagttatgattgttatttgtttatttgactcttacgaacattaatgttgagatggccgagttggtctaaggcgccagattaaggttctggtccgaaagggcgtgggttcaaatcccactctcaacaatactttatatatatatatatatatgtgtgtgtgtttttcttatcttttttctccttggttggtcctaccaactaccaagtttgaagtccttatctgcaccaagctccaccctccaataatcaaacagcgtagatagcaaagggataatgtggatgagaaccatggctaactcatatcttcttcccaaaccctattattaccataattttcattatcagcaccaatgatacttcaagatcaacctcccaaaatgaactactagtactagagcttcctctgctgcccctggggtcgacctcaacactctcgaatctgccctttccaaggtggtagtttagcatcaaatgtctattatgattttcacaccaaggggtaataaacacttgctttgtttgttaattgttagataccagttgaacaatgtaatagagcattacaataggcttaagttaagaatagttgagataagaattgagctccaattagattctttggctttatatttatgcccccatgaaaatattgctcccagttcagttacaaggtagttactgtccgtgtgtttagattagcattggcaaaattaattttcaaccaaatttattttgcaaattgattttgaagtagataatgctttttagtacgaatccaaattcgtgaaaatttacgagatgatctgattggttaaaaatgttcaatttggatatgtagatacataaaatcctttttgtatagggatccaccgtttatggttataaattcccacttttcgtactcaatttcgtaaggattttttgcactaaataacactactctttgaagcaatgtgatttatgtttgaaagtttttattctaaaaacaggttagtagtaaaatccaatataattttttatattcaatgtaaaagttacctaaagttgattcaatcaaaataagttctagacccataataaattccttaaggtagtaatagaatcaagcatgtgaaatttacctaaaatcacattagctggtattttaacatgattctagacaattcaacgtggaaacaaacatgcacttactgtctagctttggagctgctactggttaggtaaataatagataggtttgtttgtgcagaaagacagtgatgctgttaaagaggcacttaaacagcttagtgaagttggttgggccaagaaatggagttctcagccatatgtttcacgtcgtacggtcagtctccaattacaaatgtgacaaagtgacaactaaacattaagctctcatcaaccattcttggacatagcatccatcatgtatacctgtccagtgcttccactactcattcatatgtaaactaattcatcgctcatacaagttttcaccgttcaaaatttgtgtatcagacatcactccgggagctgacaagtctaggcataaaaaactaaagagaaccttgcaattcctagtgtcagaaatgatgtgagtttcagaaatcttttaatttttagtatcaaatggagtatgtaatatcatatgtaaatatctcaattgtaaaaggggaaactagtaatttctaataagactttcaatcttcaagacatatgtttctttaagttgtacgcattcttaaccaacaagttacaaaaatctttaatggtgcaggcagcttttctttttactgtggttggaacaacaggattttcggctgttctggctgggcaacttcccggggtatcactagcacacttgtgttttgctctgtatgtctgtttaatgatttagtgttgaagcacgcattgtaaatgcagatatgggattcattttgcttgcagaaataatgtaaattattatggaagcagtatgtggttggagcttctagtagaataatatatttatggattttaaatgcttgcttggcaaccagataaaagagcaaccaaagtagaagatttagaaactctttcctttcatgcatgcatcatggtctcactctacatattatattctaacgccaacattggtgatacttaatatactgtattacgctttttgtggtttacaaaatttgaattggaaaaaaattggttaaaaatacttttccttatatttttcttctaactacttcccacacactcaaccaggcagaccttaaaataattttgacatttttttttccatctctgattgatgtgtgctgactcttgtaggattggggcttctttgtaccatatttgattgggagtatctcattagtggttttggctgtgggtagcatatccccagggtaagaagaattgtgtttgccatgtagtaatggatacccctcttcagtgttaaatgttaatttgctttacattaatgctccaagttgctagtgtaggcttctccaagctgctattggcagcttttcaacacttttccctgattatcaagaaaggattgccaggcatgaagcagctcagtttttgagtactgcccttttcttttttgtctggttttcatgcacaatgcatcagatatgtgactttgctctaacccattttttgtttggtcttctgtttcattctagttgcttatctgcttggcctacccattttttactattccctggatattgggaaagaacatgtcaatctcattgatgagaggcttgaaaagcttatctatagcggacagcttgatgccaaagagctagataggtatttatttaccatacagctctaatttctcttattcaatgttaaagaaaaaagccatgccagcttataacttttcaagaaccaagtaccaaccaagccaagccttaataatcacaaaacttgccttgccttaattttgaaagagttttagtcagtaatttgatttttttcatatcagattggctgttgtgtcaatggctggactggcagcagatggtttaacatatgacaaggtggttggtcaatttgctgatcttttcagtctccaggttaagtatctctattttttttttataagatgtggatattatactactcgctattatctcaaataataatactaaaagatttttttttccctgcagagatttattaacggaaccaagccatcactcagcaaagatcagcaacaaaatctcacaagatgggccgtatgttttcaaataccatctacgtttacagtttgataagtaccaaaaataaatatagccctcaaatttatgcatttttgctcttaaaaagctcatgtttgcaggttctctcttgaaaaataacaaggtgactcatgaagccttaatggcagcgatgacgaagaaggcaagcttactggaatgcattcgggcaatcgaaaatgcagcatagttccaaatttaacggttttcagccaagacatcaaaatatagtataaccaaagtttaagaactacaaattacaatttcaagttatttcttgttcataatcactcatgattccagcttcttctttttttatgagcattcaactttccattatttttgtgactgttggtatttgatataggttagtatatgcaagaatgatatattaacataacatagaattgaaaagggtagctcacataattagaggggtttgataaaaaaaaaaaaaaaaaaaaccatgtaaataagaaagcgagacacaatcgtttacactatacagaatccatttaggttcaacacatctatggtgcgcatcatttatttattttactatttcttcttctgcatccggatgacatcacttttgctgctattcttcctctgcttgtatatttctaaatattatttagtattgcatcttagtctaactgtgtctatggtttttagacacattaaatctgcaaagtgtgtaaaatggtaagaatggtatatttgatcacagttcatcaggccaatcagtagggtcgtcgccttcatagaacaaaccatctacgatttggtcaattacggaatcgatgaatgcgttgcagctgacggtgaagattcgaccaactctgtttcgagcactggagaaccatgcaaagagtgctgcacaagttactgcacccaaacacaccccaccagcctctgtgattccttcaatgtccatctttctgaacacagagtttcctgtcaccatttccattgtcaccgtcgcggcaaacaccatctgcaacaaacatataattaacatcatatataatcaaaattaaaataaataaaaaatgatctagtgcctaattctttatttctcttataactaagagtttaaattgcatgcacgagtattaatttaaaaggaacattgacaaaaattatggcaagaaggaaacgggaagggtacactacacttcctggtatttaatttgtaagataattctatattcaatggaaaaaaaatagtaaatataattttgatatatatttttgaacagggaatcttccggtcaacgattaattctgcacaatagatatctttctatatttcaatatataaaaaccgaggatcaaatcctaagcacacgtttaaacaaattatctattaatcatatcataccaagttaattaaatgttaattaatttaaaaatattttttagattattatataaactaactaccttaataatatatagtcatgaataagaagtacaatttgtaaagaaaaacagattaatgatttgatgaataaaattgaaattaatttggatggggttagaacttaaagtagcagtaaaagttgtagccataaaaaatgaatggaaagtgcaagtttttatttatgaatagttacgaaccatagccagacgaccagagatgatctcaaaatcttgacttttcttagaactctcaatatagtcggaaagcgcggcgaagaagggggacacgtcataatcgtcaccctccttgcgggtcttgatcagtacccccgctcgatccgaaccataggatctcagagtgcacaaccgcggctgcaaaacgatgttcgcgccttccgcctccgccgctttgggtttcgggatcgtaacctgaaccggaccggccggttccctcgcccgaaccgcgggcctcgccgatcgcagctcgcagtgcactacacgcgtcgcagatgccatagagagaaaggattttgggagaacctaagaattgaaaagagtatgataggagaggagctacaagaaagtctacgattaccaagtgcgggaccagatagaggaggttacgtgtcagtcaattggttcggcaacgtagctttcgaatgtgaggccaaaagacactgtggtgtcgtttcgacaattttttttcttcttaatcctcatattcacaaaagaaacactattataaattcaaaattccatcaaaagaaatgagcaaaatttaactattaattattttttattaaagattgaattaggatagtatttgaacaattatttggaatatatataaaaataaattaaattatattaatataaatttgataattattatatcatcttataactttgtttaattggataatatatttttaaaatttattgttaaattattattctttaaataaattacatatacaaaattttatattaatctaaattatttattaactcttttatataaattaaaattaatataatataaatattttaaaatataataaaacataaattatttaattaatttttatcaaaaaaatataaatataataattatcaaaattataatgatatatataagttgatcgtgaagtgaagcccacacacacggatgcggggattaataggaatacgtagcaccctaaagaatcagatatatattctaaggtcctctttcttctcttccctacccactcccccaaattcaaaaggactagttcttctatgttaacttataaaattaacagcaaaaaggtggttcaaatgcttatccaatgtatagagcaagtggtatctagagctagagcaagtggatttgtgacggaaacaactgacaaatccaacaaaaagtgcttgtattttctgttctatgtgtaggattaagaaaacatggatatgtcttatgtctttataatttcattatcaataaacgaataaattattgatattttaaaaaaaacctgcctagttatgaactttgcacggtttaataaaatgacataatgaggttacaaatatattagtgttactgtcataacaatatttatcagaaataatttattatcgataaatttacatcacgataaactataataaatctcaataaaataaagaaatttttaaataaaacgttatttcatcaagatttgggtctcactcgtttgtgacatttaaaatgaaggaactgatatttgacaattaaatattttttgtagagtaataatttatgtactgcacagtacaaaatgttataaaccaagtgaacaaaataaagcattttataatttcactggggcaaaaggtactcgaaagtgggagaaataaaaaaaaaatggcaattgctaatttgctatggttttattgcctacttcccaaaagggccaaaaatgcctaaacctccaaaacttcatcccttccttttgtttgctactttccttgcttttccttgcaccaatgaggatttgcctctattccgtttctgcttcagttattttgccccctcttgtctcactttttatcaatagtttgctccttcattggcgaacagtagtcagcatagtgattgaaaatttataactttaattgaaagccttaaattataaaagtcatcatagccgctgaaaattccaaagcatcagctccttcaccatcaccacatggaaaacaaaatatagagagggttaaaatgtcaggactttgaagaagtatatgaaacatatagttatttagtttcagtatcaaatcataacaattagcttgtacctagaagaaatatcaagacttacttaagtgtgaaatatatattagcttgtttgcaaactgcaaatatgtgagaagttcctattcaaatcaagccatacaagattgaaggagttgaccatattaatattcattaatttgcaatcacctatctatttgatattttggacttaaggttcaatatatcatctaccatactctcacgaagaagacagggaacgaacaaattacaagaaaaagaggaagataatagaaagagtgagagaagagtttggtgtgaacccaacacaattgttgcatttcccataaattatttacctgggcatcaagggtatgctcaactcttgtcagttcctatttatacctgttgagcaccgtagaaaatgtctcagatctacttaaacatgtagatagtaaaagagatcaaacaattttaagtacactcagttaaacatgcgcctcagttcttattttcatttagctaaaaagaccctcaagtaaaagaaatacaaaaacacaaagtatgataataaaaattacttaaaaactaaaaccataaagtttccttgcataattaattaaaaaagaaaagagaatcaagtaattcataccaaagtgatgatgggtgtgataattaagaacgatttcataccttgtaacaaatttgatcgactttctcttctaaaaaatagtaattaaactcttctcaccaaactctatgttgcctatttatgatgcctttactttatagagccatcattctataatagatttcacatattattatgctttttagatggaggttggtgattaccaacaacctaaaatttgaaccatttgttcctgcagctcctcaactttccgtgtctcaaatgttgaaagttgtagcttaagctgcaattcatgcattccctttctagagttttcaagctcaagattcacatcatcaagtgctctcttcacatgaagaagttctttttacttcacttattgactttgcatgtccctcttcaagagtgttgagtcactcactatatttattctcggctttaataatctgatcttgaaaaagagaacataattaaaggacgaagtcatcgtcataatacgaatacaagaatgccaactttcaattttgtataacaacaaaagcttgtcataaatttcaaaacatacatttgttaaaagaccaagagaatatcctatatatagaatcaatatgtagaataattactggtggtgatttatggataaaaactaaaaacagattacactccactaactgaaaagtggagtactagaggacgtcaaccctactaatattttctaataagtagggattttttaactacataatatagaaataaatcctaacaaactggataattcaataaataaaattaggtaagtaataaaataaaaatatttagtttaaaataaatagtaaaaaataaaataaaaaacaatttttaatcaacctatcatgttgataatagattttcttctcttaaaatcgatttttgttaaaataatttattgcaaacttgataatcgattaagtttggtgtgaaaacaattggtaattgattgtggaacaaaattaattgattattttatatgacaaatgtgttattgttaaaacttaaaaacttcactattgatcgatgaagtaaatcaacgtgagattctcacattttctttatctctcctttaattttaccatgtcaaacgattgaaatttcctttctctcttctattttgcaccctatctttcctcagcttttgttgttgtaccaaacataacatggtgttaaattacacttatccacaaaacaaataaaacatatttttaaatttcgaaatccataatattgtaatgtatttatttaaattttaaaagagataaactaaaaatacattgtaaattaaaaaaaaaccgagaaattaggaatttgtaagaatgtattttgatttttgtagttggaatcattattattatgatttatgttatgaaaatatgttttgtgttagaatttaaacaaagattttgagtttaattattattttttattagatttttcaaaaaagaaaatgaatagatctttataataaagaatgaatttttacaaaagagatcttgaatttaagatttattttttattagatcttaaaaaaaaatgaataaatctttattatagaaaataaatttttataaaagaattttgaagatttgtataatattaaaaaaagagtaatttttttttctaaaatctcaaaaatctttcactaaaaataataaaaaaaaaaataagaaatcttcaatattaaataatattattaaatttattaaaaaataatttaaaatctaccactaaaaacttttaatccaaaaaaaaaagtagtcatgatttctttttcattatcctaatttgtaccatgtgtggtcatctatccccacaatgcttttaacttcaaagttcaaaccaaaaacattttgctgattctaatatcccactctctctctctcattatctatcttatatctaaactactatgttggattttggagatgagctgactttagatagtttcaggattccatggctcatatggattcaacttttagtgttccttcttctccttaccattctcttttgccactccatcattgctttagatctctctcatcacaccacttctccttctgcctctgccactgattctgatcttcacactcaaccaccctccaaccaccattccactgctgtgaccaaccgtcttcagagcacccgggtacaccccatttccctttctttgctttttcttttacccttttggattgttacgcttcccaacatataaagattgcaacttgcttcctctaacctcttctctttttatattttggccttttgaaataagctaagggtgacagatcttctttggctcatagaaatctaatattttggctttctttgcatatattggttttattttcttaggttgtttaatgtcctctctgacaatttcttgttgatttgttgaagttcaaattaagcttctattatttttctttttcatctgagaaatctaggttgtagatcttctgggagtattagtgggttcactgttacaacacccctcccattaaggccactaactgaaaccttcaattggattttaattacctttaaatggtccactgacttttgtggataactgatttgaggtttcatggttaagaaaattctaggttggtaattaatgtttctggttaggaaaagaaattaaattgactaaaatgttttagttgtcatttactttttctttttattaaaggagttgtcatttacctgttcttaggtttttttttttttttttttgacagtgcctgttttgaagttatgaattatgatcgccgactctttctttgtttaggtacagtagacattaaccaaaaaacgagattgaactttcaacaatctcccctggtccccttattttgttatgaatttaatgtatgccgcatttgattgtcttcccttttcattttcaccttcaaaatttcgaaacatgcataatgatttaagataaaatttagatgtgactttgtaagtacttttgatattgttctctaatcagaattggaatctttgctcaataatcctcgtactaaagatttctattaaatattaatgtgaattactaaggtgaaattctaactataattggagaacaacaaaaatacctatgaaagtgtatctaagttttttctagtgattcaacatttcatctttgaataaaatgaaaaactgggctataccatatagactaaataatctcaacagtcaatcccttgagtcttgactgccacataaaattgtgatggcttgaaagcaaggctctgttgccatttgcttgaggccatcaaccaaagtattcaaatttgacgtttctgttcattcattttatgccaccgacagtaattaccttacctagtgctgttacgtttgacgacatccagtgtgtacatttagttattggtttaaatcaaatatacatttgccttaatattgatgtgaaaagctttattattgtctttaatgatctttaatgccttaaaaaactatactagtacagggtaggtcaaggaagaatatgtagtatctagtcagtattattactgcatttcaaatcctaaatttgacctttctaattgatttattcatatagtatatataactttcagtgaatgattactctttttgatatagtatttctctgttggttgaattagcatttatcattactctatctgctttaccaaaggacctgaaggatttcatcctaaattactgaataatgaaattgatgtgggtagttgtttaagtttaactactattactccttttcaaaaggacaactaataatttatcttgtctgtattgaataagttgcttcctggcatactctgttttctttcttttttgttttaacaagtgttatcctgaacgggattcgaacctatcatctctccttccctttcttcccttcatttttttttaaccattcaaccaatcttagtggtttgtcacctttgtaaataaaaaataatttgggtatggaatttaaaaatgatgttgatatttttatatgagattttggatctataattaatatcaagtcacaagggtgggttttttttcttcttttgggggggggggggggggggttggagtagtgtgggaaaatatgaatatattgtaatattatatttatatatatataataagaacaatttcttattttaaaaatgtaagaattctaaaaagttatgcttgtttatttattcatcttaattattaaaataaaatttaataatttttttcacgataatcaaaaggataaataatctatattcattattctcatttgtcttagtaatcaaatatgcctgtctgagtctctctctctctatatggtcaaaagagagaattaattttgttgaattcctagatccccaataatttatgaccatttgtcaattactcggtgttgattttttttctttctatcttctaaaggaaacaatacattctcttcaaactataaatcatacatgtatattaatcagtaggaatagatcccctctctcatgtcgtgtcatgttttaattttgtgtatatttctctcataagtatattattaaagtataaaagaaagatgggaatctttttgtgtacattgaatctcgactttaaatatattattagatcatatgctctaattataatctaatcataacaaaatttaacatgaaaatatgcattataatttttttccttgtggctaaaataaattgacatagcattacattatacgtagtgacgcagaatgctttggcaggggatagagaacacaagtattaaaggtgagatagcaacgagcgcaagcacaggaatagtgagagaagagtttgcagaacgggaggcttcaacttcgtcactgtatttcctccacccttgctattatttcaacttagccaaagaagcattcctcaaatgtcttggccttgattctacatcatctaaatctgacgctctttcaacccaaaaacattggaaacaaaagaaagttagctgatcatgaaaattatgttcttatttatttatgaaatttttctcatcattttgaactacttttttcgatcctgcttaatttctccaccaattggagttaccagaagtaagttttccctttttatgggtaatgattcttccatcgtgtgaatttgaaagagaagcaaatttttgaagtgatagttaggcaaacaaaatccatttaaatttcttacaaattaaaataattcatgataaagtttatttaataacataggccttgcccatgacttaaaattgctattcccacttgcaaatttatactgggctggatttgactgtacagggcctaaacgaataaagcctagctagcaaagagagaactattgttctcacttccaactgcgctggattttgtgttggttaattgaatgtacaggttagctggcagacgcaaaactgttattcccacttcaaattttactgcgcggggtgaactttctgattcaaatatattactaatatggattcagattttatgttacgttatcatgaatttaaatagattaaaatatgtttttttatttaaatattaaaatgtttgaaattctaaatttgttcatgcaaaattgaaataaatctgaatttgagttattgtaatttaaaatataatttttgatgataaatattgtcacaaattaaaaaaataataaaatcaaatcacaatttgtaatagttaaaaatcgtcacaaattgaagaatttttttttttgcagaaacctcctttctcccaaacccatattagttagggtctaaacatgtattaatgtttaattggttaacaaatcaacttgtttgcacaatcaccatatatataagttcatatttatagagaacaaaaagttaaacattatgattttgcgaggaacaaaatatatcttagtcattaaaatattaaaaaataattatataaaatcatatgtcatgattccatagttaaaaacgtccaactcagtttattaaaaagtgtggattgatagatgttaaaatgtcataattccataaatttatctatacaatttgaagaaaagatttgtatagggacaataataaaaaaaaataaaaaatagaacattttatattatcaataacaagccttttactgcatcatcattattatattcctcttaaaattttgtgcaatatttattttatttgttgctttcaactattgaaagtatataaaagataagttggaatattgttaggctcttgctaaccatttaggacatcgattaataaattaaaataagaaagcttttattgtctaaattatattagagcgcagaaaaatatatcaagagaacctaattttgcgtctttcattgaaaaaaattatatttttagttccttgagtaatgatttttgggcatttgttaacatttactatatttatcaagtattaattatatgtacaagcgctgattataataccgcttgttaattgagtattaataactaaaaaaattaaggttatttttaaaattgcaagaattaaagtactctatccattcctttttacaagacattgtttttaaacttctgtatattttttataagactcttttctaaattgtctattgtattaattaattttagaacaaaatacctttaattaatttatttataaataacagatattacaaattatctatttctctctcatgtgagaattggagaatgaaataattattttaaaaattaaaattccactgttattattctctttccatatattagttacttaaggataattttgaataaataatataattacagataaatttaatactaatgattaaattaattaactttttaataaacgtaaattagttaataatttcttattattagggagaaaaatatttattttgacgatgtttggacaaaggaactaaaatacttttatttctaaattataagacaaaaattattaatttgaattaaaaataattttatcctaaattttaagatattaaaaacatatttaaaacaattaattaattcgaaatccaatctaatgcggtagtaattaaaatccactatttgaagatttaactatagccacgtgcgttgttttcacgccttcaacccgcgttgttttcacgccccccaccctccctataaaagatcttttattttttcatttctgtgtagttgcgtttcaaaaaaacgtgtctctccattttgaatctggatccagcgccttctattcagcattcaccccccaaacccaaaccctatttctctttcttccctgtttggttctagcgagcacaatgaggagaggagctaagagaaagacgaagcaggaccaagaagccaaacacgacgcacccgaagataacatggccaaagctcagcctcgagctaaacgaaccaagacctccaagcctcaatccgaacctgagtacatcgaagacaagcgcaacttggttagtttaattaacacttcaccatcgccgttcaatttttttatttcaattcgaaccgttttctttaactatatgcgtcgaactagaaacgttgtctagaacggaatggaccgcagcagttttgtttattaaggagaaaatattgattcggcgtttcattttccctttcttttcgtgtctagctttagttagctatacttcgaagtggttgtattatatgtgtttaggttttttcttctttttcgtatttgcattgtgttttactaatggaggatggtgtttgtcaatttggattgtgtaggaagatttgtggaaggaaacattccccgttggaactgaggtttgttcaattaatttgtatattttaattcgtttatgactgtgccgtgtttttttatttaactgtttcgtgttgtaatcgcagtgggaccaattggattctgtctatcaatacaagtgggatttctcaaatctagaagtgagtattggattagactgcttaggttttggttggtgttctgtttttgagtggagataaaatgctttattttgactaattgctgatgatgttgtgatttgggggtgtgttttcagaatgcgtttgaagaggatggcgtgttgtatggtaaaaaggtttacctctttggttgcactgagcgtaagtggcttgcagactttatttcttgtcattttgaaggcggctgatttgcttcatagctgttttccctttattatttgccctttcattatcttatgttgatctttctgactgcagctcaactagtcatgtttaaaggggaaagtaaagttgtctgcatacctgttgtagtagctgtaagttgtcaaactgggctgtctacatgtgttggtgacgtgaacacttgatgaccaaattgattcttgcttttgagtttttcaggaaaaatatactgtttgattttgcaagtatgtgatattatgtttcctctagctgtgatttgtgtgtctctccttctggggcatggttctttggtatatagacttagattagatatttaaaatcatatccttaatgccaaggtgttatttggaaatgccagttcattgaatgtgttttgttgccagttttacatgatgaagcaaccttgtatcagtttagatgatttggatatttgtattttgattttaattttgaaaatattacaacatccttctgcagattgtatcacctttcccaccatctgataaaattgggataaactcagttcaaagagaggctgaagagataattccgatgaagcaaatgaaaatggactgggttccatacattcccttggaggacaggtattcatctcaatttgtttgttttggtggtttcttgagtatgtttatgaatcattgcttcttgaatcttgatcatctcttaacttcttcattatggttttatgtcttcaacagagatagccaagttgatagactaaaatcccaaatatttatcttgagttgtacccaaagaaggtatagtcttttattttctcccctttgcaattttgtattctacagtttctttcagatcttctgaatggattgttcttggagaaatatacatacctttatgttattggttatctagcttaaataatcttgttattgtgcttttggctgttctctagttatttttagtcaccattttcacttctcaaggcaaaatttgtaagctacaagtctttcatgttaaatttctttggtgattgcatcatattcttctcctgcatgtagcaaaaaaactgtagtttttcaagtagtgtgaagaatattcaactttctgcgtgcttgtctgtttctattctccaatagatgacttgcttaagtatttatccttggcatgttgcattcgtgttggtttttaacccaaaatgcaaaaatacgtgagtaacgccaggagtctaagccttataaaataaacgagtttgtggatccataaaaacttaaaatggatatttgggtaaaactgagtatttatttcacagtttatttcctataacttgatgaattgaccttttactgtagttttttttttaccttttatttactgtagttgttgacattttaacataaagctttttactcatgcacacttttacagtttgaccttgatgtaccttctttatgaatatgatgactcatcttacctatgttataacctgcggtacagatctgctttaaaacatctgaagttggatagattaaagaaatatgagtactgcttgccttgtaagtctactgcctttagaatattacaattgttctcatatgtgtatatcagttctatctaatataaggaagaagataatgacattttattaaataaaaaagtgagaattgtggattctggacaaagcaatttttttgatcaattattggtgcttcattttgttcaaggcatactgattcttcatcagttactgttaatgttcctaatataatagttttttaatgactgctattctttctgcagatttctatcagccgtttaaagaagatgaacttgaacagagtactgaagttcaaataatatatccagctgagccaaagccggtaattacattaatgaagatttttccaagtgaattgacagtgtttgggttttttgggatgcttttgtgtataatatggttatgtaatgacctttctgaataaatttttcttcacaagatgggcaggtgccctatttgattttctaatttgtaagtgtttacttatttacttatatatcttgtttgcaggtcttctgtgaatttgattgggaattagatgaacttgaggtaatgaattaactttgtggtgattgtagtttagaacatgtcagattaagtcagctagctgttgcaactttaaaatcattgtcatgcttttgaaatctttgataaagcttgatgttattatgcaggaaatttaagggaccatttgatgtgagaagatattttgtttttacttttaggataaaatatgttttttatccctaataaatacccgaataaatacccgaattttgtgtttgttccctaataaattttttctttgcattgagtccctaataaaacaacattttgtttttggtccgtgacacttgtttttagtccgataaattaacaaattttgtgtttgttccctattaatttttttttcatttgttattagtccctttcaaaaagattaataacaagtatttttttatcagggagtaaacacaaaatttgctaatttatcatggaataaaaaaagcatcaaggacaattttttttttttggttttattaggggatcgatgatagatgaatccaatgatagatacgaggatgttggaaaaaaagaagagaaataagataaaagaaaataaagataaaaggataagatgggggaaaggagtggggagataaatacgaaaatgactaaaaagggaccagctggaacatagagataacgtgtctaaccctccaccaagtttatagttttttctacatttcgtcctaagatacatcgtccgtcaatctatatcctactctattataagtattgtttaactacctttctctaggtaagtttcgttctacctctctttgtgtcgagctcttggtaacaaatttttgttcttacaggagcatctagtgattgtttcattatgtgtccaaaccatctcaatctatgttctttcattttttcgcttaccggtactattgctaccttttgtcgaatatcttcatttcttatcttattcatgtataaccacacatccaccttaacatcctcatttctgatccctattttatgttcatgttgtctatgtgctacccaacatttatttccatataacattgcaggtcttacagtttttttatagaatttttttttcagcttaaggagaattttgtggtcacacaacaattcagatgcacttcgccatttcatctaccttgctctgatttttgacttacatccttatcaatctctttacctttttgcaaaattgatcttaattatctaaaaaatctttcttaggtacctcgtgaccaaatagatgcatgtgatcttgatcaccatctcttactagtgaaaactcacattttattaggaagcaaaaatgaagaatttttttattagagagcaaacacaaaattctggtatttattagggatcatgaacatattttagccttacttttaattacaaaatgctatcttgttttcaaatatctgtatacaagtcattgtttcctatacaaatctttgaaaataggtaatagtcaccgtttgctatactaatctttgaaaacagaaaatataatgtgaaagaaaggtgacacttttgtaattaaaacttaaaagtcaaaataaaaaatgaaaatagaaaacatttttttctttccaaaaccaaataactcctaatgttgcttctgtttgtcattctgcacttcctattgctgactctaatgtctgaatgttgctatttatggaattctagaaaatcttgactctgcattgtgggatggggattttgagattggacaaggagagaaaaaatctttatttgccagtgttttgtttgtgtttcactgtttctccagtctccaccttgcttccctcctaatagagagagggtaaaagtaacgggcaattggaaaatcaaatgacaatggacaaaggcctcttagactgctttgttgtatattttgcaggagtttactgataagctcatagaggaggaggagttatcagaagatcaaaaggatgcatttaaggtaccaaataatagaagccatctagttattccataatttctgtgttttttaagtaataagttaggctgatagtattgctttgtttaggaatttgtcaaggaaaaggttcgtgaagcaaagaaagctaatagagaggtacttttggtgctgttggttctgcacattatgctttgatttctgcttgttttttaaatacctttttttacctcttgtaggcaagggaagctagaaaaaaagccattgaagaaatgagtgaggaaactaaagctgcgtttgagagtatgagattttataagttctaccctgttcaatctccagaggcacctgatgtatcgaatgttaaggtaggtgtttaggcattctattattactttgttttcttctttttgatcaaaggatgaattcattgggactaagatgatttcagatagttaggagcatagaatatcctccttttatttcaataaaaagaagatacaaactatggaaaatataaaaaaatcattgatgaattaaggggtacccaatccattaacttaccagtaagagaaaccccttcaaaaagatcatgtgctttacactaaagtagaagccaattgcccaatcttatttcaaggtagccactctattattattcttttttatttatgctgcacatgtcttatttgatgttattgcattaccttattttctgaaaattggttattcctttaatggaacatttaaaacttgtaatacattgagggagaatggagggcttcttagctgtgcctgcatacatgtgtgtctactggaaagcactgatagaaatagatattcaaattctccttttcaactttggattgttatagtgaaggagttgatgagagaagaggccatactttgttaaaaaaatcaactagctattccaaattagaggaatgaaatcattgaaatattaggtgctatacttctgtggaatcattagttccttttgctttttttatccctcttctcatcaacctggttttcattgaatttggtactgcttataatttgttggagggtaaagaaatggaaatgacaacatctttatggttgtaactattttcttcccagaataaatatccctactaatctgcttcaccacaaaatctgtctatttcttggcatgttgtgtaaaagaacataacctttgtgtgcatatattcaatgagttaataaaaaggaagacaattcagggtaggatggcagctgatatagaatatatcaacaatttgttgaatttctggtttattaaatgcattttccttgtacctataatttacagagtatcattatctgtgtttgcagtctccattcattaacaggtattatggaaaggctcacgaggttctgtgattggctccaagacaataatgacaatttttctgtggcttgttttgcctaacacaagaaatgttgtgtttagtatgaagttatgtagttcaggaggtaaccccctggtgccccatcaaattgtcattgccagtgtagttgtctaaagtgacatataccatgtaaaactgtaggtcagagatcctagagaagtgaactatgtgttgggaggaatttaagacatgtttctggcttccatgttgaagagaatttctgaggttctggagctgcaatttgcgtggctcttgcatgtcatggttttctcttagattattctttttcccttcaaaatgtacgacagttttgactattagctaaatgaagaaaaatcaattcattattgtttcgtttaatgtggctcagttgtgaaaatgctgtttataaatcgtagctgttatgaaaattttcttagtacaatgtgacttgaaataggttagttaatagttctaagatgccaatgaagatgctcttacttttaagggtagaatttcaatacatctatcgacatttagggcgttttgttcctgtttggcattttttaaatcaagtcttgtttaggttgctgttagatgtaatttcaatgtgttttttcctttcttactaagttaaagtacgttgtaatttgtgctatcaaattttcaatggaaatgcaaacatagcttaaattggtgaagtgttaatttttatcatgttctcccgtagctcaatttgaaaagcaagtcttgaggaatttctgttgtggatgatatatcataagtatacaactgtttcaaaatagaatttcacaagccatgcattttgaattactgtctcggcttagagatgggacagaaatcaatgctcgtttgaaggaagggtctccaaatgtgggctggttatgtctttctaaatattccaagggtgtttgatcaatgattgtttttttactcttcactaattcctttggtgaggagtatttaaaataaacaattacttaagagcagagtaaaaaaaaacatcagaatttaaaaaaacaattacttaagaatattaatgagcatttttagaacattagttaacaaatcaaaggtaaaaagtttgaataatacacctaactactcattattagattgtgttaacttacctctagtagtatacacaaaatttgtttatttatttataaaaatcaaacttaggtatgagaagatttataataaatcacatatattttacaattaattgagttatattttcttgatttttaataacatagagataatttcaattatctacaccaacacaatcttaagataataatgtcttttataatcataacactttaatgactattgaagaatttgcagagagaatctaatacaatgtcttttgtgcaaaacataaaacgattagttttaataaaagtgtctgaaagtttgactttggaaaaacttttttggatagtattgtaaatatctatattattttagtctaaaactagtttttttacaaatttattctttgccaaataatattttaaagaagcacatcattataaaactattatgatattaataagttgtttaattttaaaattgtaactaaaactaccatgattactatcgaacacatatatcaattggcatgtaattgttcaactttattagtgagaaaactttgttattcatagtaataacatgattgtttccaatagagaatatttataagttaaaaagataaaataagttaaatctcaactaatttaactaactaaaataaggtatattatttgagctgacttttatatgtaacgtaggagccatgttgaagctgaagtagtagattttgttaaatttatttttatttatttattaaagttatcttacccttttattcattttcaggttgagttaggcatataaatcacatgtaagttatgtaaaatgaaaggttatgcagattgacattttttaatcatgttgtgttaagttttggacaaaactctaccaaaagtgaaataaatttctaccaaaatatttgggcaagtaaaccttttagttcatctttcaaaacaattattgagttaacttgcaaacctattattcatcttttaaaacaattattaagtgggttttccacttgtcatactgatttgctttaaataagtcagactaagcatttaataaacctatttttcaaaaaaggattaacttgctttgtcttgttactgtaccaaacatcatctatagataaaatgtaccaaataaattttataactaattttctacactcatttgcttattaaaagagtagttattctttaatagttcatattacaaatcatataaaacctttcttttcaaacaattgttctctaaagaaagacttgatccgctgataatatagcattttctactaactactgccacatgtagttggtcagaaagaatcacccgggagaatgaaaatatttcgatctttcctttcaactagagaactaattttcgaaattatattgtattatccatatagtctatagaggattgatgcttgaacagtgacactaatcagtaatcaacaagtcttattttgattgtaattcttcaccttcctgatttgcctgttaattttttcccttaatttgttctcgtatattatatggaatggccatgttcacaatgtgagttaaataggatgatacaatggtgaaagacttgaattaatttgagattcattgatagaaatgtgactctttgttcatcagtactttataaagttgcattacttctgaattgatgaaaagggtctaagtaaaagagtaaatccaagataattaaaagctgaaatgtagacgaacaacttttcagttttcatctcttctacaataaaaattggcagcgcccaaacaacatgaagaagatgaactcatcgattatcttttttgcatcagtcttctaccgtacgatactatcttagagagatattctcgtgaacattttgacacgtacgatacgatcaagtacttgaacactaaggaagactcatgtcacaagataaatactactaaacactccaaacaccaataaatcgtgttatatatatatatatatatatatatatatatatatatatacaggggcggatccagaaaattaaggaagggtgggcactcttccaaggacaccgtaaccgtgatggaggcaggccaacgatgatgtcggagaagcaattatttaagggtggacaccatttcaaaaactcaaaagttcatttcgaaaaatgtaatatgaaactgcataagaaaaaagtgggtgtataaagaaaaaaaaattgggtgcaaaaagcaaattaggcccaaatgacattaacctagcctctttctccttccttttggtttgccgttttgctttctgctgttcaactattttcttcttctcttctcactgcacaagctcctggtcctccatcactgcctccacccctactcacacagctagaatcaagggtgggcacttgccccccttctcttcaacttggatccgcccatgtatatatatatatatatcctctccaagtgtgtgaaatattgtaccattagttatcaagtaattaaactgatccgttccctggtctagctaatcagcaacgaaagttatatcataataaaaatattatttatatatattatactatatgatatatataatatataatggggaagggacatgaacttgttggtatgcatgtcacatctaccattcaaccctataacgtaggttgggtggcatcattctattgccacttgcatcttgatcaccactgaccgcactttgagcaatgaaactctctctataaccattgatccctccaatctcagagaagctctttggagcagccacttgaggccccacagaatagaagccaccaccattgaaagtgttgaagtctgcagctttgttggttgctgccacagaatgatgcaacttgttgatttcaaccatcaccccatcaatattggtttgatgagttggagagtgttcttcttgttttgccgtagaagtcttttctccctcagtttccctgtagttgttgaggtagagcttcaagggtccaacatagttctcaaaacccagtgttgtcatggcccaaagaagatcatcaccattgattgtcttcctcttttccctctggcacttatctgaggcctcaccagtgatgaagcttatgaactcagacacacactcttgaactgtttccttggcctcctttgagattttggcattggctgggagtgcccttttcatgattcggctaacattggctatagggaggaacctatcttgttcttttgaggaggagctgtctgagatgttaccagatgttggacttcccacaggacttgttgtaatttggtttctcttccctgtcatgttaatggaatagaatagagtcactcactaattaagctaaacaattgagattctcaccttcaccctctctccctatgtgtgcaagtgtaagtgtgtacaagttatgcttagcttaggtgctgcatgcggcttttaataagggagcaaaagatggggggatataaaatggaaaagtggaaaggtgctttgatgtggaatattggaagaaagcaaagggtgattgatgaagaagatcacaaagggtggtttttatatcgactaggaagacccccttggtcatataaaaaaaaatgaaaacaagaaagtaaacaaatagtagttttatagttttattcaatgaccatgtataactttcaaatttaaatcaaatactaagataacaccttgtcagaagtgttattaattggaccagttttttttatgtattgaaaaaaatgaacaaatagatagggtcggcaatgttgattaaataaatatcattctggaatcttgtgtctaattggtcatgtgacagattattatatagattaatgaaaatttttgagggccagaagagaagagacaggaaggttcaaagtttaatatggaacttattcatgagtataatgcagtggattaagttcaaagttgtggcattggtgtttggcaaaatatttcgtatatatcccatctttaatgaggtacttgggaaaaagagaaaatgctttccagatagatcaagaactaattaactaaatatcaaagcctgtcattgtttgaaaattgcaaggtaaatgatgagagaaatgattatggaaaattgtttgctagaagacaccgcacttcacaaattggtgttggcttttaattagtttggaattcttaatcagaccccataacgtgaattattcgtactagtgcatatgttatttttgtacggctttttaaaaaagggactcgaaaagatgaagcaatgggatatatgctttcactttggcacgcttttgtgttgctttgtctcactgagattcttccatcacatacatattattgcaggacagtatcatctcaaggcatctcagccctcagtccccaattttcttattttccacctgactacttcttgaaacaatgcaattaatgtggaaataaaaaagagaaaaaatattgcatagacaaaaaaaaagaccctttagcttttgcatttcccgttaacgaatatgtcttaaactggcttggttctttgatcagttccaacctgtcaagtctcacctgcatggttctgagaaaaaaatatcagaaactcacagattaaagctatcaaacaggcttctgacacatggaagctaaatccaacaagcacgtactaaatatatatatatatatatatatatatatatatatatatatatatatatattggaccggctcttacgtattgtcttggatattaatttgttgttaagagaggtagctacaagctgcacatacaaaattcaattattggatgggtttgtttttgttatataaaagtttaggttaattgaatttttgagggtcactgggacatttaagataggcttcaagacctaagagggtacgtttatatagaagtaattatagattaattacgagcacattctttactttaataacgaaattcaaacttagtctttataaattatgagttctattcttatcaattaaaccaattattggatggatgggacatgaaaaatgattatgtgcattatactatcacaataatgtctattttagtttgacaagaagttggaaattttttaagtcaaacttagaattatattaacaacgtacgatgatacgtgatcaaacgcataaaatataatacacacataaaaagagcaaatttgtcaggatctgaactattaaatgcgaaaattcaatttaaaaatgacataaaagtaacaattacggtctctaatgaaccatgctagctaattggggtctgtgtccaattgaagttgattaacaaaaacgtttcatgcaacccttttgttcctgtttatagttacaattgcatgctagtgttttaaagctaggggcaattttcagcaatatttcatttttagattctattctagctgttcaccaatcatcgatttctggtttcttattctttggcttcaaatatctgctgttcatttttcttttggtaaacttgtatgctagctgtacttctatttcgatccttttcttcactaagaacaagtaaagttgtctagatagtgctctgcatcatccagccaataggcacttattttaattggaaaatactcatgcatgtaggtaagttaaaatgacaattccaaaatctttgcctatttttagatacaagattgagatgtttatggcattcttgttgagaacctaatatgtagtacaagtagtggtcaattgtgtacattataagcttagttttattctgttctgtaaagtttgaaaatatttgtttgcatttgttgatagctaaatacgtgaagtgagattacatcatgattgattaaatattcgtattatgtgtgtgaatagtctttggttgtgcttatgctggtagctttgaggattattgacaactgaataaaacaatttgaagatattaccccaatggatatattttagttataatatataaattatgatataccatttgcaaatctgtttgtcaacttgccggctttcagagactgctagaaagtcagataacatcacaatcagaactcagaaatatgttgaagggagaattaggggaggatgattctaaaggtaatatttatttatgagagagctcacaactgcagcaggccattcataatagtgataagattctcttcatctatatacacacactctgatgcaatagtttttatttaaaaattaaagattcgaatatggtagaatatattacgaaaaatataattattttttgtttaaaattgcttatattttatttttttatttttttaaagtagctgacatatatattggtttaccatttccatcgtcatggtattattattgttggtttttaacttcttcataaatttatgaaaaacaataatcaaatttaaataaaaatattatattcaaattaagataataactcctttatttattatgatatgaataagttatatacgcacacatatataagataatagtatactgttatgagatcaaactactccttgctttagtttcttttattttcacagtgaacgttacacctaaattatatttggtagtataggtagcacgagcctttcattctaaacgggtctcaactctcaacaaggaaattatcttgctttggtcctaatgtagtcactgtttgtacaaacgcatgctggataatgccatccagatgttaacataaacaaatccttgcagtttgagaagatttaaataggattttggagccaatatttcatcgtgttgttagaaatgaaggattttgaaatgaaaacgattagttgaaatttaggtcaatactgaacatatatgtgagctgtgacgtgagatcaatttgttagaacgggaccaattattggaattataaaatacgtcaattgtcattaattaaatcaattttgtggtctctctctctctaaagaaaaattcaattttgagatcaatcagatatgacttgacgatttttgtgtgatttgcactcaataaaaaaaatgttcttttaagaagcccaattttttattttatttttatgaataaaacgaaatcggaaaaatgttatgtgaattttaactctagacaccctcttagcaccctcatttaggggtgttcgcggtctggattggatcggttttgaagcaaaaaatcatccgatccaattctttaggtttggtcatttgatcatccattcggtttgaaatttttttcaaatccgatccaatccaatccaatttttttcggtttggattggatcggttttcggtttttttaaaagtatacaaataaaacttatggaacttatttttatcaaaataaggagtatctaacataaacaaacacattcattggacaaaaacaaatattattttttaattttcattagacaaacacgttcattggacaaaataaggagcaatgtattgaatttttgatttttgggttatgatagggaataggcccaagtagataaagggtaaggtatggtttacaattggatcggtttggattggatcggttttcaccggccaatccgaaaaccgatccaatccggtgaaaattttcggttttttttcggttttcagtttttcggttttcggttatttcggttttcggtttttcggttcagtcaccgcggtttgaatcggtttggatcggttgatgaacacccctaccctcatttaacttttatatggatgtctgtaacttaactttgtgcaaaatttgcaaaataaaaaactgtatatatgatgtattgtaaatatcatgacctagccaatcaacctacagtatcataagtaatgcattaggattgtctaaaaccacttaaaaacaagccttcaaaaccagggaataatgaatacttttccaaacatatcccattttcaagcatcaagcagaataaaagttattggataggtacaaactagtaacacaagtcacaactcacaactcactcaaccattttcacaaatacttggtagccgtatttgaaaatttatcattatcactccaatggggtcaatccatgatataactcccataaaaaaaaaaaatacatcactaacccataaaagaaaactatctgaatggtttaaaacataaaagcgacagtgaatagcttcacaggaaataagaaaattcacgtcaaaaacacatatccaaacactgtaaattatctcaattcaatccagtgttttatattcttttaaaaaatataaccttttaaaatattatattttaataataaaatttatttttctaataaatagtatttttcaaaataaaataaaatatttatttaatcatatatagatttaattttataatttagatatgtattatatatggtattaaaactcaaatattatgacaataaactaggttaattctgtattatttaattttgataaaatcaaattccagttaaaataaatgaacctgatggaatggttcattattgaaaaacaatttgaatccaattgaatggttgatataattaaattaataaatgaatattctctcttatttttaaaatttattagactgtctaattaatagttcatgaatcatgttactagtacttttacaactctgtcgtctttaaatgcaaattctatataaaatatttatagtagacaaatgagtggtcattgacgacggttgagaattttattttcataataatattaattaatattcatttaattgcctttatttatgagtatatttggcaattgaaaagtaattgtttttattgtgttttaaaaaacaatggcttatattgtttatataaataacaagttttatataagaactctcacgttaattatttcaatcataaagtcatataagaatgaaattttaaatttaagcactcaatagccaataggtgctgctatagaagagagagagagagagagaggagagaagaaaggaaggagcagagaatattttacaaaataatataatgatttaattttttaaacaaaactataaataaaatgaatatgtcttgataaaaatattaacaaaattatgatttgataagattatgtgaatccagagaggcagtagaagagcatggaatgcaagtaccacgtaagcataaagcgtccaaatatcttccacgcaagccaaagtcctttgcggctaaacgcaactcgcgaaaatccccaccaatcaaaatctcccataaccttcagggctcatctttttcttgccacgtgtcctccttatcaccacccccttcccactcctttttctttttattatttttcatttttcaacttcacttcaactcttgctctgtcttcaatcaacacaacacttcttccattctctgctcacgcgcaatgaaatctagcctttgactttcatcctcacacactcatcaatcaatggcttcctcttcttctctactcttacttgagctcaaatttcttgcgccgcaaattacccccaaacgacgccgttctctctctagattttgctctctcaactccagctacaatgtttctctccgtacgcgaatccgcgccgtcaaggaagaaggtgccgtcattgacacagtgaacgacgtgaaatggagcggaaacggagttgccgcgagcgaatacggtgctaacggctccgttaacggttacttgaacggcgtctcgggcgttagtcagagtgagaacgcgaatggaagcttggtgaagtacgtcaatgacaatggcaatggcaatggtgtagcggcggaagtggtggaagatgctgcagaagcgtcaaagcggatggaagatggaagaaagaagaggttggaggagattggtaaagaggaggcctggttcaaaaagcaaactggggaagcaccaattgaggtatgaatatgagtgtatttgtttgtacaatgttaattaggagtgaggtgatcttcaggtcagtgtgtatatagaataacatctgtgaagagaggtttgttccttaaatgaatcttagtacgtactccaaagggattagtctttggctctcgatttgaggatactctgggttcacataaaatgttgattagtgtgactgtgttattagattgaatgagtgagaagaacttgtgattttctttttgcaggtggcggttgcacctggaggtcgctggagcaggttcaagacttactcgatgatccagaggacgtttgagatttggggatttgttataacgtttatcttcaagtcttggctgaataatcgcaagttctcgtataaaggtttgttgttttgcttggcatggtgcgaatgaggtgttcatgaatctgctgaagtgacccttagaatacttattatgggacttgggaggcacttgagctccattatatgtttattttatggatttgataagcaaatgcagaatgtattcaatgtgttttctatcagtagtggatgctggaatcggtaatgctaatactcacacaattaagcatttttccctgcatgttagaattctaatattatattttaatgggcgagcatttgagtaattgcaatcatagagcatcaacaagcacttttaacatatggtagagaagtttacttttagctgtgggggaaatggaaactaagagcaatcgtttaaatagggagtatgtcagccctgtgtactttactattttctttttcaccatttggttctgctatcatggaagactgtagctttttttttggtatttttgtgtatttattcttcctgattgccacttgttacttatatgttatagtcataatttaattatttagatgtttttctttagctttagaatcctgcatggtcactatatgcctttagagtttggaactaatttgttgcttattatgcatatgaacttgaactataaaagtttataaagtatggcaggttggttatgctagccagagttgattcttgtgatgctatcaatgcccaagtgctgcatgcttgacctcaagagttaatctcattgttacgaatttgtcatatttatcaattttgcctgtttggaaatcatttcctgacaacaacaaataaacctgttaacacaaaaattgtgaagtgctttttaatttttattgaatttttaggaatttcaacaatgtgaccatttgttttttattgactcaaagatattatttacaggaggaatgacagaggaaaagaaaacctcaaggcgaaaggcccttgccaagtggctgaaggagagcattctgagattaggtcctacatttatcaaagttggtcagcaattctccacaagagtggacattcttccacaagaatatgttgaccagttgtctgaacttcaggttgaattggagttttgggttgaacttataagattatttccttgcttgttgtgcttatgttatatttcctttttttatctactttttttgtttatggcatttataatttcacttggagtttagaaagctgatgacaataattttgagatcacaacacacacacattcacaaaagaaagaggttaaattgagaagtttaaaacatattaaggtttcatttcttcaaagccttagttaccttaatttttgggttcaggatcaagttcctccatttccctcagagactgctatagctattgtcgaagaagaacttggaagtcctttagctggtgtctttgatcattttgagtatgaaccaatagctgctgcaagtcttggtaattaatgttttactttatgcatatttgtaacagtaaatgttcaatcagagaagggaacccaattcaatgtactttggctttaggtttaatatttgattagaaaaaaggaacggtgaacatctttttccccaatgcaggtcaggttcatcgtgcaagattaaggggacaggacgttgttgttaaagtgcaaaggcctggtctcaaagctctttttgacgtcgatcttaaaaacctgagggtcagtgttataagcatttcatataatgcttgcccttctagtgtggtgtgcaaatgtgatataactctttgataattctatcacttgctccttaacttatcttaattttagtaaccttccaagattgacaagtcgtttttaaaaattgatctgtgtttattttttttttccttgcatgaaggattttaataataggacttcctgcctatgaagacttacagaattgacaaaacactaattcttgggccttttttcctcctccaggttatcgctgaatatcttcaaaaaattgatcccaaatcagatggtgctaagagggactgggttgctatttatgatgagtgtgcctctgttttatatcaggtgatgattttctggaatcttgttgcacttttaggttacttgagattaacagcagaaaattatttatgtggttctccatcataaagatgtcattctgctgtagtgaattcaaatataaagattgcataggatgatcacaattcatttttagtttgtcaagaagctggctttgctctttgaaattccatatggggaaaccaatgaagtttcatttggtcatggaagatttcataacaacattttagttaagatttcttaaggttgattaggagtctcttattttaaacagaaaggagataattgaaagtggttagttttgacagaaggaataaggtggcagacaattttacctggctaggtgatggagtaaaatggcaaatagggatttttggtttataggtgtaattataaataatgcttcagtaacagcaagagtcatgtttgttgagaatttcatgtcataagtttttttctaaaaccttgaacaacattattgcatttcaagtattagagcttagccaatgtataaagggagtcttaagcaaatttgcaggtttggaggagttgatttgtggatattgttcttgtttcagtatgatgttttcatgtgttttctgcacatcctcaactttatctaatcctgttgatgtaacatgaattaacaattttcaggagattgattacaccaaggaagctgctaatgcagaactatttgcaagtaactttaaaaacttggattatgtgaaagtccctacaatcatctgggattataccacgccacaggtttagctttcagttctcatagataatatatagaagttatgcatctttcccatttttacttctgatatctttcgtatttatctgcaatttaactatttttccaatgcagattctgacaatggagtatgttcctgggattaaaataaataaaatacaagctttagatcaactgggtcttgaccgcaaaatgttagtgtcatctgaatttcttcaagcaaaactaatattggcattttacatcatacttatgtgcatatcaacaactggtgatggcatctaaaattcaaattaatataatgtctactttatcttctacaggttagggcgatatgcagttgagtcttacttggagcagattttatcacatggtttcttccatgctgaccctgtgcgttcttgttcttagaattgctgagtggtttttgagttgtctctcgtcttatgtttgtttgagttttctctgtatttcacttctaatccaaacagagcattagtgattcttttggattgtctagtaactgttaaattgtatggtgtagccaacctgttatgttcactatctctgaatttgctcttacactgcaacattcaagcatctgttacctgaggtacaagaaacaatgctgcttgtgccatatagattatcatctgtcgctttgggaagcttccctagggcttattcaaaaaagggcattagattagaagtaacttccttaccatgataaggaatagtgattgccaagcatccaaaacactatgttaggaactcattaaaatattgcctggcatgtcttttttcctttctctggggaagaaattgtgttaaatgaggaataatgaattttcaatttttcatattttatgattatccttcaagaggtttgatttgatgcttcttgtaactaatatttacactgttcgtgcagcatcctggaaatattgcagttgatgatgtcaatggtggaagattgatcttttatgattttggaatgatgggaaggtatgttctttatcttttctgtatatttagaatatgaaattacaagtcaaacattttactcttggtgtgactaatacatttgctaattgttgttatgattggtgttgcaccttacagtatcagtcaaaatatccgagaaggtttacttgaagctttttatggaatttatgagaagaatccagataaggtaaagtgtaactgttttttatggaagttttccattaggccatggaaaatctagcatgatattccattcttgattttaaattacttaccaaatgaagcttgcgtactgatgtaggtccttcaatcaatgattcaaatgggtgttcttgtcccaactggagatatgactgctgttaaacgaacagcacagttcttcctcgacaggtagtttattaaatccatttagtaggaatgcataaaaaatcataacacctacatagatttagcagtagtatttctataaatcaatatcattagcagtagcttgttaattattgattgcaataactgcagaggctgcttaaaactattcaaagaagtgttgcgaataggaaattctaagcctttttatcttggaaaaggaaaattttgttgattgattgggtttttgcttttgagtacatggctgttctaattagttatgtcaagaatatagtgatattagggttatcttaagtggtaaggatcaaactacattaactcaaagagtgaagggtctcaactttttttcctaccaaaagaaaaaggaataatgatatttatttgaaaattgttactgaaattttttgactacttgctgattgatgagattttgcaaaaaggtggagagattgatgaggatgtaaatcatagaatcagaacagggtagatgaaatggtggagtgcatctgggttgtgtgacttcaaaatttcccttaagctaaaagaaaaattttataaaacaactgtaagacctgcaatgttatatggagctgaatgttgaccagcacataggcaacatgaacataaaataggggtagcagaaatgaggatgttaaggtggatgtgtggttatacgaagatgaatgaggaaacatagattgaggtggtttgggcacggtagtgagacggcccctgaatgctcccgtaaaaacaaaagtttgttatcgagagttcgacacaaaaaaaggtagaggtagactgaaacttacctggggaaaagtagttaaacaaaacttaatagagtgagatatagattggcgaataatgtggtttaggatggaaataagaaaaactataaacttggtggagggtcagacctgttgttatctctgtattccagatgattcatttttagtcattttcctcttcatcttccccctccttctccccccccccccccccccctcttattttcatcctcattgtatatatcattggattcatctaccactaatccttattagcttggtttaaagttgatgttgttgatattatatgcttatattttcttccctctattttatggtttagagttacatgtctgtactgattagttgtgctagcaacttactgcaatctctgaccttgagctcttcaacttcaattttttatagttttgaagagcgtttggctgcacaaaggagagagagagagatggcaacagctgaacttggattcaaacaaccattaagcaaagaggaaaaagtaatgaagaagaaagaacgtctggctgctattggtaatgcacctggtctagtgtgtgtctttaagtttagattatttggattatgcatacaaggattattgttcatgaaatgagtgaagacaaaattagacaagttataaggaaggatatattgtttgggctattggctatgggttgttaacttattattttatccagtagcactcaagtaggtcaggtgaaaagctatacacagttctatatactaacgttttaaaattggttttcctgattggttaaagtgattttttcatctgtaaagtttaacatgacctgtgtaaactataagaatttttttttctgtgtgttgttttagtgcagtgcaagtttggttggatggaatggatcattcctattcccatgcttggttaagtcattggaatgggaatggacattcgtgtacaattatgggaatatgtattccattacagaagtgatagaatccatttccattttccaacatgttttaaaattgacccatctcacctggcttacccattcaagagcaaaatccttttgggccaatatgtttgttatagacaaaaaaaaaaagaaatagcttgagttgacatgggccctgctcatcctgataatttggttggctcacattgggcctgcctaagtctatttttcttgtatctacttaaatcattcatagcatatgaaacaaaaaatggaatgaagtcataattttatttattttcatagcaaaatgaaacataggaataagcattccattaccatacccatttcatcattccatcaaactaaacatgatttagttcaataacattttgcaatccataggcttatcacttatttgtagctctcatactttaaacaggtgaggatttattagccattgcagcagaccagccctttcggtttcctgctacattcacatttgttgttagggccttctcaggtgattattaagagtttaatgtgttactcttgcacattctatgcttgcgactgcaaggtaacaagtcaacattgtttttgcagtgttggatggcattggaaagggccttgatcctcgttttgatattactgagattgccaaaccgtgagtatcgtattcatactttataattttttaataccttttagacattaaaagtttaaaattatatgctttgcatatctaatatgactatttttcctggtcctttagctatgctctggagttgctaaaattccgtgaggcaggagttgaagttatcctaaaggcagtcactaacttgttcttgcatgtttgaattcagtctaagtcctatgatttcctttcttatatctttcttctaaatgtacaggacttcagaaagagatgggacagacaatctcaagcattttacaatttatttagacaggctgatagggttgaaaagcttgctgaaatcatccaaagattggtacgcattagatttttgttgatacaattttagttgttcgtttgatttgtatcttttgttctggatttctgttattctagatcacatcttcccacccttcattcttgcacaggagcaaggtgatctaaagctccgagtccgaactttggaatctgagagagcattccagcgtattgccactgtccagaagacaataggaaatgtgagtgaatctggcatctaacttagtgaaattataagtttagttgtttcttggtataaatggtttgagagattgagtccatttaatagcctgttgtcatttttagtatctatgcttgcccttctaatttaatatctagcatctattgtaagtaactgttggctattgtgtgaacacacttgcaatagcatcaactcattaaatatggaaatgaaaatggatacctactcctgttctgacaatataaaactacattgaataagcttacctgccttcaaatatttgtaactctcttttgataagtttaaaaaaattgggatatttgtgagtgccttgcatgcaggagtattttcatgtgtcgggaaagcatgaatcatgattttcaaattacataaaaaaaccctaatattcttaattttttccacgagatttttaagtgaataatggatgtacatagtaaattggctctggacagttgacagaaatatatttcattcacatacttattataaaccacttgcatgattttttagaatcaatacttcggatatatgtaggatgtgtgtatatgaccaaagataaaaaaagttggtaggatgatgcatatttatgttgcttttttaataggcaatagctgctgggagcctaataaatcttgcaacaattctgtatcttaactcaattagggtaagctgttccgatctcacttatttttcttgtgttgattttcaattcaattaattgatggtccagttgtagtggtactttttcattcccaagtttcatgcgacctttttcaggtgcctgccactatggcatacgtcttctgtgcaatatttggttttcaagtgctctttggcattgtgaagatcaaaaagctagatgaacgggaaaggttgattacagggactgcataagcaactactaggtaattttcttttctttttaaaaattttggaattggatgtcacatgttcatgttataatatgcaaaatgtgaattgtgtaatcaaaaagattattttgcaagtttttgacattgcattttttcttcattatggtgtttttgttttttccttgtgacctggtggctatgggttctagttttgcaaatatcctctcattcttacgggtaaggttgtgtacatcttgctcattcttcccaaagagaaagatggaagaggctgatgtaatgggctgtcctttttatggtctttgtttcttcttccctgctcacagtggttaaggctgcatacagttgagcctcatcagatcagacccctcaatggtcgtgaaccttgtgaattggatgcttatatataatttggtcttaacttgaaatttgatttatggcgagtttaaacatgcaacttgaaattttagatgtgagaaaatgttacttgatgacatcacccaggtaataagcatactgtattctgacggtggctaatcaacttgttcatttcaccttttggaaacagagttaactattcatgttagtttttttatagtacatatgaccataactattcattggtatttgaacaatgaaaaagaataaactggtaacgtgcttttaactgttctcattctttgatttctttctgagattttagtgtcatgactcatgataaccttgagacataatccttctaactgaagacaaattctctttgtttcccacattggttaagcatggtttaagtgaggacactataggtggaatgacccttatgctctttgttttaaggttttaagtcaagatgtggtgtctagccttctattgtgctctttcacttaaccccattaattcagatctctctcctttggggctcaccctagctgctcaaaagtagtattagagttgattttgtttggcagaggatttgcaatgagttcagtctcaatccagttgtagatggaacatttaagaaaacttaactcatggttggtatcccccctcttgagggggagcatactaatatttggatttacactttgaggggaagaatgttggaaattcaagtgagtgatgaagccctatattggttaagaatgggttaaactgacgaagacaaattccaagtgaaaagattcatgtagtgtcccactattgcaacctattgcttgatccgttaatggagatctacttaccttttggctcaacaagttgttatttaagtggttgcaggatgttagtgagtaactgacaaatgcaaattctgatggttacctcttaactcttaatttctagtcaaagtatattaatgtgggtctgcattctagtgtctgtatcattattagtagggattttgattggttggctctcttcaccttaatatgtaagatacccaggtatctcaaatgtagggaaattcaattttcaaaaaccttacttcgtggtatgataaataaaaataattgtgtgaaaacttagatttctttacatcatatgttctcatgtaatatgatgtttgcataccaaatctgagcttctggggttactcagaaatctcacataagcatgagctaaattgagatacaattctgcttagctgtaaatgggttgatatgttttgtagttcttattgaaacactgttttgggtccttgacatgctccatgtacttatatctttcgtttgattttggcccattgcagatttaggatggacatgttgctcatgttaaggtcatggttacaagtcaaccttcggggcatcaaaattattaggagctcaaagtaagagctaacatcttggaatatatcagcaggtgctaaatctttataatggcaagcatgctggaggcttctgttctcatttacttccctaaagattgagctaaggtagccaattggcgagccacatttttgtcattaacacgatcccccatgcgttttcattgcaaaattttattatcaaattacatgtattagtgttttattttttttacctcatccatattgtaaatttaataggcattggtgtagattgtagcgtttattgttgtaatcaccatatggtatggttcagcttccaatatagtttgacaacgggaagctttgcttgtaactgacgtacataaatttatacaatgaaaatgcaaatataagtattttctataaatatgttggatgtcaattgcccatgaaaatacagtttttcgtggttattgtttcttgtcctgagcatctatcttaaggttcgctgttgtgcacgagcatgatacagcttattttgacttcaagtagcctgtttaatggcttcaagcttcaaaattatctctccagccaccaaatttttactgttagctagtattggtttcgtaacgaagtcgaatgataagtgtgatccatgtaactgatcttacatagtaggataagcttttgttattgttttattattattggtttcctggtttgtattctagagtgtatatgtgtgtgtgtattggtttaggccttacctttcgtatctacatttccccattccccaatttgttaaatgtattctcacccttttatagtatgatgcaccaagaataataatgattgaagacatgtttcatggaaaggatatagaaagttccatatgatagtagatcgtagcttactggacatcttttttatgacatccacatgggcatcttccgggtagcttcataacaattaactttagactatgaaatttgcattatggactttgtttttaaatagttactatagtttaaagtttgttatgttttctattttcaaataattattgtttgaagttttacataagaatattgaaagtcattaaatatgttcaatcttagaaaaaaaatattacatttgaatagatcatcttttaactttatcatttttttatattatactctgtcaaaacaataaaggataagaattttaaaaaaattagttaatgtgttcttaattcttttttaagtaataaataattaaaaagaaaaaaaaacttctaaaggaacaattattttgaaactcacagaaatgatatagttgtgaaaacaatcccaactatcaaatttaagttctcaaaagccagtggtttgattgagagagaagaggtgggtgaacggtgtgatttacgtaacttagatctatgcgggttcatctaaaaagctcacaagcattccacgctatctttcacgcgaattggttcaaacattatacgaaatagcattgctctcaaattatggataactcactttttatcatcatataaatctcatgtgagtcatacactcgtactcataaaatttatttaataatgaactatgttgcaagcatgtctcgctatttgatgagccaacccaattgagaaaacagatttagctttataaatcaaataacactcaactgcaagaagtgtgaaacagtcaaagaaacaacttcataacaagatttcttccatcattaatgttgtgatcatggggacgagcagttatcaactaatgttataaaacagtaaacaataaataaaagttatagatcctttacaatcgccattcgccaatgtgctagctttagatttagaaaagctgtaatgaattcaacaacgttaaccatgacaagcaacgaacaaaactacaacatcatctaaggcaaggagttggtatagacatagtcttcattctcgaaaacactttgttgtgactcaccactttcttccttgcattcactgaccctttgcttttcacagccacctgtctgcatgattaaattaatctagttactccaaaaaataaaaactttgatcgttaaccctatttacagctctatttcaccattatttgttagacaatttcatattgtatttattttactcccataattagattaaatcaaccaataacaaaaatatcaagaggtagatgtagatgagaaattcaaactcacaatagtagcagaagtcccagaagccacaacttcgctgattgcttccccttgaaaaacacatatcacattgaagctaaacatcagaaatagaaacaaagcaggcatcaataatctcattgaatatttgtaatattattggacctatctagcctatcataaagctgcatagactatataatatatgtgtgatatactgatatggcaaagtagaaaggactaactatagcttagtgtcctttatataataaagaattgaggttttcgaaaattcacgcgacaacattgacgcgatattggtagttgataatatttattgatatctatgtattttcaatcaagggggtttcagcattctcctttgacctgtccccggattcctcggcaagaaagctcgatcctcaagaactaggttggatcatcttggtgttttctcacatgaaaattatatatatatatatatatatatatatatatatatatatatatatataaaaagccagccaacagagatcccatgtaatagtaaagatttgccacgttcttgaacccaaactcaccctgacaccacctacctaccctcctccgtttccaaagggtacaataaaatttgacgtatttcaaaagttcaagtctcacttgaaattaactttttaaatctttacaagttatcttgtgtttggattttggagtttgtgagaagattgaactcatttacatgagattgcgtcatggaaatccatttttgctccccttgtaacttggaagatatgcgagtttaatccttaatgttattgcaattggtatgtggtttttgttgttgttgttggccgtgatacaacaacaatcttaaggatttaaatagctgataatgctcatgtctagatttctgcttgtagtctaaacttttgtgtatgtcttcaacaaaaagtgtttaaaagttacgttagactcaaacttgtggataaggttaaaataaggaaaaacatcacaattttaattaaaaattattatttaatgatatttcactgtagatatatattattttttgaaagaaaaaaaaaaactaaaaaaaatgtgagttaacaaacaagggtggctatacataccattgttcggggaaacaagcgttcagcacacattgcaacagcaatgagaaatggtaacccattattctggtgtgactccatgcatcaaccgtttctcaaatttatggacatggaactccaacatcagacaccttgtcaatcagggccatgcccaaaacgcccttgttctcttccgccagatgaagcaaagtggcgtcacacccaacaactcaacctttcccttcgtcttaaaagcatgtgccaaactttccaaccgcaggaactcccaaatcatccatgcccacgtcctcaaatcctgctttcagtccaacattttcgtgcaaaccgccatggttgacatgtatgtcaaatgtgatcacttggaggatgcacacaacgtgtttgttgaaatgcccgtgagggacattgcttcttggaatgcaatgctgttgggattcgctcagtcttgcttccttgataggctgtcctgtcttctacgtcacatgaggctttctggaattcgtccggatacagtcactgtcttgctactcgttgatgcggttttgtgtgtgaaaagtgtgacatttttgggtgcggttcattcctttgggattcggattggtgtacatatggatgtttctgtggctaacactttgattgctgcatattccaagtgtggtgacttgtgctcggcagagactgtgtttgatgaaattgactctggtcttaggtctgttgtgtcctggaattccatgattgctgcatatgcgaatttcgaaaagcatgtcaaggctgttaattcttacaaagggatgctagatggtagcttttccccagacattagcacaatactcaatttgctttcatcgtgtgtgcaacctaaggcactatttaatggtttgctagtacattctcatggagtcaagttaggttgtgattctgatgtatgtgtggtgaatactctcatttgtatgtattcaaagtgcgaggatgttcattctgcaagatttttgtttgatggcatatctgacaagacttgtgtttcatggactgtaatgattagtgcatacgctgagaaaggatatatgagtgaggcagtggccttgtttaatgcaatggaagctgcttgtgagaaaccagatttggttactgtgcttgctttgatttcaggttgtggccagacgggggcacttgaacttggaaaatggattgacaattactctattaacaatgggttgaaagataatgttgtagtgtgtaacgcactaattgacatgtatgccaagtgtggaagttttaatgatgctaaagagcttttctactccatggctaacaaaactgtcgtctcctggacaaccatgattactgcttgtgctttgaatggagatgttaaagatgctctgaacttattttttatgatgttagaaatgggaacaaaaccaaaccacataacatttcttgctgttctccaagcttgtgcacatggaggtttactagaaagaggattggagtgcttcaacatgatgacacaaaagtatggcataagccctggtatagaccattattcttgtatggttgatcttcttggtcgtaaaggacatctcagagaagctttagaaattattaaaagtatgccttttgaacctgatgctggaatttggagtgcattgctttctgcttgcaaaattcatggtaagatggagatgggcaattatgtgtctgaacagctatttgaattggagccccaagtggcagttccatacgtggagatggctaacatatatgcatcaggtgaaatgtgggacggagttgcagctattagaagaaagatgaaatatcttcaagtgaggaaatctcccgggcaaagtattattcaagtgaatggaaaacctactatatttacagttgaggatagggatcaccctgaaaccttgtacgtatatgatatgctagatggcttgacttcccattctaaaaaagtactactagcttattcagaggagaatgttgaatgtgaatgggagtgaagatataagaaagagactgtgattggagagctgtgttggtggattattaaattgtttcagaggatatatgcataaattttggtcctttgggtccactatgagatcaatcctcaatttgattttggattttgtcacacttaagagtttcttgtccctccttcaatgatgtattctgtagggattgaacccaagtcctttcccacaaactcagtgtatgttaccaactaagtaacattcattggataaatgacttataatacttaattgtaattgatattatttcaattatatattactagtaattaatgtgtgtttagataagctatagcaaactatgatgcatgttataaaaaaaaaaaactatgatgcccgttatatgaagcaactattaattacttttacatcaagagtgacgtaaattttagaaaaatgtggattagactagtagttccaaaacatgctataattgaaatatgctcaaatataattttagttcctataatatattcattttatgcttctagtctttacaacatttttttggtccgttttggtttctataaattttattttatgattttagtccttgacattatttgttgtctttataaacgataaaagctccttttatatttgaagtcatgccctttcaaatctatgttgcttccctcaaatctctctggccagaatttctctgccttattccaagcacttgggtctctcataatagcccatgcattcactatcacccttgactttttaggtatgaacaaatctccaaccatgcaatcttccctagattggtgtggtattagtaacggtaccactggatggatcctcgtgttttcctttacaaccatgtccaaatacaccaacttgtccaagtctgattcctccaccttcctcttcatacccaccacagtttccaactccatttgaactttcttcatcacccttggattctttaggaagctctcaaagcatccactcaattgctgtagcagaagtatccattgaacccacgagcatatcctgcatgcatgtgaggaaaaataaagtataaattaagaaagatgtactagtgagaacagtgacaactagttaagcacacagctttaaaaaggaaaaaagaaaaggttgagggaagaatacaaagctgtcattacctttaccagcagtatatggctttgatattgggccgttcaatacggtattcatattcctcgctaccaacaaagcccaacatgacatccacaaagtccttaactatattgacttctacctactctgatttaatatgctcatcaataattttgtcaaagaattcatcaaagattttgcgcactgccttcatacgcttgattagcccttgaaggtcaagttttccaatgtaagaaatgtaatcacctatgttaggagttgctgctaagtgcattacctcttgcatctcagctttgaagcccttctcatccaagtcctggtccatgtacttcttccctaagaccgttctaaatgccatgtctgcactgattgttgcaaccttggcgctgagatcaacagcagctccatcattgtatgcctctcttagaagcttgatggataggtcaagttcctcttccctcactgttctgaaggggttaattttggtttgactaagcaattccagtgtgcgcatcttccgcatgttgcgcccgtaagaaccatattcagcaaatcccaagttcttatgctcccaagcaatgtactttatagcttcatggggtggtctactagcaaagacaaggtcatgggtcttgaggaacagttcagctgcttgtggggaagaaacaataatggtgggcacaaaacctaagcgtaagtacatggcaggtccatatttttgggctagtcgatatgaatgacttttgcacaagaaagtacttttacttgaattttcacatgtttagttgaattttcacatgttgcaccccaaattattaggtggcatcgtaccgtcattgtccgactaatctctacaagtttcttggcagaggcctgatgaagatttttttgttttaaatgttgattgaagtggaacggttttggtagcttatgtagggtggtggattggttcggtaacttctttgatttgaccgtccacaattaaaaatatttccgcagagaaacaaaatttccaattttttgaaaaagacaaacttattttccatattatataatgattttgaacattaatgtttataacggagtaaaaattgaaaatcgtgttgctaaaggaagtagttctcccgatatttggtatgcatcaaataaataaattttgttttaaaataatatacatctcggtaatatatatatctttcttagttatattaactatagtattctcttttttttttttttttgtttacatgatatccctttccttattaagttgcgagaaaatgttgttgaataatgttactctaatttcaaatcgtcacgcaggacaatggacaaatctcctttacgtagtttggtcccaataataagggatttgatcataacatgtgcagaaaaatatctttcttacgaatggcgagacagtttcgcacaaacaacaaaaatcaatcaatccttagtagtgcaagtagccaatgcaaacgttcggaagaaaaaccaacaacacttgaaacaaaaacaaaagtaaaaattaatccgcgcaactcattgtcggccctcaatttgaatttcaaagcttttggcattaattaaaaaaaaaaaaacttttcattgaaagatagacatataataataattcttgatgtcaatcatgataaaaaattaagaaaagggaaagggtagtttattttcctgtgcatcttattcaaatagaccccaccaaacataacgaagaaacaatgttgcaaccaggtggttctttttatcctagccactttcatcctgaaggcgataacaagttggaacttggaatggcaagtaaatgattggccctaggcattgtgagtccaaactgctctctttcatgttcaagtcatctggcaaaatgtcatttggtagtttccaatcaaaacaatgcacaatctgtgccactgttagacaaaccatagttagacccaattgcaatcctggacaaccccttctgccagacccaaatatggtatcagctccaagtcacgccctctcacatctatgctgcttccttcaaatctctctggccagaacttctttgcatcatcccaagcacttgggtctctcataattgcccatgcattccctatcacccttgactttttaggtataaacaaatctccaaccatgcaatcttccgtggactggtgtggtatgagcaacggtgccacctgatggagcctcatgctttcctttacaaccatgttcaaatacaccaacttgtccaagtctgattcctccaccttcctcttcatacccgccacagtttctaattccatttggaatttcttcatcacccttggattctttaggagctctgaaagcgtccactcaattgctgtagctgatttgcaacataaatacataaatgtgccaaagaagagtgaacatatatatatcacaagttctaaaaatcagtagaaaatggccaacgagctagtagctatatttgtatcagtcaaaatcattaattaggacttttgggtaggaataggacatttgatccttcataatgctaccttttcttctctcctatggccatataattgtaagtatgtgacttttttaatttttaaaatatacaagaggaaaaatactaaacgatgtgataatgatttctcttaacagcaatatggctttgatattgggcagttcaatgcggtattcagattctttcagtacctaaaaagcccaacatgacatccacaaaatccttcactttattgacttctcccttgtctgattgaatatgctcatcaataattttatcaaagaattcatcaaagattgtgcgcagtgccttcatacgcctgattagcccttgaaggtcaagttttccaatgtaaggaaagtaatcacctatgttaggagctgctgctaagtgcatcacctcgtgcatcacggccttgaatcccttctgatccaagtcctggtccatgtacttcttccccaaaatcattctacaagccatgtctgcactgagtgttgcaactttggcactgagatcaacagcagctccaccattggctgccccttttagattcttgatcaataggtcaagttcctcttccctgatgggtctgaaggagttaattttggtgtggcttagcaactccagtgcacatcttgcgcatgttgcgctattaagaaccatattgaccaaaagccaagttcttctgctcccaagcaatgtactttgcagcttcatggggtggtctactagcaaagacaaggtcgtgggtcttgaggaacagttcagcagcttgtgctgaagaaacaactgtggctggcacaaatcctaagcgcaagtacatgacaggtccatatttctctgggctagttgatgcagatcacgataaggatttgaccctaacatgtgaaggtttcccaaaattgggaccaggtggtagtaatctctttccgttttcttgcttcttctccatagacagaagaggtaagtaagagaaactacaaaaattgctaccatccaaatcatccaagctatttgggtgatttcaaactatattgctattataatagcgtcagtgtataccttcgctactaaaagcaattgggcttctaatgaagggatatgtaaaggccatgacaccctctgatgtattgagtttgagaaactgcttagaaagaaaacatatggtggaaaaatggagggagtaaatatcaagaaaatttatattaatggactatgaataattatacaagtgcaactgatatcaaactttaatccaaaatcttaaaatttatgtttatgaatcttgttttatttatatgatgtttaaactttttaattcttaaataacgtgaaatttctttccatagttatactcaaccatttttctctgaagtataagtctcatatcatagattttctcttgaaccaaagtcatttttcaatcatctagtaatcaaggatgattcttagaagtagggattatcccgactctttttctaagaatattcaaagtatatatatcttgggaaaaattctttaaaaatattattttttatagaaaaagaagatagaaacgtaaatgtgtacctaatctaccctgttgtcctttttcgttcaattgttaatgttttcttctcccaatttttcggatattactctatataaaatactaaaagttaatcaagtgaaagtttttgaaaaaaaataattttaaccccgcataattttaaacatcaccaataattaaatacatgaaaatagaaaaatatttaccattaaatattggataaaatctaattaatctaatgcaataacactttttatcatctatatttatttcatctctcttctctctattttcttccccagttgccctcaactctactaaatccacgagacagacgtacgtacgtgttcccacttcagcttcctttaaacttttttaatctctccaattcttcttctcattctattatttattcatactttttactttagttcttttgttttttgttcatatataagtgtgagaatggcttgaaataatccaatttggatatttcagcatgcaataaaaaagataagttttcagctgcactttaaaatctaaacacgcggaaataccaaagtatatatatcttgtgcaggcgcagagtcgtcgttctactaaggcgatggccgcggaaacatcgaggtgtctttgtctgacccgtaaatacgaattatggtactcatcactcgtcatgaatcatgtcacaatggacacaaaatacatattatataaaccctgtatcaccaagacacaaacaccactccacaattgcttccttttggcagcaaaaatatatacacacttcgcaatagcaacgatgatttggatagccatttttttggtttttcttgcttatatgtggctacggagaattagcaagaacaaggcaaagaaattaccacctggtcccagagggttgccaattttgggaagccttcacaagttgggaccaaatcctcatcgtgacctgcaccaactagcccaaaaatatggacctgtcatgtacatgcccttaggttttgtgcccaccattgttgtttcttcaccacaagctgctgaactgttcctcaagacccatgaccttgtctttgctagtagaccaccgcttgaagctgcaaaatacatctcttgggagcagagaaacttaagcttttctgaatatggctcttactggcgcaacgtgcgcaagatgtgcacgttggaattgctaagccacaccaaaattaactcctttagaagcatgagggaagaggagcttgacctgatggtcaagctcctgcgcgaggcagccaaagatggagctgttgttgatctgagtgccaaagtttcaacactcagtgcagacatgtcttgcagaatggttttggggaagaagtacatggaccgcgacttggatgagaaggggttcaaggctgtgatgcacgaggcaatgcacttagcagcaactcctaacatgggagattacattccttacattgctgcacttgaccttcaaggcctaaagaagcgcatgaaagttgttggcaaaatcttcgatgacttcttcgagaaaattattgatgaacacttgcaatcagagaaggctgaagacaagacaaaggattttgtggatgtcatgttggactttttaggtactgcagaatctgaataccgcattgaacgccccaatatcaaagccatattgctggtaaaatgaataacatcgttaagcctttttttccactctctatataactatctatctatatatattagctgctagtatatgactatatatatacgagaaaaggtggcatgatgaacatatgaagtatcaaatgttctacattaagttggcaactattagaactggctgtcaaattctcactctctttgacccatttgtttttttggcataggatatgttggctggttcaatggatacttcagctacaacaattgagtggacgctttcagagctcctaaagaatccaagggtgatgaagaaagtccaaatggagttggaaagtgtggtgggcatgaagaggaaggtggaggaatcagacttggacaagttggtgtatttggacatggttgtaaaggaaagcatgaggctccatccagtggcaccgttgctcataccacaccaatccacggaagattgcatggttggagatttgttcatacctaaaaagtcaaaggtgatagtgaatgcatgggcaattatgagagacccaagtgcttgggatgatgcagagaagttctggccagagagatttgaaggaagcagcatagatgtgagagggcgtgacttcgagctgataccatttgggtctggcagaaggggttgtccaggattgcaattgggtctaactgtggttcgtctaacagtggcacagattgtgcattgttttgattggaaattaccaaatgacatgttgccagatgaattggacatgacagatgagttcggcctcacaatgccaagggccaatcatctacatgccattcctacgtatcggctttccactgaaagggattagggaaaaataattccgtagtatgtattttgatagctacacaagcaacacaggctactccagcaaaaccaagaggaccatcagaaaaccaatccacctcagcgactacgtataaccaactgcacatgagtaaaaggacaatagtcacagagaatatatcaatattctctttgtctcgtcagagaaaatcccttataacaaacattctagaaattctgctaactggctatgattgataacaaacaactttcgtttgtaatttctctatatatatcagcagaataaataaatgaggcactaagttgttatccattatttctcttctttactgccttagttccttagtctaacatattttatgtttaattaggttgatttcaatgatatttatggaaaaataaattactctttttccttccttatcgttaggaaattagaattatgtaggtcgcatacgatagagattagtttctttcctgtaatttagagacaaatgaaccttacatgttgtagagaatttctatttattttttgtactgtaaagaaagataacaagcaaaactaaacaattgacactaaatccgtggtgcctagagcttcaagagcaaagtcagatggcacctgccactcatgcttggcagggctattctgatcgcaaccaccgagccagcaacttaacacatcagccacaaggttacaaaatgcatgtgaattatatattaactagtatttttttcttcaatatatgtttatctatatagtaatcacgttggatatcattgatcaaattatcttcaatcctcatgattcggatatcatcctatcactgccattgtttatttcggcctcggatgacgagataatacggagtttcagcaagtctggaatctatactgttcgtttcttcttatgatcaccttatggaaaaatgtttcaaagggaagaactcaaggtcactggagattggcttcttgtttggcgcatgcatatcccaccgaaagtcaggcactttatttgtagatctctttgcaattgcatgcctccctacaaggcaacgttttcaacaaaaaggtgtgcgtgtcttgctgcaacttatgttcttattgtcaaactaacattgagatcgaatgcttggcatattctttttggttgtcaagaagttgcgcaagtctgggaacgtctgggttgtggaaccacatatcctacaaagtgcaataggcagatgtttgaatgaagaaggataaaataatttgtaatatattaggagatataaagttggtaagatgattggagaaggataaatgaagaagggagctaagggaggggggagggagaatgtcacgtattccaattctcttaattgatatttctaataaaattaatatttatcaattaaaaatattataatatatttatatttgcgaaagaagggaaatgtgtatcatagtacaagaggtgaggataataatatttgcatatctcaagagatggtagtataaatgatactttagtaataattattttaaaatagataatggaaacttaaaaatagggtgaagtattagatatatccaaatttattaggggataaaaatgtatattttaacataagaaacaaatgcaaaataatactctcatatctcataaaagagaagtataatcacttgttgcgtactcggcaagtgcaccggtcgctcaagtaataaagtgaaagtacgggatttgtcgttcccaacgaggattgtttgaccaaataaactatacttgatatcaatacgttggacggtaaataaaatgaatgaataagatttggttggtgtgtttggtgtgtacaaattaaattaaacgctaagtgtaaacataaactaatatcaacaagtaaatggagggataatgatatgtaagggaatgtagttagggcaacccacacatgatgtttctttcaaaggaaatgtattgttcactacattcatttatctaaactatttagctaaagtgttttcataagttaactaagcttagatccctcgccacttagttctttaacttacactccaaccctaatcccttagcgattttcggtgagttaagcattaagcaaccacataaataagtagagctacaagcacccacccctattcctaggtgatgttagcaagttactacacttagttccaaaccaaagccccaatattcctattgtgaaccctagtttcacactctcacaaagaatggccaagtccaaggaaaagatgaaagaattaaagcaagtgcagtaaaatagcctttgataaatgaataatagcattcaatacatcccaatgaaatttacatcaaatgctagtgccctaactacaataaaagcttagccaaacctcatgttgagtggctgaaatgcaaaaagggacatacccagctgaagcaaggaagaagaagatggagatgcaactccacttgtgccttcaatctcccaaaaaccctagctaaggaacccaagctctaaaaccctaagtttgtgtttttctccctccaaaaaacgtgcattgaatgctggtggttggagtatttaaagccctcctcgtgaaatctctgttctgcccttaattgtggcttctgtcgacctgtggcgtctttggcgccaggttggcgctccaggcgccggcttccagaggctgcggcgctcgcggcgcggttaacggcgctcaaggcgcgggactccaggggcaatggcgcccagggcgcggatacggcgctccaggcgcccagctccagaacttgaggcgctctaggcgcggagcttggcgctccaggcgccagctgcacttccaagttctgctcatttctcctggtttcagcccattcttggtgtctttggtcgatttcctgacaaattcatcaagataacttaaattatacacaacgagggcaataaagaatgctttatgctcaatttttgttctaaaatgcttggaaattccttatatgctaagcgcatatcatcactcaataaaaactaagggaaacagaaacatagatgttgtcgttttatgtgttcgtatttctattaggctaaaattgatatattataatattttttcttattatatatagacatatatattaattttaatttaataatttatttcatgtctatctatgtatgtgaattgacattcgttaatttttaaataaaatgttaggtttatctattgagtcttaattaagttgaatttaaataaatgatttttatatcaaaattatacattgcatagaaataaatattgatcaaccctaactactctgtatgttttattgagaaacttcaaacgaccatttaactcaatgaccctacaaccataaattaggctcacgtgatctggaataaatgcgactgaaaacaaataagcgttagttagattttctatattttttaaagcattttctcttattaatttaaaaagatacccttccgtttctattaaacagaaaaacttgtcaacgaggtgtgcttgcagagaaaaattattaggtcctgaaccctcacttctcaataattccaatccatatctacatatattcaaattataatttacgagaaagaattataataagtagtacttgattatattggcggatgggatatgagaacaattgtcctacaagataatttttttacttaaaacatattaattaataaaaaaaatactctcagtacatatttttaagcacatacaatgaatcaatgacataaatacacactttaactcaattgtaatttatataaatatagttaatttaaaaaacaacaattcacaatattatgtattttataaaaatttatactactaatatttttttttacaaaaatattacaaattatttttagctaaataaattttctgaatctgatgcccgatattttttggctaaatgattcaagaacacctaactattagttgtctgtagcatggtggcgaccaattgcgtttatcaaataaacacgaggaaatactgtatcttgtgcaagccattgagttaggcagaatagaatagtgaccgttaaaatatcgacaacgtcatctttgtctgacccgtaaatagaaattatgcactcgtcattatataatccttcatcacaaacacaacttttgtataagcccaccagcggcttttggaaactaagctatacacttaatagctgagatgattttgatagcattttttttagtttctctttcttttctgtggttatgcagaagcaagaacccaaataaattaccacctggtcccagagggttaccaattttgggaagccttcacatgttgggagaaaatcctcatcgtgacctgcaccaactagcccaaaaatatggacctgtcatgcacttgcgcttaggttttgtgcccaccattgttgtttcttcaccccaaactgctgaattgttcctcaagacccatgaccttgtctttgctagtaggccacctcttgaggctgaaaaacacatctcttgggggcagaggaccttaagcttttctaaatatggctcttactggcgcaacgtgcgcaagatgtgcacgttggaattgctcaaccacaccaaaattaactccttcagaagcatgagggaagaggagcttgacctgatggtcaagcttctgcaagaggcagccaaagatggagctgttgttgatctgagtgccaaagtttcaacactcagtgcagacatgtcttgcagaatggttttggggaagaagtacatggaccgcgacttggatgagaaggggttcaaggctgtgatgcaagaggcaatgcacttagcagcaacacctaacatgggagattacattccttacattgctgcacttgaccttcaaggcctaaagaagcgcatgaaagttgttggcaaaatcttcgatgacttcttcgagaaaattattgatgaacacttgcaatcagagaaggctgaagacaagacaaaggattttgtggatgtcatgttggactttttaggtactgcagaatctgaataccgcattgaacgccccaatatcaaagccatattgctggtaaaatgaataacatcgttaagcctttttttccactctctatataactatctatctatatatattagctgctagtatatgactatatatatacgagaaaagttggcatgacgaacatatgaagtatcaaatgttctacattaagttggcaactattagaactggctgtcaaattctcactctctttgacccatttgtttttttggcataggatatgttggctggttcaatggatacttcagctacaacaattgagtggacgctttcagagctcctaaagaatccaagggtgatgaagaaagtccaaatggaattagaaactgtggtgggtatgaagaggaaggtggaggaatcagacttggacaagttggtgtatttggacatggttgtaaaggaaagcatgaggctccatccagtggcaccattgctcataccacaccagtccacggaagattgcatggttggagatttgttcatacctaaagagtcaagggtgatagtgaatgcatgggcaattatgagagacccgagtgcttgggatgaggcagagaagttctggccagagagatttgaaggaagcagcatagatgtgagagggcgtgacttggagctgataccatttgggtctggcagaaggggttgtccaggattgcaattgggtctaactatggttcgtctaacagtggcacagattgtgcattgttttgattggaaactaccaaatgacattttgccagatgacttggacatgaaagagcagtttggacttacaatgcctagggccaatcatttacttgccattccaacttgttatcgccttcaggatgaaagtggctaggagaaaaaaaaccacctggttgcaacattgtttctacgttatgtttggtggggtctatttgaataagatgcacaggaaaataaactaccctttcccttttcttaatttttttatcatcatcgatatcaagaattattattatatgtctatctttcaatgaaaagattgtttaattaggaaaaacaatttaatagtatgtttaattaggtagatttcaataatatttatggaaaaaagaagttaccctttctcttcctttttttatcagtaaaagtgaataaaatgcattaatagggacctttcccttccttaccttaaagaaataatagttgtgtctcgagactctcttgctttagagtatagatggaacataactcaagcgattatagtcacttgtatgatccttgtcaagtttttcaaagtgcaaaaggcaatgcttgatcttttaccatacgccttagcaaacaaagcagttcttggcttctaatctgttgctttttaactttctctccaggcgacttagtgggactttgcacggatgttgttaagatcaaatgagcagggtatgcataaaaactaagagatggctatgggagtaggcacaagaagttgaccactatatgcggcagttgaaagtagattgatgatatatgtgacaatttgtgaactaaaagtttgtcaaaaatgtttcgtcaatacgtggaagtgttttgtcaaccatataatactgcatgtaacaataacggtgcaataaattactaagagatactcttaatattacttgcagtctaattttaagaataataatgatatctatctatatatatctaacactattactactatttatttacacttctttctcaaatgtctttcttggtgtgtagtagtagcataactgcataagtatcaatacagcatttttcttttttagttttaaacatcaagaccgtctgaaaaagagactagcaactatgataaatttaagtaaatgagaaaaggagtcattgaagaagccattcaccgccaactcgccaagcaattatttagaatgtgtttgttttttagtttttaaatttaaatttgttttcagttgtttagaataagtgagagcaatctaaaatttagaaaattacttagactagctgttagttcttttgttgtataaagagattcacaactgaaaaatatcttaaatcctacaccataaaagagatttatattttgcaattatgtttaattaattttcatgtttattgtaagtgggcagactcagtagtctgtccttccgtgtgcctaaattcaatcaatctatttgccatgtctctctcacttactcaactgtgtttgagtttcagttcccatgtctagtctatcttcttctccttcatttgcaagttacggtactacttctagtacccatcctcgcgcggccccacttacccgaatttcatgcggtcccagacccaaaaggaagaaaagcaaccacaattcggaagcgcaagagctggttcgtttgctcacgagcaagataagcaacgacaaagagcctctggtgaagacgctggacaagtatgtcaagcaggtccgaactcaacattgcttttttctcttcgaagaacttggcaagcacgacaactggctccaatgccttgaggtccctcacttcccccttagcaatatcttttaaggttttaaatctttcatcgcgtttggtggacaattgcggctgatgcggtccaaattgcagtcgcggacaattaaaaaaactttatgttgtggcccaaatcacggttgccatcgttttttaaaacctttcttatcatttgtaaaattgttgtctggtgctgaaagatttatcatcattattattattattatcactattactttttaaataaaattagtacattctctcgttcattaaggttggccttttatgcatataacaatggtaatatcacaaagtattgtgatgataactgtgatatgacctagaatgagagaaaaataaacaaataaagtgtgggaaaattggcagtaatgagcaaacagaaatggatacttctcattgttttaatatatagtatatacaatgcaagaacatagtaatatgcattagttaaaataggggagcatgaatgatgatgtcaatggttaactctgcctcattgtagttgtgaattttatttggcattcaggttttcagatggatgcaaaaacaacggtggtatgttgctgataatggggtttactcaaaactcatcagttatggggaaaaaaagggaaaaccagaatggctatgtggcttttctcggagatgcgtaatactggttgtggtcctgatacttctgtctataatgctctaattacagctcaccttcattcgcgggacaaaacaaaggctttggctaaagccattggctacttccagaagatgaaaggaatggagctgtgtaagcccaacattgttacatacaacattcttttgagagcttttgctcaagctcggaacgtggagtaggtcaattctttgtttaaggatcttgatgagagcattgtttcgcccaatatttacacacttaatggtgtgatggatgcgtatggtaaaaatgggatgatccacgaaatggaagcagtgcttgctcgaatgaagagcaaccagtgtaagcctgacttgattacctttaacttgctgattgattcctatgggaagaagcaggagtttggtaagatggagcaggtatttaagagtttgttgcgctaaaggagagtgcatcactgcccacgtttaattcaatgattttgaactatgggaaggcacggcttaaggataaagcagaagatattttcaagaggatgactgacatgggttacacgccaagctttgttacgcatgagagtctgatctatatgtatggcttctttgattgtgtctccagggctgcacaattgtttgatgagctggttgagtcaaaagttcatataaaagcttcaaccctaaatgctatgcttgatgtttactgcaaaaatggtttaccacaggaagcagattcactgtttgaaagagcaaatagtataaaaatatatccagattcatcaacatttaaacttctttataaggcttacactaaagccaaccagaaggagcttcttgataaattgctgaagcatatggataaagatggtattatctctaataaaaggttcttcttggatgctttgggtgctgtctaatgctgcaactgattcaaacgtatcaaattcaaaatctgctaatgcagctactgactcaaacaaccccaagatttttcaaagttgactagtcatgtgaagaatattttggctcatcaatgacttgcgtacaaacagctcagttcttgtgagatggtatacttatcctttgccatcacttctctatcatatgacatcactttcctttttttagttttcataatgatgctatttacttgatattatataattcatctatgagatgctatttctctgttcctgtgctgaccttgaaatttcaaactcaggcatgtttttggttttcagatgataagctctgaagaattatcctttcttattaataatttatgcaagtaccttcaaattacgaattcacaactacaaaacctggggcaactttaggtattttaaaatacttggttaaattggcatctgatgctgaaaattaatattcttaggacaaaagaaacaagaatacgagagattatgtttgcttattttccttactggtctgtgtataatattgatttcgtatgatttgcttgatttgttatcttgtaaagaaatttatgagaacaacagaatgtaattttattcttcactgtatttgtttttggtttccttaagttgtctgttcacttttaagttgtatctgttcacttaaacatgttttttttttcttgctggtcgttgcaagtttgccagtttcaaatgaagttctaaacccttttagtgaactttaaccaacaaagagataggcatagaagatcaagatcctattgcctaggcatcacatgttgtctggctttgcctttcatgtccgggttcatttttgttcataggtatagatgtatttccagctcattgccccttgtcttggcactatgatctatgaaatgaagaatgcatcagatctgacagctgccaaagctaattagttgacgacaaccaatccaaaaagagcatacttgctgctgaaaagcaatgtctaaatctgtaactaacaaaattgagttattaaatggtgttattgataattcatgtacaattatcattctgatgtaattttaaatcaagattaaaagctttctttgtcatgttattgaaagtaccagaaggaattctcagttgattgtgtgagttgctggagcggagctttttaagcttatacagtaaccatagcctcccaaaccgtttgcaaaaggattttagactatatatattttttatttaaacggttggccacgaccaataaggtagaagcactagtaaagaaaggagattgcatggttttgagttttttgaaaaggaaaagagggagatcaaaacgatcattgaaggaaaattgttgagaaagatttcatagtaaacatatctgacggatctaaatgattttatgtgatttgtgtaaccaatctcatctagtataataaaacttttgatgatcgtagtggtggtggttagtttaaaacgccacaccaccctaatataactaattgaaaagcaattgatgtctcttctttatttataactattgacgattttccctttgattgtagtcaagttgaatattactttaacatatttttccgtttgcctcttgaataaaatttgtctggattcgtgtttcatgactgggttcatttttgttcacaggtatgaatttatttccagcacattgccctttgtcttcgtggtactgtggcctgtgaagaatgcatcagactgacagctgcctgaaaggtatcaggcccaagattaacaaagatgaaagataacagcagaaagaaaagaaagaagcaaagtattattgattaactttaaccaacttgaatatacttgtagattttcgatcatcaatgtcagaaccccaatccgaatcacagaaagctataagtctagagtcctgggatttgtgaaaaactaagctatgagttaatgtgcctgccaaatatcttaagatccttttgacagcctcccaatgcacttcaagaggttgatgcataaattgactgactttatttacagcaaaggagaggtcgggacgtgtgattgttgcatattgcaagccaccaacaattgaccaatataaagttggattagaaaaagttgtatctccatgaatagacagtttctgattggtaaccattagagtcggcatgggtgaggcagagtgcatattcgctttaaccaaaagatcaacaatatattttgtttgtgttaaatggagagttgtaggagaaacatatgtagcttccaaaccaagaaaatactgaagatgaccaagatctttaagagaaaactggttgttgagttgagagatgagtaaagaaatggcagaggaatcattgcctgttagaagaatatcatcaacataaacaagaaggtaaatagcagaggaagaagtaaatctggtatataaagatgcatcagattttgtattctgaaacccaaatttttgaagagtttgattgagtgtatgaaaccatgcacgaggagcttgtttgagcccataaattgctttgtttaacttgcaaacaagatgagaattggcactgtgaaaaccaggtggttgatgcatataaacatcttcttgtagaacaccactgagaaaagcattgttgaaatcaaactggcggatgggccacccattcatgagagctatggagataatgagtcgaacagtaggtggtttaacaaccgggctaaaaacttcattaaaatcgaaaccttcttgttgttgaaatcctttggcaactagacgagctttatatctgtgtatctgtccatcatgttgtcttttaattttgaaaactcacttgcagtctatagattgaatatgaggtggaggtgaaacaagagaccaggtgtgattattgaggagagcggtatattcttcaaccattgcttgtttccagtggggacaatgcagggcctgagagatattaagaggttctgagtttgttaaatcatgagtgatagacttggaggtggctgcatatgactttggtttaaaaatgccagacttgctgcgggtttgcataggatggctggaaactgtaatgactgcttctaattgaggaggagaggtagaaatagatggcaaagctggagcaatgagagaatctgaaacagacacacttgaaataccattagaagtacctgttgaatcctttaaaacagaagcaggaatttgtgcagtgactttagccttagaaatagtcgggatttgaggtaaagaaggagaaaaagatggtgaagaagtaacagaagcattgttgaataaatcaaaatagggaaagagtaactcatcaaatataacatctctagaaataatcattttaccagtggaagagaaacacttatagcctttatgattaacagcataaccaagaaaaatacatttggtggatcgaaaatctagtttatgcttattatatggtcttagtaaaggaaaacatgcacaaccaaatactttcataaagctataatctggtttattatgatgaatgatttcaaaaggagatttaaagtcaagaacaggtgtaggtaggcagtttataagataaatagcggtggtaaaggcttcttcccaataaaataaaggtaacttagcatttgcaagaagagctaatcctacttcagtaatatgccgatgttttctctcaactctaccattttgttgatgagagtaaggacatgtaagtctatgagtgatgccattaagatgcagaaaattaataaagttgtgtgaggtaaattctttggcattatcagtctgaatgtttttgatttttgaaccagttagcttttcaatagtggtcttatattggagaaatattagaaagacttgagatttattgtgcaaaaggtaaagatagttgtatctcgtaaaagcatcaacaaacaacacgtaaaatctgcagctagaggtaccagaaataggagcagggccccaaatgtcaatgaaaatcaaatcaagaggagaattataagtagtagaagaagagaaatgaggaagctgatgtatttttcccaaacaagcttcacaaacagtagaagcagaagtatttttattagcagtaaatggaagattacatttgtttaaaacaactttaacaatgtgaggaccagcatgtcccaatcttttatgccataaatcaaacgaatcaagcttagaatacaaagcaaacggagtattttgaacagaataaggtggaagcacatgaacatctttaaattggtagagaccatctttaagaaagccctggagaacaactttcttgttgacctgagatttgacaagacagaaatcagggtgaaattcaaaaaagacattattatctttggcaaactgtgaaacacttatcaaatttttagttatagatggcacatgtaaaagatcattgagcttaaaaacagtagaagaattagaatgagtgaagaaagattggccaatatggtggataggtatacctgcaccattaccaacatgcacctgatcagctccattataatcagagttggaggaaaaattaccaaggtcatttgtcaaatgatgtgttgttccagaatatgggtaccaggatgagtcaacaaaagatgcaggtcctgctagatatgctgaaggattatgaaaggaaagaggtgggggcggaggtggtggtcttggattatgcatctgagttgaagaaggttgatgtaaaggtccttggttggtgttctgatatgttgtgtcatacctataaaagcatcttgatgcaaaatgaccatttctgccgcagatttggcattgaagtttgttttgattccagaatgagccttgatttctgttgcctctagagctgcgacctcctctgcctcgtctgccaccaaaagttcggttgccattgtattctggtgtggtgtttctttgattaaagttggcttgaataggtgtaagatcagttttcttgaatcgatcaagcatgtcttcttgagctagaaggaaggcttccaattcgataatagagaaaggaggaactctggacattacagcagtgattaatggattatattcttcacttaatccatcaaagatagcttcagaatattctgcatcagtgagaggagatcctacagctcccaaagaatcaacaacctttttgatttgaagtagatattcagatgctgggcctttctttttgatggatttcaactgattcttgagttgcttcacttttgcttgcgtgtaggaagaaaaataagtctggagttttgtccagatttcatgtgcaaacttaaagcccaccattctatttttaaatgacatattcatggatgaaagaagccaagaaacaagcaaattatcttgttggtactagtgggtgtatgttgcagcatcatgcatgggagttttgtccttgttgagatgatcttgaagattatggctataaatggaggctaaagcaagctgttgccatggcagaaagcttttttcatcaagtttgtctgcaataggggtagagaaggacttcataacaagccctgttgcctgtgtgcttgcattgctggtttcgaacctcggagactctaggttggcatccatggatcgactgaagctctgataccatgaaaggtatcaggcccaagattaacaaagatgaaagataacagcagaaagaaaagaaagaagcaaagtattattgattaacttgaatatacaagagaggtagctatatatatatacaaggcagctaacaactaactgatataactaacttttaactattctactgtcactgtcaaagctaataagttggtgacaaccaatcctaaatgaacaagcttgctgctggaaagcaatgagtaaatctgtaactaacaaattgagtttttatcaatgatgttattgataatccatgtacattgataattcttgtgtaatttgaagtcattactaaaagattgatttgtcatgttttctgcacagtactaaaaacaacagagtaataataaaaagatatgacatatgcagattattcactattaaatgaaaagaaaagtcggtgcaggtgattagtgaattcatcttccaactatgttgatactatttgctgtttttcaaaatttgggtgctagaaattcatggttcagtcacaaattacctttatgctgttgttgttatcacaaatcaccaactatgcattataattaatttgtggacgtgataccacctatttaacatctaattaaatatagatatacatgattaaaaattataaatataatagattatacgatgtgataaaagaacaaacaaacaaaatatagcaaaagtgtttaaaatagaagaatacctaccttttattactattttttttttaaatcaagaagagttagatctaatggggtttatctctcaccaggcgacaaaaaaagatttgaatctatataagaggtatttacgttcgacgcccaaaataaaataactggccatggccatgggtccacaaattaaaatcttagcaaaactgcacggaaagtagaatgaagaaaatctatttttgtaccatcccacattatgggttgtggtggcccgttcgcattgttaaattttaatattactacttttttcagcttgaatgggtagctaggaattttattttcattcaaccttataagaattactcaattaccaaactagggagggaaaaaggtaaaaatgctaagaggaaagtaagtgaggagaaaatacttaaacaccatgaactgaataaaaaaaattgttttttttttcgattaaaaaggtataaattgttagtattatatagttagtgagaagattactaacaaatccctttaaaatagtcttattgtccctttaaatgtaaatttctttaaaagtaattttataaattaaaaaaatttattaattcatttatagatgttatcttatatttcaaatgagttatataagtaaattttaaaaattagttaatgaaaaatttattttatttataaaaatgttatttttttttagaaatacgattaaaattttatccaaataaatctttaataaacaattaagatataaaaaaaactcaaaatgattcaaatagcatttttgtttccgtatgtatgtaaaatgaaagtgattggtgaagggtgatagaatgcgaccactgtagcaccgaacatggggaagattgggattatgacaagttgatactataattaatcgggtgtttccttgttttgtgcgtcgcggataagatccactgattctgattcaataatgaatcaccaatgcctatgcgctgatcctgccagcaagcatagccccatttgtgtgtaagacagctagattcccatcaaacatgatctcattattcagatcataatcatcgtcttaatcttaagttctaaacagacgcgtctgtgttcagaaacacacacacacgcgtacttttgtttggatcgcatgtattctttttttataatgaacaatatgataaattatttgtgaactaaatatttcattatcattttatatgcatacatattaccatttttaattatataaaatataaattatttatataaaaaatcaaattatattcgtataacttaaataattactacatcatttaataatcttcgtaaaaattaggttgaattaacaaataattagtgtaacaaggaaataccatttttagtattcatgattctcatagaattaatgaatcatgatttttaatatgaaaaaacttttttcctatcacatacttttttaggttaacaaaatatttaagaagagtgctaataatgtaatacttctgatgcactatttttaacactccttctgttattagctgaatttttctaaaaactacaaatttaaaagagataatattaaatgataaatgaaatccacaatttttgagatttttaataaattttagtaaataaaaaaatgtattgttatcatttttgaatatttaaaccaagatcctgactgaccttaagctgaagggacataatcgtttgcttgtctattctatatagtaatgtgagaatcatcttttctataaactgaaagtatttttctgatacgagttaattcccataatgaatcttaactctgacgtttttatatatatataaaataaggcaaatatttagtttagtatttaaaattattagacgttcctttaaatataaaaaattaaaattttatcttcaaatttgtaaaaaatataataaattatcttattgttaatttctttaacttaaatagttatgccatgacatattcaataatattttatttgttacgtgtcatttatgtaattatcatgaacctgaatctaataataaattgttattataatcttaaacttaatcagttattaacattcaatctctaaacttatcagtaattaccacattatcattcaaaatcctaaagtagattatttatgtatccaaaaatatcttcttttttttttctctttccactaacatagggaagcctcaagtgtgtttattacttttttaaaaacatgaggggataatgtagcgtaatattattattttggtagtgttagaggtgtgaaaagtttgagttgggttgaattttatttatttttaaattaatataattaaaattaattggattgaattgaattgagtttattttttattttattaatttaattcaactttaactgaattgtattgagttggttattggattgagttattaaaaatttgttacttttttaaatttaaaaagaatttaaagaaatcttcaaattcaaaaataataagatttttttacaaaatagtaaagatttttttaaaattcaatattcataaaatattatactattcattgataaaaaaatcataaatatatattcataatatcattcatataaaaatgtattactttaaaataaataaaaaatataaatttaaaataatatattagtttaagataaatgttatatatatatatattcatcgtattcccagatagtgtaataaaagttatttttttattgaattctttaattttaaaacgggctaaaaaatcaggaaaattgatgttctctgttttaagaatattaaattcaatttaatggtaaaaatcattatgtgttgatcgtgataaaaaagtgacccctttgaagttttttaaccttggaatggaacacgagatctttttcctatttctaatatttgattcatcgtacgtgggggactcgtttagattcctctccacgtcagcatgcattccctccttccctcaaccgacgccaaatatttcagattttcagtttcacatatgcacatgtattctctctctctctctctctctctgagttgtatatacgcccacaatctagcgtcgcgtgtcagagcaactcgtgactcactcactccccacaacacaaacacgttaataaaataataaaatactatatatatatatatatatatatatatatatatatacccacatcgagtttgagttcatcgaaaaatcagaacagaacccaaccaaagcagctatggcggcgatgcagaggccactcaagagaaccattgcaatcgccaagcaacgcgcgtgcttttcctctctccgaccctccgccgcagccgccgccgcctccgacaccgtcgcgccgccgcagctccccccgttcgatcaccagccacacccttacaacggtccctccgccgatgaagtcttcgccaagcgcaaaacgttcctcggtccttccgtcttccacttctataagaaacctgtgagtctccgaaatcgacaccgaccaccttagcatccccgaaaccttttctgtttcctttcttctttttttttttttttttttgttttcgcgtaatgtgaatctgtaatgtctgtgaagattgatgcgtttccgatcaggcaaacattttcggatttagcaaggtgtctgttttctaaaatttgttagtctcctatacacatatttttttatccgaaaagtttgtttcttaaactcttgagagaatgaaaacatctctcacttgttttgaaaactgttccgatctcaagccagctgcattgttaggcttaccacttttgacttttgagtgattgttcgctttgactttcgtgtaggcttcatgattccaaaacaattgggatttttattattttgtttttttaccggaacagtaggataaggggctagagggtttagaaaataatctttgaaacaaaaaaatgagaagaaaatcatatagtcccttgatgtctctttttcatcattttgtttatttaagagatgtgtgattcaaattttgaatgtgttagctgaatatcgtggaagggaagatgcaatatctgtatgatgatagtgggaggcgttaccttgacgcatttgcgggaatagttactgtttcttgcggacattgccaccctgaaattctgaatgctatcacggagcagagtaaacttctgcagcatgctacaaccatatatctacaccatacaataggtgactttgctgaggcattggcagcaaaaatgcctggaaatcttaaggtctgtttttcatgttcctcgaatatttgactgtatgattgcattatgcctcccattcttgaaatgccttataatatagttttaaattgtgagccataaccgcaattgcagccgcaatgaaaagggtttttgacccaatgcaaccacaattgtggtcacattagccgcattttccttgctcttagtgttcagttttttaatgtggctagacttcttttgacaaagaaatcaggatcctaattgttgacagttaaaaacatgattctaaattgcaggttgtttattttgtaaattctggttcagaagcaaatgaattagcaatgatgatggcccgttcatatactggtaatcttggtatgatttcgttgagaaatgcatatcatggggggagttctagtacgcttggtctgactgctctgaacacgtggaaatacccaattccagaggtttgtctgtaaatttaattataattttcaattggtctgttgatcatatatggaaattattcttaacaatgatttaaaccttttagggccatgttcatcatgttatgaatccagatccatatcatggagcctttggtacagatgctgctagttatgcaaatgatgtccaagaccatattgactatggaacttcgggaaaaattgctggatttatagctgaatccattcaggtatgtgtaatatagggttactctaaactggttatcatcccgtgagcttaatattataatcttggagtcggactgcaagtagatcatggacagcatcaaagttagaaggtttcagaataatgaagttggagatttagaacatcacattgcctttttggtttactttttcttcatggcttattctagggagttggcggagcagttgaactggcaccagggtatttgaaacttgtttatgacattatacataaggctggtggtgtctgcattgcggatgaagttcaaactgggtttggccgaacaggaagccattattggggatttgagacacagggtgtcattcctgatatagttaccatggcaaaggtctgtaccatcatatcattgtttgttttactagttcccgaaaccttgataccttaatcatacatttgaaatgcaacattatttgtatcttatgttgttcatcatgtgttatattcttttagcataatctcatgtttttctttaaattttcagtttaagatattttatttttggtatgttttcgttaaagtatgtattttttctctgccatatttcattatggaaattattttgttctaactttttaaccttcatatcttctgctgctatttcatcatatctcatgttaacttgtatcagggtattggcaatggtctgccattgggagctgtagttacaactccagaaattgcaagtgtgatggcccaaaagattcattttaatacctttggtgggaaccctgtctgctctgctggtggacttgcagtgcttagggttcttgataaggagaagcgtcaagctcactgtgctgatgtcggatctcatttgcttgaacgtttgagatttctcatggaaagacatgacagtatgttgtcttgaatttaacacccccgaaatagttagggtctgattgattctcttctcgcttgcttttgttttaaaatttgtttttctaaagcaatttttcactcagcaatcaatttcttgttcaaaatttattttttttcaaaatcttttacaaaataagtgttttaaaaaccaaaaaaaaaaaacaaaaaacagaagctggaagatgttttctcatcctcatttgtttcttcaagtgcctctggagacaacttttagaaaacagaaatgtgtccaagagacaaacacttccaaatatatttgggagacaaacagattttagaaaacagaaaactgttctttaaaaacagtaaacaaacgaggccttagttttttttttatattttgtaatacacttcattgtatggtacatttacactttctatctaatgcattctttattaggcaggggcataaactttccggttgagaggtttccatattactctactatggagctgtatacacaagaatgtttctcatgtttctgctatttttgttgattattctcattttttgtataatgtgccagtcataggaaatgtcaggggaaggggcctaatggtaggcttagagttggttactgaccgaaccaacaagacacccgcaaaggctgaaactgctgttgtgtttgaaaaactcagaggttagacaagaaccattttattttatgcatctgaagccttattttccaaaataacttccaaagagtcttaacaatttatttgtatatgcattgaagaactcggtgtgctagttgggaaaggaggacttcatggcaatgttttcaggataaagccaccaatgtgtttctccaaagatgatgcaggtatagttctgtcctcgctctctcaacaaacttagatgcaaaatgtcattccatttcactgacagctctccacgtgtgcagattttcttgtggatgccttggactattctctatctaaattgtgagctgattgtgcatcttgctagcatgaaatgaaatcttcgataatgaagccaaattactacaagccaacaacaaaaagctcatttagttcacagaaatcaccgtgaataatgtaatgttctccccgttgagaagagagggggtttccctcccttttgctgaacattagaagttgaatgcaaagtattgtatataaatttgggtttcatgacatcaaaaagttgcattcaatcgaaagagtaatgtttaaatccatatacaaagagactacatttgcatattggcttgtatatcaaataacgaaatcaataacctgcacgagttgccttattcaaaattgaatcgcgtaaccagcgtcgtatctaggtaccaattatgtaaactttagtgtgttttgtgaaaagaataatgataaacgattcaaaatttaatgtaaaaattttgtactaaagttgtccaaagttattacggtcaagtttataaattattcagcattaaaaatattcctattatgaataattagattttctcatcggcaattttgattaacaaagatgaaaagtgtattttggacgaattgctgaattaggggtgacaataaataatattaaattgacaataggcacatcctttcagtaactatctaaagatttaacttgtattatagtagttttctttaattatctctatcaaagaaaagaaggattatgcagttttaaaaacacgcagctgtactattttacattttacatgaccttaatgaacacgtatttacaacttctcaatgctggaaaaatgccgagcagccggaacatgatgataagtttaagggtgtttgctagaattaatatttgatgactgactgagcatgttctggaggacgattaacccaaagtttgctcaaagcccgcaggcgttgaaaatattcccccaaagcaagcagaaatcgaccagtctgatgtatggtaagtattcgatacatttgccgcaacgtttcttgccgtagatgatcagcctgtttcacataaagtttccttcagttagcccaaaagtatactttctaaacttgttttagatggaaaagaatgttttattgtttggatcaatattgttttctgttggagttttctccataaattgatgttagaaaaaaaaacataatttactaaggacagtgaatcttgtcaagtagattttccttacttatattgagaaggtttttcaattttcatgttaaaatagtttgtctcatttcttctaccttcatacattgttactgactcttttctgtctacctaagagttaagacactttaatagtttaattgtcaatacctccacaccaaaaacgaaacttaatctgtaataaatggatccttaatctctaaagattttattaccattttaatttaacctgtcactgggttggttcttcaaaaaacaaaatatcaccatagttagttatccatataaaaacaaagatcctttttttacctatccatcctgtgaccctcatggtcgattattgccttaccccctaattgcctgcacctcttccataattgcatttaaggatatcacaggttcctcttgttattcaatttcctcaactatctcaacattttcttcttcctttacctccataaggaaaacctacattttccttctctgaatgcaagcatgtcctggcccaaatttctcatgacaaaagtaacaaagacccttgatcctgtgtttatccaactccttcggtgtcaatctttgatggaaccacatattaggttttcccaaaattcccttagggtatgtttgggagagggagttaggaggggaagggagggaaaggaaaggtttaggaagagtcattcccttgtttgcgagttttaatttttgagggaaaggatttgaggatttttaaaactcttctgaaacccttcaaaccctataaattgttgtccctcctatttggggggtttttagaaggaaaagtaactaaaattattatcttatatcaacagtgttaataaaattattatcctaccatagttaatgtaaaatataaaatatattaattttttaaataaggaaaaaattgtaaaaatttcttattaactctctatttccctctcttaatatatttttaactctcaaacaaggggaagggaacttctctcattttcctcccttttctttccctcccttccccttgaatctctttccttccctttccctcctaactcccaaacaaagccttagaatttgatggaattgatggacttgctactaatctctgtccacttcttttcacatcaacatcaccctcttttcttgatatctccatgttttcttggaatcattcataccacccttattttgtaacaggaacaaacttctttcatgcaacttggccaacctagcagcttcaagaagtgttcttgacccaaacaacttcactccaactgccatttttcaggttttagccctgccatgtagcaactcagtttctgttgttcactcgatttcaccttacaaatcagtgcatcaaattctccctgatactcgttcaagcttcctccttgcttcaattgcatcaattgctccattggatcttcaaagatggacccttatctgatacgaagtgcttctaccaacataccccatgtcacacccttcaataccatgttcccacccttggaaccaattgtagaaaacttcatctagtgctatactaaccatggtaaccttattttcctctgatgtgccatccaagagaaaaaaacctctcacattttgatagccaaccagtgacatcatcttgtgtaaatttaggaaaatcaagacgagtaaatctggttgggacacgatactcaccttcgcttcgattcgagtcttttcctcggttcttcgattttctcatttgcaacattaaccctcttgtagtctcctgaatttcattgaattgttgttccgtcgtggttctttgttgatcaatagaagcacgtaatcgctcctccacttccttgatcgctgccattgtatgagtcgcatctgctattgtcgctcccggatcaggagttctgacaccagcgacggtaccaagggataattggggaagaatagagagaagatagcatagaagaatagaggaaattgagccaacaaatctgatgcttctgttattcacaataagtgtaatatgcaactgttctaacggactctaactacccaattacaatttgaattgttccatttacccctatttatagaattatgcatatcgcgtacccatgttctcctttagattcgtctctacttgtaacacgccttgaaatgagacaatttcctctccttttcctatgtaaagcaaggagaaaaaataaacaactcatttaaggaacaaaattccttactatttcacaggcctatgctccgatttttggagtacaaaacaagaatatgttatcgtcgtagcttgtatagtggagggaagcataacataacactaagataacggtaaaacggccaacgggcaaagcaaaaccaccccccttttcagctaggtctgttttcacggcacatctaattacatagcgtttgcttgcatgttttttacacgtgttccctgacgttttccacgaccattttaaattttatgcagaggctaagaagggctactttcaattggacttggataatcgcgtcaaaaatagaaagcaaacatatgcactgatgcttgcttgtttggtttctggaaaattgattctaagtttagaattgattttagatacattttcatatgtttgtttttactttaaaaaagaatttagaattgattatgagtctagaattgatttttgttgaagtaatttcaagtaatttatgtattgaacttaaaattttgtactgaattttactcattttactcctagcttgattttataataaaaacattcaaatataaattatatcatatcaaaattaattttacaaaatcaattctcaattttatttacgctcatccaaacacacttaattaaagcgtataatttgaggatgtataagaagaaaaagaatagctgcaaatcactttagcttttcagcagttcaactgccatatacttcatctaatccaatattatatggcccaaatcatgaagttgcaccacataagatatggcactattctaacacatacaaaaattagaaataaaaaaagccaatttacccaatccaaaacacttttttgtttatctttctaattaagcgcacatactaaaaaaaaaaaaaaaaaaacagcaaggcatctttgattgagatgacatgcaatgcaacgaaaagttattaaattgataagtaaatgggtgtgaataaagtgaagcctatgcattacctggttcacaaagctcacaagagcttctagcctctccattgcagtatccatttgggaaatatgggttccttcaactagttgtcctggtcctacagagtccgcaagcatttgctgaagtttttccataccttgtgaaagggcatcttctgcttgctggcatgatttttcaaggccataggcatcaaaccgttgttgctctgtcaaaggttcacttagagggaccagaacctgcaattaaaataaaaataaaataaagttgtttctacaaccttacatgataatatagtggagatatggcaacagaaataaaatgaaatcaagattgtgcctttagcaaagcatgttactgtgaatttgcatgcatcaattaaaaacaacatttggctacagaagcagaaaagctgactgggataacatcctagtttttgaattaaaaatcaaattagctcatgtgaataaaattcacatttaattagttagatattaagcatcacctttagaagttcagaggggcgaaatccgccaatccacaagaaaaatcgttcagctgttgtcttccacataccagacatgacatagaaaacatctgcttttgctgcagcagatttcatgccaaagagtttggtgtagtggttcattataccttgtacaagtgtcccgagctgtgtgtcaccgatatgagaacttaaagcagttctcagttccaaaatttgtctattttgctcctccacccagtttccatactccatcttgaaaagggttattcctgtaaattgggtattttcagagggctaaaatagttggaaaaaggagtttaatccaagaaaaacatacttaaaagaaatccgagaaaaaaatattatatcaaccaaaatgtagtatctgattctgatgtctactatacaaatcaagagttgcagtttgttacagaaagttgtacatagaactgatataaaacactcattttcaagatgcgtaatggtgcttatattatagtatcaacatattgacaattcaagagtatgggcctgtacaacatccgaacaatgtaaatatacaaaggtagaacaaatacaacacaaattttaaggattttcatctatgagactagataatctagtttggcagcaaatttcaactcaaatagttaaataaatataacggtgcctctaggcactaaagttttctaaccagtaagttgtgagggcagtttgtaagggcaatgatttaggaataggtaaaaatactgtcttctccaaaaaaaagttaattttagaaatgagagcactaaatgaccgagatatgtaataaccagtaaccacatttaacagaaaaatcaggagtagtgacaaatcaatatctagcactagcagtttaatgaccacaaacctgaatttaaagagccagcaaaatccaaattattagaacccaatccgttgccaatgtacaatccctgcagttatgttgcctcaagagattgacaagagaatgggaaaaaaagtagaaattaaaaatataaagtgatccatagcagaaactacgagtaaacacctgttgttttgcatgatctacctcttgctctaactgcacgagcttcaaacgacatgattctaactgctgcacgtatgcctgtgaagaaacatcagaaatcacatgaatattagtatatgtatacacttgttgcatgttctgtgtatctttcaaagcataaaccttcaaacctttttcctcaaacgactcttgcgagcagcctctctattttgtgctagacgtcgttgtgtctgcatgtttcaacatgttaaattccttctctttttttttctccgtataaggataaaagaagaagcatgaaacgagcccaacttctaaaatcggaagcagaagacccctaatttttcagtgcatatatctgaaagagttcaaaatgtgggtctaaaatactttctgatgtcactcaaaatttctacataaagctaaaaatggaggcagaagaaaagtgtaaatggtgtgcccttccatgctggaatatcaccaagattaagtccttactccttaagttcaaaatggtttaattgtctaaattaacttatcacattacaaaacaccctacataatgaggttagcgaggtgagagtataactatgacatttagtatataaatttcatgataaaagaaacttgttctgaagttaagcatagaagtatttgctttcagagacaatttaaaccgaatctttcacatgcagaaagtacttaaaaggtttccagtgttgaaactattccgaattagtaaaatatttcaaagaataactaacccctttatgctgtatctgaaaaagggtattacataacatggttttaccttatcagtaagtctgttagcatcttggtcgtacttcacagatgtgccaaatattccatgagtagcatcctctgactaggtgtttaacagcaaaaaagaactttattagtaggcaaaataggcattatcatttgcaaaagacaaggtataaatttggtaaacttacttgcacctgaaactgattatctaacttcatgtccacctccccaattatggatgtggatacagttaaattattaatatcattacttttgaaattttcttcccacgtgctaatatggtggataggatcatatacacccattcttcttgaggaaacaaacggtgaggatgtaccatccatgctctatggacttatcagtgcggctatttggtgcatacacatagacagaaagcttctgttaagaattaataaaaccttttaaaactgcatcaatcataaaatgcattaaagaagagctcacttagatactaataatgaaataatcagaaagcaaataacaattaaaatggcagatatttaaagattgactctagcgcaccataagaaaaatgccgtaaggcagaaatcctccgctgctaccatgttataagaaagaatccaacaaaagaaaccttatggtagcactgtttcatacactaattcatattgcatgcaccattaacaagtgacgttgatcacaaggaatcataccggggcaaagcaaaaaaggtcaatttgattggtaagaccggaagaataaagaaatctccaagcctcccttgtgatataaccaatctagaagctggagtaaatgaaagaagggggtggatgcattttaagaaatgctgattaaagaattcaatccccactgaatatcccataaatgtggacaattgtgtttggtagggactgaaccagagaacgaaaaagtttatggcgtcaaatattgtagacatgttagagttgaataagctctacaacttacagcgaatttgtaaattcattgagaaggaatcacgtttgggatgtgaaagttgctgtaattattagctttttaaaattagtttgaaacgtgaaaccaaacatgctattaattcgatctcttgcttaggtgacaaaaagatataaaagggtagccgagaatgatcaactttttgtacaggtggtgaaggacacaggagaccaatttctaaattttattgccaaaccaaggataaaggtacggtaaacaaatacaaactttgggcttgaagtaaatactacagattatgcacaagtacaaaaagcagcacaaagtacgcatcaattcttttaactgatccacgtttttagtttcttaattccttcaaagatagataacaattaaaacgcacgggatagatagatagattctcggatacttactagtccttattcaaaaaaaggcaacaaccaaaatcatcatttttggtacgtacgtgaaagcaaagccaaaacccgtatgcacactttttcaaagacaaaaacaaaaaatgattatagacgcaggagaagaaagtaccggtgaaggtgatcatagaaagcgcacaacacaagcaaatagttcaaaaaaacaaaaaaaataaacataaaagagctgtcatgtatttagtatctggctctcgtatctggtccttcctcgttttcctcggcagttaaatctttaaaattagaagaaaaggaaagggaattcttctttttttttttaaattttaataataaaaatatggcgaacctttgaaagctactttgagaaatcgtgagaagctttttttcacgcaaaaatcattccaccttccattggcgactcaccaccaaaaaaacagaacccaattcccaacgcaaactattatccaattgccaaccctaccctaatatcccatcacattcatggcaaggcgaaagcatagaattataattaatacgtagaaaataggtgccactttttttaaaaaaaaaaaatgaataaaggccactatttttttaattggactttatgttattttaatatgaaaaaaaaggaatgttatggagacgtggtgtattgaaaattagagagggttgtattttggtgcgttgtgtgatttgtgttgtgctacagagagtcaaggatttcacacaggcacaaacgaataggcaagcaataacatcatcgtagtcatggtggtcacatttccactaccattaatgtgcgcaccaggtagatcctgcagattggtggggctccctcgttgacatcattttacgattacgccaacagtatttctcaataaacactcaaccagaagttttttcacatgtctggaattatgattcggaaactatgaattctaggaattatatttttttactaatcaataaaatttgtttgcggtaattagaatcctaagataatttttttggaaatcaaagaattatataatatttttatcatattaaataattaatttaataaataataaaataatatttttattataataaaagaaaaattactcgaaaaaaaaaataagattttcagtttttatgaaaaaatttccgtaaaaattgactagaaaaacatttccaagaaacattcctgaatgttatttttaaaaaaacaattgatacaaaaaataaaaaattcagatttttaacctataatttccaaaaaatcaatttttttccctttcagacgccccctaaagtgtctcatagatatatagtaaatagataggtatatacaaagagagagggagagtatttttatttaaacattatttacattaattaataatatatcaaaacatctcttatgcataatgtattttacgaaaattatttatgattgaatatataataaactttttaacaatgttcttctcaaaaatatatactattttaaagaaaaatcaatataacaagtattattttaatgcattaaaaatgattcacatgcttaacggtactaataaagtcatttgattgcaaaagcaatcgtttatagtttttaacatagcaataactttacctcaaaaaaacatagcaataactaattataaaaagaaaatttgtccttcatgagaaacaaatgagtccattttttatcttaattacaagaaatatagggcccacttttaaatgaattactaattttattttatactcctaatttactgtcaactctattaataagatgttcattcattttttttaagtgaatattttaatagaaaccatctattttgatttaacggtaatgatttcacctctcacaataagatgctcttcttacttgatatatgtcccctgtatgtgtgtgatagactttttgaatcagagtaaaataagtaaatttgggttataaaatcacacatttatgatcaataagtctaggtttaatttgttcgatattacaacctttaggtttgattgaaggagcttcaataaaaacaattaagcttaatctaattttgataaatcaagcttgaatattcgtgatgttcttgtattgaatttattttttatgtaaatgattggaatgaagataaaacttaagtctttatgcatttacttcagcctccatcaatagggtgaccttagaacttgtttaggtgtagatttctctaaaaaatattttttaagaaaaaagtaaaataattttttcataaattaaaattagttctcaaaagttaatttgtaaaagttttttggtataacttttttgaaagattagaagacatctataaattagttaatggagagttaattttaatttacagagaaatttattttatttttttcttattttcttcacttaaaagtgtttttatagaaacttatctaataaaactctaaagtgagtttagattaaatttgcttacttaaaaagacaaaaaaaaagggggattcaaatttccttgatcatcaattaattaaatattcattaaaatcaattaggtaattacaattaatctgtttcggaaaaaaataggtatcaattagttttagtttatacatttaatttcatgtgtttaccaaatattgtagtgtttatatattttaaactatcatccctccttaaagtacagttcttctcgattacttgcaagtgatactcgttaatttatttttcgccctaattaagtcctcgtagttaggtaagtcttctctaattaagtcctaatagttaggtaagttttctttttcaaagcaatacttaggtaaattattaattggtcggtttgatttgatttttagataaaaattatttgaatcaaatataaaataaagatatgattaggttcaattttttataacaagattcaaaaattgaatcaaaaccacaaaaataatgtaatttttaaatttttgaattttgtgattttttatttaagcaatttttaaaattattttgatgatctataaacgtttaattcaattttgaacactttaatcaagaggattggaatgtttattatatagttaatgaagtgttaaacgattgttatgaaatcaatattcttagcaacccaatttgctaccgttatggattgagatatgtcatgacataaccagcaatcgaacctcatcccaggagcctgagatcatacataactcccatgccaagctttaatatattccaatcgagtgttattacttattggagcccaaagattcgctctaggcaaaattcgataagatgacgttaaaggaattaattactcgcatccttactccacagaaactcaagtccactccaactctatccaggtatgattggggattaaaaatccaaagaatttaggaattaaaaattactgactccacaactgtaaatgatttagtgtaatagcgataattaatgatgttcagaagaatcactctcgcattctgctcaaggtaattaagctgctggaaattttttttgttttttttatagataaagctgccttatattatttcactattcatatgggcaacaatacaattgggcaaaacatcaaacaaatagggactagcatgagccaagctatggccaacattatttgctctgtctcttaacaaagcaaacatcaacgtttgtgaaattcagaagaagtctatcatatttgataataatgttaccaaattccgaattatcctgactttgacagcgtatacagtttatcattacctctgtccatctccactgtacttttatgattctttatgattcaacaataacacctttaatttaatctttaatttaagataattaaaatcgatgatagataaatttaaagataaaaaaaaaattaaattaattttttcttttaatttattattcagattttattttattttattttattttattttaatttgattttctaaatctttaaaattgattcaatttggtattttagttttttttttaattctctaatttttaaaattgattcatttttaaaaaaatgtatattttgtgacagttaaaaatcacttaccatggttttaaaccaccacaaagtgtaacttttataatttagactaaaaaatcaaattgtatcgatttaaaaaaattagaaaattaaataaaaaataaataactaagaaactacttttatttctcagatgttctaaggcgaagagaagagtcaatgcctccccctctctgactgtgggtaagctggaaaagtactattagatctatgtatatttctcaaactaaatgtaacatttgtcagtagtttcatgtgataatataatgattgagaagaagaaaaaaaaataaatccgttaaattgtgtatgaatttacatatatttttattaaatatattatccaaacctatcatcaatgcatttacaataaaaataacttttaatattttttaaaagtaaattttaatgtttaaatataagtaacttaagtgaaatgaaaaataatacttgttcacattatattttttatacttaacaaagttaacattgccaatttttacattttttaagttatctcttttccttttgttttacacgttaacaatgtttcttttttctacacattctattttatatatatatatatatatatacacacacaaaaatgtgatagttgaaatggtagtttaagatgattaagagagaaattttttggctaattgcaaaaatagtttgtgaaatgcatttttagaagaaaataaaataaaatataaatatttaattgaaaaattggagaaaatatttcactcttcaaattatgtattctaattaatattataagagtatattatttataaaatttaagaagtttaaactacaatattattcaaaattattaagaaaatgtatatctggctaagaataatttgaatatatttttttaaaatatttttgctatggactaacacctagataaggccagactctctgatagatcgaagtcgggtgaacatgtaatagacccaataagatagttgaatcatccactattacacttgttaaacacagtaatagaactacattaaaaaaaacacacacagtaatagaactataaaaataaaatattgaatgacaacccttagaagtcaaggaaatagttggaactgcataccattcctgtattggcaagaatgacatcacaatgcacgataatgaacacagtatatagaggtgtataatatcactagaaatacatgtcattatccaatttgttcacctcttttctcacactcttgttaacttgagtgtcacagccattgcaagtgattaattactccaaattctaaaggaacaacaagagatattcctatcacctagctagactaactgtactatattccctattatatggactggtgcaaaacatattttaaagtcaatataaatattatttttaagaacaagaaaaaagtaaaaggcattaattaattctaaaacatactttaattaacttgatatataaaattacaatgttttgatttatttatgttttctttcggattacatttgtgaggacccagctgatttcgtcactaactgctcatgtctaattaattgaataaacatattgcaccaaaaggacaataaataatcatcaatggataaaattgctgatatggaacggattacgtgctttaaaatttccaataagaaataatttcataagtcaggataagtttaaattattgtatagaatattagctgaatgagtgactcttatatataactaaaaaaggtacaataatgttggtggttgcattttagaatggttggtcgacctattagtgattttccttttcatattctcggggtgcattggcttgatttgattactatcaaacacacaagtataacgtcacgcaaacacttgctggctttttcctattcgtggttttcatactcaagtgcaatccaaagtgggttgccactaagaatggcttttgggtctctcagttatgaaatattttttagattttagattctctaccacagtgatacatgtttttggcaaaacggaaacgtcaaacatggtaagggactaagggggcagaaaatttaaatgaaaaaatacgaattaatgaggatactagtcttgaatctagatactacctctctatttgattgagaaaggaaatttattgaaattttgaatgaaaaagaataaatttttatttttatttttaacgaatatttttttctttattcttgttcaaataaaaataatataacatttctatataaaaaaagaatactattgtttttttttctttgccgttcaaatatacacatgcctagtcgtaaaatattaactaaaattcttttgttatttctttaattcagtagctgcttctgtaacgtcttattctggcgtcattcgaactccttcttagcctactgtcactaatgatcggtcacgtcagcaacgtttttctttttcttaattatttaatttgattttcaaattatgttaaataatttaatttagtccttcaattttaaaaaatgaattaatttgctctcaaaaatattttaaataatttcatttaatagttcttaaaattttgagaatcaaattgattcatttttttaaatttgagaattaaattaatttatttttaagaatttaatgattaaattaaatcttttaaaaattatgagactaaattaaatctttttaagaacttgataactaaattaaatcatttaaaataatttgaggcccaaattaataattaagctttttttcttttttgtgtaacttcatttttcttataaataagtagatagtccataattagactctaaacatctttatctcaagttatctcctttcaaaagtagtttctattttattatattacaatcaagtattgagtgactagctattttcagaagtattttctattttaatattatattacaatcaagtattaagtgattagctatgttatatattttctctatataatcaaaaacttaaaatgacataatttgtgtaaaacacaaagaaagataagaacttctcaaataataagccacaaatataagtcacaaagtaagaacttctcaaataataagccacaaatataagtcacaaagtagtagaacaaccatttaaaagaaaattacacaaatatctcatgagatttttagaaattacacaagtgtttcgtttttaaacttacaaaaaaatccacctaaatgttcaccattttatacaccatttaatctgttgatatgaaagagtcatgtgcaacacatgacttttaatgattttttttccctctaaaatacaccttccttcaacctttttaccattggatttatgattaaaaaaagggagaaaatgaaagactctagctcgtgggcaatatagaagtctccattgttagagtaaaactcgtggaaactcttctacccaacttttttttttacgttgctaggttgtagaatacatgagtagaaattgcattgaaattaaacccaaaatatattgtggaatacattagtttagttatgcaatatggtcttgagttgctggttggagaaggatccctcccttcacacctctctcaaaacttactccaaaatggaacaaagactattaattgttaagggaaaaaggggaagaaatagattctaaaaacatgaaaatcaattctcttttcaaaactgaaaaaaaaattagcacaattaactgattcatttacacggatctcacaagtttcaaagatacatttgatatgtggtgattgatattatgattttgctaggacaaatatgtacaaaaatcgtgtttgatggtacaatttaagagacgtttgtttcatatatatttcttacattttcaagaatattattttcataaatataacaaagaatattattcttagatatttttaaaaaatatatgttttgttacattttaatattactgaaaatatttttttaaatttaaagtaatttaaataaaaaaaataaaattatatgtttatcaaataataaatttttacatttccatgaaaatatttttttcgcacccctcttaatgaaaatataaatgtaataaacaaacgctccctttgtaataattttagtacaatatcaatttgtaggatgactgggcgtgacaaaaggcttcggagggtgctaatgttcatgctgagttagtatgtggactggagggggtttagggttagggttataacaccaccaaacaaactctatacaaggagggttataacacaacaccaaacaaattctatacaatttttttagtgagatctgagaggtttgaggggaaaaaaagggaggaaaggtaagataagagatggagatatttatgtaaattcaaaagcgaaaatatatgaaaataaagtatattcaatactaatggaaggtttgttttaacaattgcctttaactaatagattagtctagtataaactattaggacattaaatcctaccaatacagatgaggttcataaatccttcttttttgtgtgtgttcttggtaaggatgcataacgtttgaattttaaaaattagccaggtccatttcataaaagcccatcggaacttttaaggtcaaatagctgaaaacaacatctcaacttcgactattgcttcctggacttttcagttgctttcagcactccttttttgtctttcagaatgatcaattcaaaatgtataattatattttgtaatgcacttccttttttacttttggaatgaccaatctcgaaggtaaaaaaaaaaaaaaaaacatcccagaaagagtgcagaaaataacttgagaagtgcaagaagcaacaatcctcccaaaaatggtgtggtaaatactacaatgtaactctatattcacaacaataatttgtagttctcgttaaaaaaaacaaacaaactagtttctagttgccttcatttcacataaatcaagtgacatattcaattttcgaaattttcacaaagggacacaaaaaaaaaaaaaaaactgttctatttctctcgctatctttcaattagtgatcatttttaacatgtaaccaaataatgcaaacataagtttaaatttaatatgcttttagtgtagaatactagaatgtgttaaaactatgggcaaccaattggtgatgcggtaaatgataagcaagacacatttttagtataaaaaagcctaccgttgttgttaccataaaaaaacagaagtaaagaagatagaaggaacaaaaatagttgaaaaataatgtactacattttattacttttttttaactacattatctgatgctaaattggcacgcaaatggttacaaaataacagcatttcactaataaaaacttatgttttcttccttttctcgttatatctctgaacgcttggtataaacaattaagcatcattttgctcttgcaatttgaatttagtttataaaatttaatttgcaaactaaaacaaaaagatgtatataatttatatgaacattttctgaatattttacgtttataatttaaatcattagttataatcaataagtcttcattcaaatggtattgaacttaatctttttaagtaatgtctcaatgtagttgaaagaaaaaattaatattttgtatcaataacatgttgaaaaaaatatttgttataaatatcataaatagtcatacatacacagcatagatgattgaataaataattatttgaccacttttaattatctttgacaataacaagtgatattaaaaataaaacgtgatttatttattatcatacatgatctaacctcgtaataaagtaagttttcttggtgcatcgtttattaacataatcaagattagtttgatgagtaaataatatatgcataaaatatttttatattattattttatcacaaattattatgtctgttaaatttattgacttatatattaataatttaaaaagttacatttaacaaaaattcgtattaattaatcgagtgtacgtaaataaaactcttaattaattatctattttgtggtcactcatgccaacatcctatatttctttggtctaggaatcgtttttcttttcaccacaatgtggattttacatgcactcaaataggacaaccattattattattttctgcaagactgcaaggtatcattcttcactaatgggaacactttttttagcagagttttaaatcttcgttcaccatattacaagtaactaacattttctactatacgctactctgtcaattgcactttcattatttgaaatcaaataattaatattctatgtgacaaggttgattagtttgatgagtaattaattattttatcctgaaaaaacataataattttattttatttttatatacacataaaaaacactttcaaaattaaaacataaaagaatggaatttgttatctaacttatgatagatgggattaaaaaaaaattgacaatttttatttaatttgtacttaatgtgagttaacttagtaagaatcatgcaaacatgtttcaaacatcaaatatagtcggctctataatatgaaactaaaagtttttttctataacacaaattttatgtatatttttctttgtatttaacaactatcgaaaataaaatttcagtttttttctatcaagtgcttatagacttatcataacacaaatattattaaaaaaattaaactacaaaagaaacaaaacttgtgaaacatagattggtcacctgtcgcatgaagcacctaaccaataataaatgtgggtatgaatcagattatttattcaattttatggaggactatgaaaaaaatgattaaacatacataaaagtaacaaagaaaatactattcacattctttatgcaaactttaggtactataacatttaagtaatgtttttgttctatgtaattttaacaacattctttcacttaactttacaatgcaattctttagaatgtgttatttaataattgtcacaatcctgtaactttatttattagcaaaaaacaaatgaaagttatcgttttaggatttttatagtggctcacaattaggcaattgttgttgattaccataacataaacattataaaaactacaatcatgtgaaacatagattatttgtcttgtgatgcaactcaccaataaaaaatttgaatatgaatagaaaatttatccatctatttatgcatgactataaaatatgattgaagctgctaaacaaaagtaacaaatactagattattcacgttctatctcctaactctggtattaaaacattttaacaatgctttttctctatatagttttgacaacatcctctcatttagtatgacattataactccttggaagattatttaaaaatgcatcactttatttataagcaaaaattaaatcaaaattataatttctaaaactatttatgggttcgcaattggctacttgggagctactcatgctgcacaatttttggaatttggtcacctaatgtgtcataataatatatggaagtctttatagaaaaattatttattttgcttaaaattaagttttatgtatattttccttttcatttaacaactatcaataataaaattccttttgctatcaaatgtttatgaacttaccatgaaacaaacattataaagaatcaaactacaaacttgtgaaacataaattacttgtcgtgtgatgtaactcaccaataataaaattgaatgtgaatcaaattatttagttttatattttatgaaggattatgaaaaagtattaaagttaaataaaagtaacaaaaaatagtttattcacacttgctaaaaatctgagtactaaaatattttaataatatttcaattctatgtagttttgataacattctcacatttaacatcacaatatagttataagattaattaaatcaaaattataatttcagactttctattagtaactcacaattgaccaattacttaccgcttatatcacataaagttttaaatttgaccaatattttggttacagattgaaaggtagaaggcgtcactttcaatcatggaagataagctaaagaaacatgtcacaagggtaatagacagtttagtccgaacgagttcaacttaaaacttagaaaatattttcacaataagtgtttttctaaaaaattaagtcttgtttatttcattgcaatttcgtgtatatataagcaactaacttttaattattctaaatacattattaactgcaattataaatactttaattcctaatagtacaaatgaacaaatatcaagactatcaatcactaaactaaaaaaaaaagtaaaaaataaaagaaatacaactttatttcacatctattaagattatactaataattaatattctatgtgatacgattgattagtttgatgagtaattaattattttatcttgaaaaatataataattttttatttattttataaacacatataaaaaaacactttcaaagttaaaacataaaagaataaaatttgttatatattttatgatataaaagaaaaatattattgaacaataaaatcaccgcgaatatttttataaaaacgccgagacacttcgtccatacacaacgttaagtattcccttatccataaattaatactaaaaaatcttcgtgcgtactgcgtgagtcccgttttaatttaacaataatatttcaacaacctctcctactgtctttggttagtcaatccaagttaagccagggtggtgtagtgtaagtaaccatggttggagaagataatcacaggaacagtcatagttacacgcgtgagacatttcacacgtgtgccgaatcctttttttttttttttttaagcaagaagcggcattaatgcttgaagatttaaaacttgactttctggtgaagaccgggtaattaatgaaagtcattctatcggacgggaaaaatgaagtattttaaaattaactaaacccacacttgtccttacctgcttcattgggcagcccgtaacgcagcatttcctgtgttgtgacgctgcccgaactgcccgattcttggctgagaaattacgagcattcggtctccagtacctgtgtgtttttccttctctctctctttctcactgacctctgatatttctatattttggtgctctgtttctttacgatcaggatccaacggtccaaaatgttcggggcttgtgctgcttgttttcccaggttttagagctccaaaccttcagatccaactcattcgtctccagatcttccttcctggtaagctctcaagccttcttcttcttcaattatcgctaattccacgttttctctttctgccgtgctttcttaacgatactttcacctttgtcttctcttctttcactatctaacgttgtaattgctgcttctcgaaagtttttagctgaaactcttcctctcaccacgagctcgctctctagttcgcgtttcacgttaaaagttaaaaccaaattattctactttctcttacgctttccgaatttgcttcgattttatgtgaattatgcttcccctcgtactccacctcgtttattttttcatgttttttttaaggattaattttttaattttttttaacaaaattgtttcatcattagtgactagtgtcatagtttttggtactttgggaaacaagatcagctactgtcatgattttgcagaagatctaaatatggtgatatcatttagttttatttttgtaataataattatttatttattatttacaggataacgttttcgggttcgagaaggcacttgtttgtttgtcgtacgaaatggagactaaacagagttcggtgatggttacgctcagttacggcgcgttgacgtgcgccgcggaagttctcgcgactttgctagcttctgctgtcgtcaaagccacgcttttggccccggtgagtcactctctctgccttcgtccctccgaaacctaatttctttgaagtctaaaaagaaaagtctaaaaagctagagtaaggtctaaaacttttacaagatctaacgttatctatatatcttttgaaagcaatttgtgttatcgctcgagttcatgtttttatggtctaaagcaattatgggaagttttttttggtctttgtcaatatgcgcttattctacatgctaatatgcgcgtgttggatgatgaatcacctcaccgagtcttgggatttttttttttgggggtaagttatgcgatgtaaccttatccttgcccatactaggccccggcttccgtgcgccggtgatttttaagtaactttttgagtttggcgtttgctaacgtatgcgctttttattttcaccttttagcttttatcttcaccaggcaaagtgaaaaaataaaataacccacaaaaaaaaacccttaacaagagttggtgttgccgttgttcttttgtttgtttcctcttgcggaactgggtggaagatatgaaatgcggttgagggattagtttagttccgaatttttaccaggtggggcccggttcagaataaaatatctttttgccatgtctgagggtgtaaaagtcaaaagtcaaggaagcggattcgtatggattattcgcttggatatgccgttgagcgtaaagcacgcttcacgaacacgtgtcgcttttgtgttgctgcttcctggcattttgggtgggaaaaaaggtagaatcttatacgatgggacataatcgtagtatccactgtcttaactgtaaacagtgtcagtcacttatgtttatgtagcgcattataatattataaaaaaattagtaggaggaatatttagtattgtcgtatttaacatgcattttacaagtctataaagtatgaatatatatatatatatatatatatatatatatatggcagtatttaatagtagtacttacattttcctttctttatatgtataattaataattacaaaagaatctgtttgttttcaatatgttttaagtacaaaaaaaatattgacgtatgaaataatgtgtgaacgtattactactgtctaattcgttatgatcaagaaaggttgttattattatcagtacttgaacggtttaaccggtacaaaactgtcgtacagggattatcatttatattctgaattaaaataaagttaataaacaataacgtgtttttattttgtttattcagaaataataaatgtcaaattattagtaatagatatcagtagtgatgcagtaaaaaaaaagatatcggtactgatagagcatatcaatttttttttatttatatttttagtaccaaaagtctgaaaggtgttgatggatttatcattggatttatatatcactaatttcaattaatttgaattaaaagtgttattacgtagatattgagtaccaaaagctttttattcttgagggaaaaagtgaaattcgttttgtttatatattttgatttagtaaacctttcaaagtaatagcttgatgcaatttgtgggggagtttaattttattttttttagcatcatggtgttaaataaattgaatggctttcaccaaacaaaatataacaatattgtttaaggcatatatatatcgtaaaataaaggagagaaaagtaacgcactaacgcaatgtataacatgataattaatttgaggttggtggatttgtatgtccctaacttttctaagaaacaataagtttggttcatttgtttggcttttatttgaattttcaactatataaaaggatttcaaatctaaaatgagatacatttgtagtatatgttaagatgaagatttgcatttcattaatttgatggcacagaggatgtcattattctttgaagaggggtagtatcgattttgaattctgactttttaatctcggactcttgatattttaaaatcaaattaattcaaataaattaaggtgaactcataaagggttaaaactcgtgacaaaattcaaactcgcgacttttgtgaaggagttatcaaactcctcacttagatttgaattctgaatcttattaacaataatacacacaatttgagaaaaataatctgcaactcaatcagtcaatcgtgaccaaagaaatacacctaaatgtcttccttttttaattacttaattagaattgaacatttttttggcttatctatgtgtcaatttggatgcttcggctattattatctccttggttcatttgtcttaacaaaatggatgcaggatctctaccggctgctattgaccaacacgcctacaaccaaaggagagagcaaaactcagagtcaaggcaagcaacgtgatgcagagggagaagacggtaacgatgatgaaggtgacgatgatgacgatggagatggtggatttggagagggtgaagaggagttgtcatctgaagatggaggtggatatggcaacaattccaacaacaagagcaactcaaagaaggcacccgaaggtggcgcaggtggagcagaagagaatggggaagaggatgaagatgaagatggcgacgatcaagatgatgaggatgaggatgatgacgatgacgatgacgaagaagatgaggtaggtgaagaagaggatgaagatggtgctgaggacgaggagaatgaagaggatgaggaagaggaggacgaggaagcattgcagcccccaaagaaaagaaagaagtgaatttagtttagtcaagcctcccgtttgtattgttgtgtacgaatttggcttctaacttgcatgtttttacttttttgggtactaaacttccatgttcttatttagtttataaggaggcttatgtaggacatgttttaattgatatctatggtaccattgcgtaattagaatgctacattattgagcagtcaatgctaaatttaagagaggaaaactatgatcttggttttgacttgagcctactccctctcccttgattgactctattgatagtaagaggtcgtatagtatgtctagaatgcaagtatcctttatctctagctattggcagtacttgctattcttgaaatttctagcttaactcattgcttgggcctttggggatccatttttatgagcttgcggagagctctctatttagcagacactagtggattattcgggcctgactgctaactcttctaaattaagtgggcgatatggttcacccacccgtactgataatctaatgtcaaaatctccaacaaattaggtaggatattataagagtttaatgcctatctatttacactgtaaaataattttgtattattatttaataataaattattatttaaattattttaaaaattaataaatttatcataaaagaataattatgattgaatgaatttataaattttgtataattctttttctctattataattgttaccttactgtcttgtttacaagtcaacgggttactatagtttggactttttggcttaaaataggatggaaccaaaattgcatatatacttactattattaaatattttttcccatattatgtataatttttttgctgaatatatatatatatatattatgtaattattagtattaatatttaatactatttttgttaaattaaaaatttaacaattataaatataaatacataaggaggataattaaaaatatatgatattaatattgaatatcaaatttaaatattttagtcactaaaattgatatatttatatttatgtaaaagtcacacacatttgaaaatgtatttatatcatcgttcaacacgtaaatcaattaacatataggtatttcaattgaaaccatcaattagcaaaactgatcattttatacctatattttacccataaaacttgaaagaccatggttaattttgaaaattcattcttcattaattgaatgtttaatgataagtagtaaaatgaaatgctttcgaatataacaaagtgaaataaatttccactttattatctatatatatatatagatagatatattgttttatgcgacattctctaagaaaagaaagaaaaatatcaatgaatgtaaaaattgtaacaatttcacttccatccatttctccaagcttctcagttttgtgaccagaggcatattcaaaaaaaattgttagtggaaataataaatagtttataatattatcacacaaaaaaatattaccaattatcacaaaatatgtaatatcgtgataaaaatctaaaatatttatgcttttataattataataatattttatgcgttttcatattttgaaagtattttataaatttttattgtcaacactgtaaaaattaaagggataacgaagtaaaattggtataattttttccttatattttcttacattcactttaaaatattcatcttactaagataatatctatttttctataaggcatttttctattacacatatacaaataaaaaatcttgtgggaactataatctggattagtcgatgttagttattaatctttattctctttaattttgatatgtttattttttttatatgtgcctttgcttttatatcttgagaatattaatttttaaattgtttttaatttaacagaattaaatttttaaatgttttatttataaatataatgtttttaaaacgagttagaaataattaatttaatttacttaataaaataaaattatttttgaaatgtgaataagatataattcatattacaaccagtcaattatacttgacaaaaaaaaagttatataaaagttttcataaatctattttgagtgagaaatggttttgttgggtacttggtattttggtagaaaaacaaaccgtggaagcaacccaacagccaatggaaaatttagttgtttagtatatgttatactgaaccggtcaatggtcaaccttaagtccttcttcttaactctttatttctttctttcaagtttcatgtcttttcctcatttcattcttctaactttctctccgtttacttcacttcatgacggattcttctcctcttatccctccctcaccagtcacagtcacggagatcgacctcgaagagggaccctccgaacaaattcaatgccggatttgtcttgaaactgatggtaatttttctttaatctcatgttttttttcgctttcaggttagggctaggttagatcattcattttgtttgactagaaatggacaagtcaacttcaagttcatattattgggatttgagcttaaataactttaatcgagcaattgtgttattgttcttgttagttcctgttttaacttatttgttatcagagtggcgtttctggcagttatgtatttactgcctgcaaatatgttgaagcttaacatttagatgtattttcatgttttgttcctctcaggtagaaatttcatagctccttgtaagtgcaaaggtacgtcaaagtacgtacatagagagtgtttagatcattggcgagccgttaaggtaaggatgctctctccctttaaaattctattcaaatttcaacactgtgtagtgtgttgttctatagccatatcaagaaatattctatgtccagtgagcattgtgtaacaactatgagatttttaagttataaatttgcttgctagagggtgacaacttctatgtactatctctgactcaagactgtttttggtggtctgtgtactttttgttcagctgatcaattaagcattgtgcatgttaagttgtcctgtgcttatcaagtgaaaactcttgttattgtaagaaatgaaaactataaatctggactataagattatatttgaatgatcaagattaaaagatggacacacatgccttttttaattggtcatgtgatatcttgaccatccatgcatgatttggatttatagttctgattttaaataataattaaagatttctcacttgatacgccttatagacactcatccacatgcaagcatatcactgacaatctataggtatataatatataagcacttgcttcctgaattttatcactaaaatttgtatgtgaagaagaagaatgttgctctttccagtgcttgacccaatataaatgtaaattactcaatgttcttgcaggaagggtttgcatttgcccactgcactacttgcaaggctccataccatttgcgtgttcatggtgcttatagacaatggcgtactttcaaatttcggttttttgtaaccagagacattttgtttatatttctggctgttcagcttgtaggtgaattgttttgattctcctagccatatagatgcttattcatatataattaatgaattccatgtaatgttctaattctacatggcaacaccttatttcttttgtctgcaggtcattgcttcactagcctatttggtttaccaaatagatggttacgagcagtattggcttcgtcttgtttggggttttggtagtgagctgagcttttactatatatgtggtaaattgctatggacttgagcagtagtcatcaaaatgcttatagcaagtattactgttactatttttttttttgttgggtggtagtggtggtaaattttggtattgtttaatttcttttattcgcagttgttttatccatacataggatgatgctggctctgttgttgatttcattttggttttgtcaaatgtaggagcactggtgtttcttgtgttgcttggcctgtctgggtgctttattacttgttctgatccaagaattcgcagtgatttgggtcagccttgtcgagaaatatgtctttgttgctgtcaacctaggtaatagctctgcttttaaatattcatgagcctttgacactgttaaaacatacaagtatactcataaatcttaacaacttcttgaatcgtcatatatttactttttgcttttttaaaatacattttatgatccagaaactatgcttggataatttctattatattggagaccctaatttgcactataaggaatacttgtgaacttcagctttttaaaaaacataaaaatgtagctcttatttaatacatccttggacatgctaaatatagaaagaatgatgtttcatggtatatttgaattttgaagtatatgtcagtagaaagtctgtgatccacaatggtagtgactaaggttggtattgtttgttttcattgcagagtttgtgctgaccgtcatttgcatggtactccttatatgtatggtactccttatatgtcgagtgattgcaatgcatgctgtgataattgtggaactgaatgttgtggttgcacttgcatgagaggttctgaggacgaagcagggctaccattattattcattatggctttgatttttctggtactctttgctgtacttgggatattttacagtgtattagtggctacaatgataggacaacggatatggcagcgtcattatcacatacttaccaaaaggatgctaacaaaggtgcccgtgccttactttattgtcttttgcacattcggtacagtgcagttaaccttcaattattgtttcactgcagctgctgagtcaacttaatgccttttttatttgtgcaactagcccatttagtgatttccttagtctactaaggaacttatatagaaattgctgccagatgtaatgagaaggttttctgtttgtttggcctttaaatccaagataatatatatctgctaatattttattattatgggaggaaaaggctatatcctctttctttcttcttctttagttgagtcatttagactgtatagcgttagagtattattaactgaaagtattgttttctgatggttcatgagaaatttacttttgttgacttgatgaaactcaggagcccaatgcagtgactggtgttaagggcacagtagtgttgcaattaagtcatggccctaagatatgggagggatattcaagaaaagggaaaagtgggacacgtaaagttgtagggagagatgccattatgctgagtgaaaattgggtggggcccgaagcagtagaagatgggaggtggttatgaagagtgcaggatcgtagctgagggaagggtagagcaatttggtttatcagccttaggcttgggcaggaagtttcatccatcttctcgtgatcttcatagccctgttttgattaacttcttaataaacacttataaaagaagaaaataagaaagtgaaatgacataatgaattaagcttttttaagttaaaatcaacttttggataggttaaatgtgacagtttctatagaagtttaagtgtataagttgattttaacttataaaagtttacttcatcttcttattctcttctactttaaatgcttactaagaaatttatccaaacatgaccctattttttctctcttcttgaatattctgcttaatttcatttttaactgatatactttgtgtttatcaatttgagttcaatataatctcctctatatcactttttttttgggtttgtattaagcttatactgaatttcatggactcaaaatcatcttgcagtctaatattcaaactgtttggggcatctttttccctccactgtgggtagtgtaaatctggcacactgaaacagtgatttttaatattgatattcccatgtatgaagttaattgcatacttgataggttattaaactgtactcttgaatattcaaccatcatcttgagttcttgattatgaaactgttttgtttatcataggagtatgtcgttgagaacattgatggagagatagcagggcctaattggactcctccacccctcccccaggagcatgtacagcagctgaaaacattgggcctcctatgagtttgaaggagtcatctacctgctgaggagaatgacagtagcggtaaagtgacaccttgcttcgtagtttggtccttgtcagggagatatgcagttaactgataaaattatgagtcatttaagtgactcatctcacttaggtttgacttgtataattgttctagattgtggaaatttgtgaatttctgttgtgtctgcaaatttaaagaaatggaagggaaaattctaagaatatatctaattacaaatatacagtccaggatcttgatatgttttatattagcattaaatcaaccttgctatgtacggattttctctcaaaactttagtcatttactttttattattttattttgctacaaaattttaaattgatttatcatttgatatagtatgttattattaatcctaattgctaacatcctaacatttataattattttagagtttaaatatacttttaggtttttaaaatatagtctcttcatttttttagacttttatcaggttgtttgtaggaaaaaaagtaaatgattgttacattttttaaccagtagaaatgaaaaatatttaaatataaattaattaattctgagaacatgttttcaaatattcaaaacatttttaagccatttttaatatataaaagtttaattaatgataacaatcaagttgaaaacattaattaagtttttggttcttactgttttttgctaattttacttttagtttctcaacaacatttatagtgcatttagtccctatatttgtagtctgttaatagttttagtctttactgtcatgcaaaaacatattaacttgtgatgtaaagttgatcttgttaatttagtgatttgttatatcattaagtaatttgatagagaatttacatataattttaaaatagttataaattctggaaattaacttcaggaatgtcactgaaacaatactttagaaaatcttcaagtaacattttaagaattattttttgaatttctatcatctgtgactaaaaaggtcaaatttactggagaagacgatggtagtgaaggagaagaatgtgtgggaaaattcaccaaaaaaaaaaaaagaatgtgtgggaaagaataaatgagagaagaaatgttagtagacaaagaaaagacaggagaggaaagtaatagggaaagagggaggatgtgtttatgaaggagaagtgagagggaagcagggagggtatttgggtattttaaaatttacaaaataatatgtgtgtagagaaaaaggaatgcaaaaagatagggcttcagtaaatttttagctcatagaaacaaattttttatgatgatttttttaaaaccaaactttataaatttagtgactgtacaaccaaactttttttttttttaggagaacctcctgcagctctaaaatgaaagccagaacatctaatgatgtgtttcgaaacttgtttcaccggcatcgaatgaaccgttttcacactttaatgcaaaaacatagaaggataggagttgtaggaatacaaacacgtactaatttcttgggcatattttgtttaagagcatgttttttattttgtttttaaaagtttaaataagaaatagtgaaaacagaataatgattttttttttactatttcttatataaacttttaaaaatagaaaataaaattaagatgatattttgatagttaaaaaaaaaaacttttttcaaatcaaacaattatttttctttgccgtctgtcttccttctactctccaatcataggccctacgactccttgcttctcaagctgttgctcgttggtgttggttacatgtcttctgtggcaattgccacgtcaccagtttgagaaagttaaagatttaggtctgtttaaataatctttgtcataaacactttagaaaaaggaaaataataatgaaaggcgaataccaaaaaaaagtgcgacgaaggcattgtacaattgattttatttaacgagtttacaataattttctacaatttttttggggtcaaatttttttctcttttctccttcctaaattgtaaaatttgttatacaaaatttatgttcattgaatactatccatgtgaaagttcccaacaatcagcgagttgatcatacccttctttgaaccgtacgagcacgtcctctgtcatcctcccaccgcacttacggctctataccccaacccaacgtgctctggccccggtcctccctttctattcctcatccatatttaacatataaaattgaataatcagagccgaaatgggatgttgacccagaaggaatggatagcgttgattaatgattttttacttatcatatcacaatagaattgaatggccacaactttctggcgttgcaggtgatcctgagcgagataagggaaaagagaaaaggctgaatcatgttttcttttttgctcaattttcacaataataattcttaaaaagaaaagcaaaaagtacataatatcttgttaacaagtattttaaggagatgttagaattttaaaaatatttaaaggaagaatataagattgagtatattaagaattttaaaacttatatactttatttagtactatatgctatatttaaactcttggtaagcgtagcaagaaactgagaatactcgatggaatatgctaataacttgaaggtatctaaaaagatgaagtaacttttgtgaattaccaaacttgaagccttgaacggatgaagtgatgaaggaaaagaaaggacaaagggaccactaaggtgcgcttttcgcgtctgaaaatagtaataattgatcgaaaagagacttgggcatgtcacatgtgcatgttggataccataagctgagctgagatcaagtgaccatgttctgtctctacgcacatacatacaccgttacattacatggcccctgccccacttttcaacttttcatcatattccacattcaatgggcgcccccactaacctaaataaaataccatcaattctcaaaacaagccatgataataaggcaaatactactgggtgttatcaagaaattggtgaacaaagatttttattgagatgcttaaaattatgttatggatgattttatttaaaatttataatattttaaaaaaaattaactaatattctaaagatattttttttagcgaaacagctagtaataaataataataataataataatatagaaacaaggtgccccacccacaaaaagtgtattgagaaaacagacaaaccgaacccaccggctgcaagcaacagcaacaacaacaacaacaaattcacctcattcttatccaaaactgttagttgagacttcctataaattgcttttgtcaagcatagagcgaaaagcaaagagcaaatcaacaaccttttaagcacagtgagagaggtatacgtacgaggatgtctgacattgctatgttggtggcggaggagtatgagaggagggtcaagagtttaagaaaggccggtggtggtggaaccggagtgggggaatttgacatggtttcttgtgtttcggtgatggtgtccaggctcaaggaaaagaagcagcttgtgcaatgggttttggagcccaagacccaagttgctatggctgcttccaacagcttcttctctgcttaaacaactcattcatcaactcctctggactctgatgtggttggtgtttgattgttgcaacgaattgttatctagttttttcatattctaattttcatgaaatattgtacatagctatgttttggattcaaatcaaaggcaaagcataattgtgtttagagagtttttccggccacaatattcgtgccctcttcccctccgctttctctgtttccttggacgttaaatttagaaaacaacatcattgctaagtatttatctgttttgattatatttattggaaaacttgagtatagtattttcttccatcggtgtgtttggattaaatccaatttttcttttcaccataattaatttcaaattccaagctgaaagtcaaagaataaagagttgccaccatttttaaaacttttcaccataattttgtggggctgaatcaattctattaactgttcaaacacactattagtaaaatttctcaatcaaatcaatttttttcgtgtacgaagatatcgaactcaattcattctaatcaacctaataatagtgttatgaaaaagagttatgtttgtatttttctatttttataaataaataaatataaaagtatgccctgttttttttttttttttttttatacttgattttgcaggatttgttgttttcatttcggtgggcgaccctagaccctagtccaattgaggagattttgtttttatttttattttttgtcgacgattggaacataaacttgcaaagaagtgaaggcggtttaactttcacttgcacgcatttcagcaagtttggcgttggcgacaactaatagtctaactattccttaatgtgggtaacaaacaatcaaacatatgatgtaatctcctaaaatataggattttaaaatatctctcttggtaaaagtatacaaaaagattacataaacgatggtggtatataactcgttaaatatctctcttagaaaaagagttctgtttatatataaagattaccaataatgaatatataaagaaattcgtaaagagtaggacaaatcaagtacaacagaaaaagagttctgtttaaataatctttttgtactatgaaccacactgtctgaatgggttgctaaggcttgatgtattggatcttggaaatgcatcacgcgaggtttccatgtttgatccagcttgtaaggggaattccttaggacgtttacgtgggtattcaagctagcctatgatgtttagcttgttttgtttcggcccatgattttccaccaccttgtttttggcatgttgggcccttcttgcataaaaataaaataaagttcgttaggcaccccccaacttcacctcttcattttcctcaaacgtcttcacactttttcttctaagagcattgttctttcttgttttccactgacttctccacgtgaattttcgcaccttcattgctttttctctggaggtgttctgtttattatttattttttatgttgagtagatttgacgaaaactagtttccgctagatcaagatacacaatgaaaattggttttccgcaaagatatttttgtaataaaaaaataggtagagagtggaaaaatcaaatagaggtatgggaatatcacatgcctttgtttcacacagcgaaaaatgaatacatgaaaacccaagatgcgggattacaaataaaaaaaacaaaaacaactcgtagttatattatataatataattttaatttttttagaacaattattttatgaagttgaaagttcaatcagaagaaaactataatataataatataatcataaattaaaatgaaaacttataatttgatataatctcctgtttcatgttgttttagaatttttaaattaattttcgctatcttgggctataattttattggagtgatgatgaataattgttttgtatctttctacgttgtcttgtgctggaccttttttattttctttttatatgtgatatttttaagttaaggacattgctattgaccgctcctcattgctatttaaacctccaaaccaaagagaaaaagctaaaatattcttttggcatttaattaaaaatacctggtcagaaacataattgtgtttattacatttagaggagtactagcaattcattcataaactttttctaattgattgaaatgtattgaaaactacacaataataaattttcaccaatgaaagaaaatgtgttcaaaaaaacttgtctaacatttctcttcaagatttaatacaacaaaaataaaaatttgttgtgttatttttgttttaaaaaacttagccaaaacttattttcaattggtcaaaatttaaagcgacttccaaaattttccgatttcaaacaaaatatatagactaaaaaggaacaatgaaagttacaaatttaaatttaacccacacgttaatattgttattgactttcagataaattcaatccaattttaatcctgtttactctgcgtatacaatcttattcgttttacacttattacattaaattcattgataatgtaaatttaatctttagtgatagatttcaaattgagatcttagactactttttggtagatcccataatatcaaataggattaaagatcttttaaaatctcttctttcatatttttctttaatgatagatctcattttgagatcttaaggagagagaaaaagaaagaaaaattattctttttttaataatgtgcaaatcttaagagatcttttataagaactcatcttttatattggagatctcttcaactcctttattagaagatctaatgaagataagatcttaagctcaaaatctttatttaagatcttgcactaaagatgttataccttaaaaaaatgaattcattcatcttgtaaaattactagcatggagatatacttttacaagaaattcatgtcaagacaacataaaaagtaaaaccaacataacataggtgttacctaacacgtgggtaccttcattaacactacaacaacaaattgacagtttggtgatacactagaacttttatttttcgaaaataattgtatgagagcgtgcaatataatttttccgtttgtggctggacacttaaattaaagggatgggcaagcagttacttttgggaagggagggctcacaattcagttcataacaatgtccaattggccatatatgctcactgctcatctcaatcgaaacagaacgaaaaagatggccgccaaatggtgcatgcattgaatgatttgccgcaaaagttgcttataatataaccttgcatggaatataagcattgaactgtctctttcaaccaagaaaggcacacagttaaatccgtataactatatgagtgatatgaaattatgaatagtggaaaaacattgtcacttgttaatcaatgaccatgcgcatgcatgcattattaactcgactgaacattttaacgataatttgctgttgtcgttcttcaaccaacgcctaatggggctaataataatagggaacccacagacaaagtttgaaaataaacaattataaagatcatagtttgctagcaatttagctcaccacctccccctcaaacttttttttgatcgaagaatttccattcataagccgagacgaaacaagagcaaagaagaaattattatgtctacaaaattctgactaatttctatgtgataaataattatatatatttttaatttataaaaaagttaataatatatcatcatcacatgaagattggtagaaattagatgagctcatactctctataataatttttttttacataaaaggcatttggaatgcactttgcaagataaaatacagaacaataaccattaattatgatatttattaggatatttagtagttaaaatcttaacaacttcataatttattttttatgtatatttgtaaattataaaaaaaattaatagtaaattccaaatcaacatatttgcctgacacactttatcagagtctgcttggtgagatctatatcgttaaaagaaataaagagaaaaaaccttggtggtccaggcaatttgaacgcatataaaagcagtacaagtgtccctttgcccccttttgtagttagagtttataattgtatgcagctatgcatgtccttggccctactatattcaatttgctcagctacctctgcttcgcgtcgcgtggcagatttatgttcttgaaggatatttcagtgtaaaagttcccgataattattatatgaaaataaatgtgcttataaatgtaggtgataaaaatgtaaaagagtctaatatcattaaataagaatagttgtacataaacattcttttattttaaatatctgatttatttttttatttttttctatttttctctttttaatacgtgataaattttattatatttatgttttttccctctctccttaattgttaaatagcatattagatacattcaataattggtttcattatttttttaattgattaatgttaatttattaatttttattagttattgaagagaatttaaatccatgacatctttctccttcattcttttttcactgtaaaatcaatcttataattaatttcattagtttgtagcatttcgtgaaagttacttcaattgtgcttggcaatacttttacgatagctgctaaattatttgaccatcttaaaagtttatctatccataataggcctttgagtttattaattttaatatatcttgtggcattttggtagtgtcttttaggttttaatatattttcaatccttataaaacacgatgcatgtttttcatattagtctctgtaaatttcaacaagcacttttagttcttacaatttcctcccattttttacagtgaaatttcctccgttaacataatcctcgctgttgtatttaaaaaaagtttatactttagtatttataaaattatcattttagtccctaaaaactagaggtaagaaaaaatttaaaagactaaaatgaaaaaaccacaattttatagggtctaaaagtgctcacaatatttttcacgtcaacaacaaagtctgactaggacaatcttttaattttaacgggaaaaatgtaaggactaaaagtgtttgcaaaattttataggaactaaaataaataaaaaatactattttaaaaattacgcgtaatttttttttaaaatggtatttaaaagtaaattaaaaaatattttatagtaattttcagttttcaaattttttaaataaaatgaattggtttattttggtacaccaagcttgctagctagctagaagacatggggcttagtagtggtgccttggcttcagcgtggaagggcgtctctatcaatagaaatacactattagtaatgacattgtttttttttttttttttttgtgagcttaagtgataactttgtcgatcttattgagccattaattgtcttttatgttgaatgcaaatgcattagtgttgacatcctttgcaaaattgttgtttgatcaacgctaaaatagccactggcgacaggttttgatgattatagtagacttagttgacgttaatatgcgtttttctggtagtttctacttgcacacacgcaatatatgtaaataagttctttttgagttgttaatgttaagcttataaattttaggtttaattcatttaaataattaagttcgattttaagtttaaatttatttaattaattaaataaataagtttgatgaaacattcaagcaatccaaatttaaataatttacaaatagatagtttcatttatattggtagtcttaatcatgaagggattctactgaaaacttcataatctactgtgccatttttcgatgactaaaatagaattttgatttcttatctatattttacgttttagtttattcctttaagtctaaaattttcacttttgtctctcaaagaacaaattgactattttattagtttattatattaatttgataatacttgacaaactataaaatatgtcacattagtcaaattaatatcgttattgtcaaaaattggaaaaaaaaaaactaatttgttctaataaacacaataaaaaatttagtgaatttttttaaacttaaaaagattcaattaaaacctaaatataaataaagatcaaaattatattttaacatatttaaaaataattaccatggtatttttttagagtaaattacatagatcttttctgatgttaaagaaaattatacatatcttttctccttcttaaaaatctacacatcttatttgaggtttaaggaaattacatatcttttccttgagatttaagaaaattatacacgtctttcttctatttttaaaatctacacaaacttcataaagtaacaagtgatgtgcgttgataattttaattaaaaaaagctaaaatattttatcgtcttcataaatatagaaatgttcagaatatgtaattgcaaatttttttatcaatttttcgtcctcgcaaaatttaaatctattattttttggttcagaattggggcttggatatccaaacccacatgtatattgtgtatgttgttgttgaaagtgttaggatattaacttttcttcatttataaatttgaatttaactctacaccaaaaacaaacatttaaattttgtgaatacgaaaaataaataacttttcttttttgcagtgataaatttctaacatttttatatttataagaatgaaaaacatattttagttttttaatcaaaattattaacgtacataatttattactatcaaatgttttaagcaatatttaaaaaatttgtataaattttaaaaataaaagagacatctttaatttccgtattcttcttgagagagatatataaattagagatgtatgtataatttacttaaccaagatatgtgtaatttttttatttattttttatttactaagatctactatgcctataagctagatgatgtcatgtgctcatgcgtattgacagtgaaaaagagataagctccaatagaatttaccttcaattggcgttgcccattttccaaattcaaatcagaagactaatatatttatttaatacaattttttaatgcttgacttgattcttttttcaaaatatacttcgcagtcaaacttagctttaaatatgtgagtagacttaactttaaataggttagttagcctcatccttcaaatagattaataagtatataacttcttaaagaaagttagttgtaaaaaaattattataaaatttttcatttacgtaaaaagtggtctaaaattgtttaaattcaaaattaattctaaacccatgattctaaattatctaatacgaatccaaactctaagacgtaaaattttcttgttggccaccatataaagttcaaaaaaagagtggagctccataatgcaaggtttgaatttgctacacatgtgaaatagtagcaaatacagggagaaggaaaatgagtgtggtcctgcgtggaaaattaggagataatgataagctattatgcattaaaagcaacactgacagtcaacaagtcgaacactaccactataattctataactatttttgtccaagttgtgggaagctatactcactcaatcaactttctttctcaaatttgcaggaactgtttgtttctccttaattatgcaaaaattctagaagagtggtgctatgtaaacctgggaggttaaaagttaaaatgagtgcagacagctaattcctgtgctcttgcatgtgactagctctgccttgtggggacttaaaaggttgctctgtctgacctctgagattgtcgcaaccaataatatgaggagtcacttgtatatgcatgaacaaatcatttaaccttttcacctacccatttattattgtattaacgagggtcttcgtagaatttcaatgtctatctactagtactactacttgtacagttgtagttgaacaagtcacctatttgagaaacaaacttgggttttactccatggcaatatgttgacatacataacttttaaggggttgattgatcgtggagcaagataaagtttcgcatctgaagagattattaagttgagtccttactcctttctttgggataagataaatataaatttttctctaaatattgtttgaggccaaaagctttagcaactttccttgtcttgaaaactgagacattattccctctccttaaactttcgataaaagaaaaaaagaaatagcctgctgaaatacatctccattttgggatatttcgatgtggattccgaagcatcaaactaaaatcgtttccaaattttgccaaaccgaaattcaaagagtaaaaaacaaggtattgtgcagcatatatagtagggaaagtagttagaatctttcttttactatatataatcttgaatataaaagactaatagatacaaaaatctaaggatacatcagtatctggaactagatcagagatatctgcgcaaagtgctaccaccccttaatgcagatagcaaaaagataagctggtcatcattcccatcatattctacctgattttgaagcaggttgtagttggccacaacatcatctgggagcaacttgttcctgcaaagtgggcaagtagcacagtattgctgcaaccactggtccaagcaatccttgtgaaatgtgtgtctgcaattgaggttcctcactttctccccttcctggaattcagataagcacactctgcaatctatgtgttctgccttcaattttctagtgaactgaatagtggggttcttctcttcgatgaaattgaggtattgggtggtggaaattggacgtgtatctgactttaggtactgaatgatgaagataagttgtattagcatgtatgttaatagaactattgtcttgacatagagctgatacaagaactcacacacagacgtcatggcttggcttctactacttctagctaaatgctaaatgaattcttcaatgcacgcacgacaaattttttttccctttgtaaaacaatgaatgcccccaggcacgcaattatttcatttataacttataaatagaggcgtgtcgtctagttttttgtacatacccgccacatgtattttttatgaagtaaatataagtacagataaacttagaaatatttgtagaaaaaaataaggaaaaaaaattctgaaagctagattgcttaagtaaattattatttttcatattagtttcttcaaaattaattttaatttatgcataaattaattttaatttataggaaagttttacattttttcttctaattttcttcttaacaagtgcttttgtagttcatacaaacataccttagttatttaaattgagtaagattattattcataataaatttctccctatatatttactacaactaatacctaggacttgtatttgagatcattaattaagttagagcaatttgtattaattaattcacatgcttgatgttattttttattagttgaaatgttttcacctttaaaattataaaactagataaaacttagatgcaattcattaaatgtttttggtattattttccaattagatttggagttttatccctataatccttatgataaattgcttacattgaatgtaagtataggttttcaagttttcactccaattctaattggaaaacaatactaaaaacattttaaaataattatttataagttttgttctactataaaatatattttattttattcttttgttttgaaaaatatacaaagaaaataataagagtttggaacacatttattatcagtataaaaagttaaatgaataaaaatattgttaacagtgtaacttttaaattaataattattataaaaaataataaatttatcatatgtatttaagtttttattgaacgataatatacaaattctttgcagtaatatagaggatttattatttattggtaacaaaaatattttttaaaatctcattttgtattcacaatttattttataaatgattaaaatgaaaataatgtttgtatatgggggaatatcaactaaattttttattttattcttttcccgttctctataaaaggaatgtatagataagataatgtacgtacttgtgttctttattagtagctttttcttctgttactcagttactgtttgttctgttatgtgcgactatataacttggtcccatgtcatcccaagtagggaagggacaactaccacggtttcggacaggcgtagctacatttccgcaaacatttatttgggtaattattatttgaacttaagaaagaacttccaggttatgtaattattgtttgtgcaactattttttggttatttgttgttttaaaaggaatgtctttacttttcttttgtataaaatgcaatgtaatttggcatacagaatctaatggaatatatagaatttggacagattaagttacaaataattattattatatatccctaaaaaaatattgttattattatatgaattcttttaataaaatacatagaatgtaatataaaatttgttttaatgaaacttcataaattaattgaaaatatttcagtccaatgtcactttatgaccaaacacatgttgtgggacgcactagttcaataaattcctacacgctacgatttggtgatataaattgaagtgtctagttgtcatctaacctgtattgcttctatttttccaaaaatatacattttagattcagtcctatgacaatgtttgtaaatactcagtccaattacttaaaatggattccgacaaaaaaaatgtagatacttactttagtaatatttatatgatcttaattattaaatagttttaaagaaaaagacagaaatgaaacttacacacaatattattatgtaaaatttaaatacgagatgatacatattcaatacaacaaccaatatatagcaatcaacatttaggcaaaaaaattattgaaatattaaaatattttaaaaaacaaataggccaataaactggcttaactgattttttaacccaattgggttatgttaattaaaagataaatctcatttcatacttcatatttaatgagtctcatatatgaattcattgtttaaaattaattttaatcaataataaaacatgttaagagggatattttagaaagtatagctaatacttttcgacaaagtcaaaggcatttagctaaataaaaagtctaaagttttctctcaacctcaagctagatccttcgtttggaaatgtacaaagactttattaaaaactaaaaataggtgactcaaataaactgaatttgtttattttggtaaactaaactttgttattttctccgttctgtaataaaggtagtcttaattttttttttatacagaccaaaaaaaaactaatgataaaatatgaaagaaaatcacaattttataagaactaaaagtctttaaaaaaatttcacataaaaaacaaagttaatgactaggactatattgctaacgaaaacaatataaactaaattttacatgaacaaaaatgaaaaacatgttattttaaaaatatataaatgacttattttgatcatttattttattttttattcagtttaatcttttatctttttaaaagttcaatttgatctttttttttattttttattcaatttaatcttttatcttttaaaaaatttattttaatcgtttattattatttttttcagtttaatcattcgagtcatttaaaattgacatagttaattatttaaaaataaacttattttgttaaaaatgaagtggaagagaaggaaaaaaaattaaataaaaaaacatcatttttaaatgattaatgatatcaatcttaaataaattgaagaagtaaataaaaagaaaataagatcaaattgaaccaaaaaattaaaataaaaaattaaataaattttttaaaaagataaatgattaaattgaacttaaaaaaataagataaaataacaaattaaactttataaaaataaaggatcaacttgaagaaaaaaaaagttaaaaaatcaaatatatcatttagctttaaaaattaagcgttacatttaaaaaaaaaaatcgtatttaaaagtaaattaaaaaataaaatgcatagatgtaatgtaaaatttgtttattgaaacttcataaattaattgacaatagttgagtcctatatatgtcactttataaccaaacacgttatgggacgcactagttcaataaactcctataaactacgatttggattggtgttatgaattgaagggtcaagttgtcatgtagcttctatttttccaaatacatacattttagattcagtcctatgacaatatctataaatactcagtccccatacttaaaatggatttcacccaaaaaaaaaatattgatacttattttaatatttggataagattttaatttttaatagctttaatgaaaaagacaaacataaaacttaaacaaaatattattatgtaaattttaaagaagagatcataatttttatttttatttttttcaatactagaacaaccaatatacacattcaactaggaaaaaaaatattaaaatattatctttttaaaaataaaatgaactatgccattgaactggctgaacgtatggttttcaacccaccacgttaaataaaactagaaaagaaaggattgaactaacactttcaccatacaattcatatttttatatggagtaatctatcctcgaatgatgaaattatactaatttaatttatacaagtcataaatggtaagtttattgatttttataaacttcaataacaaattatcttaaaagtcattttatcgattgtgtctaattggccaatcatgtttaaaattattgaaaaagtttatatatatgaaaacttaaagatgatgtttaaatgttgagagcaataaaagttataaaaacaattgatgtttaaaaaaagatttaagtgtttaaacattaaaaaaattgaaaagaataaaaataaaaaggttaatgtcttgaaaatatgaaaatgttgagcaataaaatatttaaaaaacgatttacttttaaaatatttaaaatgttaaagaatgaaagtttaaaaatgtgaaaaagtataaaaaaaaatgtcttgaaaagtttgaaaatgttgaaaacgaataaatttacaaaaaaaaaaaaagatttttaaaaagtttatgcgtaaaagtaattttaacaatattgcaaaagtttaaatatatgaaaattaaaagagtaatgtgaaaaatatggaaatgttgagagcagtcaaggttaaaaaatatgatgtttaaaaaatgatttgaatgtttaaaaatatttaaaaagttgaaaagactaaaaattaaaagagtaatttaaaaaaatattaaaatgttgagagcgataaaaatttaaaaaaataatgattaaaaataatttcaatatttaaaattttaaatataaaaagagagtaatgtcttgaaacatgtggaaatgttgaaagcaataaaagtttttaaaaagataatgtttaaaacgtaactaaatgtgtaaaaatattgttcaataaaattttaaaagttgaaaaggacaagagtaaaaatatgaaaagtaacaataaaataatgtcttgaaaattttgaaaatgttgaaaacgattaaaattacattattaagtttttaaaaaagattatgtgtaaaagtaatgtttaaaaatattgaaaaagttttttaaaaataaaattttaaatatataaaaaaaataagagtaatgtcagacaagatatgaaaatgttgagagcaatattttttttaaaaaaaaaagatgatgtctaaaaaattatttaaatgtgtaaaaataatgtttaaaaatatttaaaaagttaaaaagaataaaataaaaatgggaaaaagtaaaacaatgccctaaaaaatatgaatgttgaaaacgataacacttacaagataaagatttttttaaaatttatatatgtaaaagtaatgtttaagaatattgcaaaagttgaaaggactaaaagttttaaaaatatgaaaatgtcggatgcatcaaatgctaaaaaataatgatgtttccataaagatttaaatatgtaaacataatattaaaaaatattgagaaagttgaaaagaataaaagtttgaaaaatatgtaaatgttaaaaagcgatgactttaaaaaaaaatatttaaaagatgaaaattataaaagttttatcgaacagtagactgattccactgaaaaattaataaactaattaggtcatgaatgcataactcagaaagttgatctaacaattcaaaacaagtgatgagaactgcgaagcaatttaaatcggaaaaaaaaaaatcgacacaaataaaaattcatttacaagatctagatatgaatctatattatttaaccttttaatattaatgatttttttataagacataccagataattgatctttttagtaatttaaaactttacctgacttaatttcttgtagcttataatatttattactaaaatgtatcatatattaaaattaatgtaattatcatcaatttattcataattcaattatggtaaactgcaaataaatgtctccgttgattcaatagctactctaattattaaatgttggaccttctacagtcaaacactatcatacatgctaacctggcccttacggtatgcttggtggagcttctatggtcaacatacagcctccaagtgccaaccttcttccctgttaacaccacaggaaaggcataagggctgttgctgggttgtgaagttgaacgacatcctggttccacatttcatcctttggatatcaattagtttcatctaattgacaaagctcagagttgggggatgaaaaactgtcaaagttgctccaatcaaccaagcacaacatcaaacacaattttatatgctggggacgagaaagacactctgcctcagagtttccttcatccaatataatccaataattatttgactagccaagtatatacaatacaagtacattatcatcaaaaattttcactaccttgctcatgagaactcactgttcactcagtctcaaccaaatttgtttaaagcatttataatcttgagttgtgatactttcctttaacatcccagggaccagggagctagcctggcttccacatatttgccaagtcaaccccagtgagcctactgtttgctcaaaattaaataatttcaagattttgcttgtttcaaacagatcattttgattaacttttagttactgcatgtctcatatagaatgctgatgattaccatagtacaccattcctggcggttgaagtggtcggaaactaggaggtgctggggcttgttgtgtcatttttattggttgatgctgacctataggtgttggctgctgctgagttatttgcattgtctgatgtgtcaaaggcgccattggacccaccatatgtggtgggggtggccccggtggtaacggtgcgatgctaccataaccataagaagaaatgacccctcctgttgattgcaaataatgctgggaggatgaattacaaagcatttgatattgaccctgtgatgcagcagctggattctgcaaggtgggttgaggtaccaaaaccgaaggatatgaatgatttggtgtggcaattaactgttgtgaagtcataaaaacatttggatctgatataggtattgacttctcaggttttgacatggtctcagaagttagacaagcactttttgcctcttcagctgcaaatgttgagagaacagaactcatgattaactgagatgatgtagaagctgttagcttatctgcaacctcagctgcaattgctgcagctgacttcttagttgctgcttctgattttgtatttacatcagtagctgaagtcgttgaagttgaggctttatatgaagaatcttcatcatcaagtcgcttccgcatgtagctagcctcttctacttgtgcttgcgctacctacataccattaaagagatatgtcagcacaaaattcaaatttttagtatcattagcaataaaagcacgtcaaagttccataatgaaagcatactcaacaacatataaatgacctttaatggttaacaggaactaagttactttatatttgtgagatagtgcaacaaagttttttccatttctaaaccaagtttgttacattgaatgcctttgagggtttacaaaaagtatgcatacactctagttttggaaagggttaaatatttttgtccttataagttataaaatgtcatgttttttgttttaatccctataaaaattgtccatttttggtccctcatttatttgccctcatcaatcagtccctgggatgcactcaaactgggcaaaaaatttatagggactaagcccagaaatatgaaatttcatagggaccataagcatatttaatcctttcagagataacactgaattcccctattcccctctcaagtttgaatatgttccagacatatctaaaatcaactaaggaaggcatttgtataatatgttttttaagaggcaagggtttctctatgttatgtaaacctcagggaaggcgggtctaatttattctattaaatgttttacaactgtgaacactatatatgagcattttattgactttaccataataatcatccaattactatatgagtattttattgactttaccataataatcgtccaattacagataaacaaagaagagtcacataagagaggtaattaaatggtggaaaacctagatacacgacaaatatatcacattcacatctcataagaaactactcaaaataggacagtcttctgataaaaagaatcatgataatacatacctgaatctgagtgcgaacattctccagctcagattcctgatacataaaagcacaaacaattgcaagagggcatcaggacacaaaatatcatccagaaaccaaataactgcagaattcaaaatataaaatcttattgagcacatggacataatgacttgcctgctcatgcaaagcttcttttaagcgagtaacaagtgctgttctacttgcttcaactaatttgagattttcaatgcattctttcaaaatatgttcttcctccactagttccttggacaaaatttttcgcttagggtcctttactggaaaaaaaaaaaaaaaagtataagaatcctagcttccaaaactctggtgttaatttcattatattgatagcttaccaacagcgcatgcaatatcaacatttttttccatcttcctcacacgatgaacagctgacttgcatttactcatctctgcatcttcattggaatgttcattaagcaccgtatgaaaggctgagactattttttctgctgtaccaccaatggacaatttctggattacataaaattcatgacagttagttatgcaagaagaattacaaactagtttgaaggatgtaagaatctaaaagcatagaaatgtcggagtataaaatcggggagggaagaaccacaaggaccctcagtctcaccgttttaatggaacgagaatcctttttcacaattctaaccgaacgggaccgctttttgttgaattccaactgcggaggtgcttcttctccaagtattacatttttcaggctcttagcctgtgatccaaacactctcctttcctcccatatatcaacctaaagttaggtaagcaccaagttaaataagatcaaattgccaacattgaaatcaatatcatggtatgcaaatcatttctcaacatttatatgccatatctgaagtatcagccatgcatgaagaattatgtccacaccaacttcatatctaaagaataatttcaacggttgtattcacttgtactaacttcaaactctggaaaaagggcttaccagtctaaatactgcacgtttttcttgatcatcacctttctcaagaacatccttaagtgctgtgggaagaaccttccaaaactcagtcacaaattcatttcctttacgtttgctattttgcaggatatcattagcaagatacagaagggggactcgctgaaccttctccgaattgtgaaattgtttattccatgttcccactaccagctctgctttgcttcggtgaaatatacaccaatgtgataaagctattaaaaaaattaaggatcacagtatatggcatcaacaactaattcatgcactttaaacagtcaactaaatactaggcagaaaaagtaaaccacttttaaactaagacaaaatccatgccaaaatactaattcagaaactcacactccaagttacattggccaagccctaataagttcagcttacaactgtgagtgcaataagtttttgatgcatcaaacatctgacttagtgatagaaagataaataagttctccaaaagctagggctgccactgcacaagacaaatccttttcaagatggacattgttctgatcaatagtgggtgttactgcaggtcccaagtaatagaaagagagagagggagagagagagagagggaaaagtaaaatactaaaaaaaaaaaaaaatacatgcacgaagacaatgtatgccattaaaaagtttaagatccaattctttgtaggtctaaaagcatgacagactttctagaacctcccatagctgaagcaaaactgtaagcttaattaatataaaccaaagaagcaactatgaagaattacactcattgtaagaaattaaattaatatggccattaacttttttcatctccttggcatatggatcacatgaaacactgaaaaacatctgcattttaaataatactccatagcttttagcatgactttattacaacatgtgactttacaaataaaagctccctccaagacctatggttgcttagcaattctagtgctacttccacacttgacaagaatttgcccaatggtttttggcctatggtgtattttatttatcttcctactttgcttatcctaagaacaatattaactttcagaaatttcacgaaaacaaaattgggaagatgttcaagccattcaaacacgaaaaataagcataacatacaattctagggcaacaatacacgtataattcacagaaccagtcacaattcagtagttctttacttcttcccactttagaaatcacgtacaaactgaaaagattgacctagttcacaattagcgtaacacctgaagatataattgcatatttataaacgaatacagtaattccaattacagcaatgctatttattccgagaccattttccaaattaacacaccaaatatcacacaccttccagaatccagaattaattgaaacatatacataaacaccaccaaacctacccccccccccccccccaacatacatatcccaatttggtgaagcaaagcaataattatatcatatatacaaaaaaaaaaaaaaaaacatttactgagtaaacaaattaatcaacttattttcttggtaattttccaaaaaaaggatactttcaatgcactgctgggtgctgttgagcttggacagcttgtccgccagtatctgctcgctgaacacgctattcataccagccaacctgcgagagaaagcacatgagtgaaaccctagcaccctatacaaccaattgatgaaaaggaaatgcgagaaattctaagaaaactaaaaccctagaacctaatggaaacataaaggaagaacgagagaaggtagtttcgaagcaaaaaacatcatttaaatgaataattaagcaaaagaagagaatgaaggagggggaattgagataccaatgccgcggaatcggaaccggtggaaacgaccgcgttttggggaaaatgatgaaggtatatgaatgtgaatgagaaatagaatgaaggagagttacaaaagaagaagaaggaggagaagggaagcagttaaagttaaaggtttacgtttgcggggtttggtttgtccatttggcgcaaactctacgaattcgtctaaaagccgtacttgttcatatattacatacactgttctccttcgtggcacgctggaaaacaaaaaaaagtgtcttgtaatttttaatttttggtgaaactgtgggttgtaagttgtaactgtagtagtattttttagctccaatttttattttattttttaagctggaggaatgacatgaaatgctaattataaggaagaatggagattttctataattttcatgtcttggaaacttacaattcttattgtatatcaatttcctacatttgctagtattttcgatctaattttcagcctaaataaatgcttcgtttatcgatgccaaatttgtttgattatactatagtataatcagggttttatttttaggtgattaactcttcaaacatttatggatctaatcccatccatggtataatttggacaaattgggatctttgttatttattatttcatttgactttattgaataaaaaataataaactcacatattttatccactttaagttcatctctaaatcctaaactttaaacatgcacatgcaaaacattcatgtttatggtgtataagtatcattactcttcattcattatgttttctattatgtatcattactcttcattcattatattttctattataacttatttgttttagacaatggaaatagtgtttggtacattagatttataaaaaaaaaaatattgaattagtggatctcattcttttcacccatgaaacatggtattttttttcaacttttatttatttttttttgttgttgtcaaccaactgaccttatattaagagtataattatatttttgtaactataaatattattttcatcatgttttacactcatttctattgagacaaacaattcaacattcaaatttatgtattatgttctcttttttaaaattatttctcttctatttttatcttctgcatttctttcatttctaccaaatatactcttagtaactaaattattaaatacaacctaacacaagacaagaaaggtacatatttaattgacattaaatacatttcttgaaagcaaattcatgtggcacacgcaagcttaatatactcattctctccattcttaattacttagagagcattagtttcacagcaaaaacattaaaatattgtttttaaaaaaaaattacatatttactgtagtttcaaaattatttacgcatctattgcagtgagtcgcgtcccagcaggacactactggggctgaatcgtccccacaccgagcgtgactcattccgtcgctaattccgctatttcggtcgctaacacttttagcaactcaaatagagaccgaaattagcgattaaattttagtgatcgatatgttttttttctcaaaaaaaaaaaagattcgtgccacgtggtaattttttgttgaataccctgccccccatttgataaataaataaaaaaaagcccccattgggggagaaaaccatactaatgctatttttttaatatcgtacttcaaatggtctaactatttttgtatatacaaacttcgaatggtcataattttttataggaatgtccaatagaggcgtactttatgtcaaaatgctcgaaattaagagaagtaattaaaaaaaataaaaaatagcattaaattaactaattaaataatttaaaaattagactgtgaaaattgttgactgattgaatcctaaatcgtaattttgaggcacttagaggcattttttggaaaaaaaaaaattaattgaccaaatcccctttggctacttgcctaggccttcctctctcaatttcgagcgttttgacacaaactacgcttcaatcggacattcctatcaaaagttatgatcgttcgaagtttatatacattaagtctcaaaatgacacatgtctcaaaatgacacatgtcacaaccaggtgagtcgcacctgactggggcgtgactcagcactagtcgcacctggagggagcatgtccggttgcgtcttcgtgagatacgattggttgctatacttgcgtaaataagtttgaaattacaataaattcgtaatttttctttaaaaaaacaataaattaattttttttgccttagtttcacggattagattatatttttaaaaataatattcttgaaaatcttatttctgtcaaagatgtttagtaaaaaatacttctaattcctggaaatgattttaaatttaatttaatttaatttaaaacaaaaagattacataaataaatgaaggagaataacaagaaaataataaaatattttaaatattttcatgaaaatataatattttcacctttttacatggaagcagaagatgcagaatatatatgtgatatatatatatatatatatatatatatatatatatatatattcttatatctacattctcaaaaatccaataaaatcctgtgaaacattcttctgctaagcttttgtaccgatctaccattatccaaccaaaatacgctacccccataaacatttttccgaggtcataattaaaatatacaagatcctaaacaagttattcgccatcaccaccaaaagaacaacaagatcgttttttttttataaaattaaccatggttgtttataaatccagtttgttatttgacgtattggggtccccaattatttaattctaatattcagtcattagttgttacttttatcttatgtttaatcatggatttttttactaacacctacttgggttgtttccttagcctgctttgatcggtgcgtggttagagttcagaacgttagacttgccaacccagttttggaaggaatttggatctgaaccttccattaagtccgctctggagtattttgtggcttaataatttccatttcaccattaaaataaaaggtcgccatataactattcctcacaagctaagtctctattccaaacatactataatactataagacgtaagacgaaagtgtacagcttactactaggtgacactcgctcatattttctaatttaaatttagagataaaaaatggcgacaacgcatatattttgttaactaaaatgatttgccactatgcgattctgcatggcacacatcttcacgttagagatgtaaaatgcatctattcactctcatcatcactattggctatgctcaaatgattcatgttcttttcaagaggtggaagcccatcttcagaatccgaagagttctggattttatcctcactttcaggtgtcgtaactgtccatgcaacagcacaaaatataaaacaaattaggataaaattcccagataatcttttctttatgatacaattttaaaaaaataccagctaagtatacttaaacgcatcagaagcacattcatggcttcatgtaccacttttcaagaaacaataaaaaaaaaaaaaaaacacattgacaactggcaagcccaactttctgttcaatctgcctttgaaaattgattttatgcgatgcacatacagaccaaattctgaaaaaatgagagataatgtaggagcaaaaagtttatgaccacagcggatatgaatttagtgacattacatttggatcaacaaaagtagagtcatggcttacctttcttgctgaataaatatacagacactagagtatgtttaacagataggagtaaaaggccaagggtgtgtttgatttccagtggaagggttccaaagatacgtatgaaagtaaaatcggtttggggtcatgtttggttacctctcaaaagtatgtttgagagtaaatttttacctggaaactgagtttgggagaagacttgggatatttttgcaaacttaagtttataaactttaaccaaaaatgcactaaataaaactgccaaacgaagatgaaaaaaggtggcacagtgcacaaggcttccatcttattgaatccagggttatccccacaaccagggaggctgtttccataaagggcaggcccaggtcacaagccagcaaacttggttatggccattggccaccgttgcataaaaatatatattaaatttacaacaatacataccttcactatcagtaggagcccttggaatctgactctcttgtgacagccaagcattttgaacagaaataatttcggcgctattttggcatttggagtaggccctcagtaattccctgcataaattaatataaaattgtcaatatggaagagtctatgaagtcacatgtaattgagacatttgtcaactgaatcagtatctgaaatggaagtaaaacaattaataattaaaatgaatttgtatttccttataaaacccttgaattaactttagtattatatagtacaaacagatttaattgaattgttttagactacacacttgatctcctaattatagcttgaatacaatcaattacaagaataatcaaggaactaattagaggctatttaggagttaatggcatgctaacttacagccttagaatcatagccaatcagtattatgttagacctccaattagagagacttacacacggaagactcacgggaagtataggctcaataggatagccaagccttataagatgggtctgttgtaattgattagttctgtaagaattgtgtaaatagaataggagagcgagggcattcggttagtctgttagaaagaggttgggggagaggataggctctcgaacattcctatcaggttctttctgtaattcttctctacctcaagggaactcattgtccccttggaggattcatcaataaaatcaccgttctaacattgctatcagagctctcaattcagggaaagattcatagtttcaaccagaggaatggatgcacgaattgaatttcttgagcacggctacaaggggttcatcaccgcacatgagaaattgcaagaattaagaatgttcgaggaagagaggcttgagcgaatagaaattaggaggcaaataggagaattaatcaaagcggtgaggggaatgttgaatagcggaggccacaccagtggcagaaataacagcggaacccacactaattcccaaactgcaatgagtggtggcggaaacttgaaattccaatctttgacggtgaggatacatatggctggacgagtaaggtggaatgatatttcaaaatgaaaggagtcaacaatgttgagagggtccaagcagcaatggtcgcgatggagggaaaagctctaacatggtaccaatggtgggaattatgtgctcaaaatgctaattgggaggattttaaagctgcagtgatatgaagatttcaaccatctatgattcagagcccttacaaattgttgtcgagtctcaaacaagaagggacagtagaggagtaccacaagcgattcaagttatatgcgggacctctccgaggtgcagacccagagtatctcagagggattttcctcaatggcttaaaggatgcagtgaaggcagaactaaaacttcatcaagtaagttatctacctgaattgatggattttgcataacgtattgatgaaaaaaatacattgttaaataagggtaatacatgggggaataaaggaggagggttatcaaggaattacacatcctcaaggactgttacttgggacccaggaaataaagggagtcagtttaagtcacctgagggaagttcaagtatggactccaatagtgtgagatctacaggttcctttagatggagaccctttaaaaggttatcagatgctaagttgcatgataaggccaacaagggattgtgttatcgatgtgatggaagtttggaccagggcatggtgtgccaataaacaattccaagcatttatcttgtgggggggaagaaggagaagaggaggagatagaaagtgaagcagaagacgaagggctcaagagtatgcagttgtccatgtatagcattacaaggttgacttccaacaagtcaatcaaattgtgggggagaaattgcagggactaacgtgctagtataatctactctagtaagagagagagaaattccagtgactacaaccccaccttacactgtagaagtgggtgatgggagggggattagatgtgaaggggtatgcaagcaagtgatcttgcaagttccaggattggaaattcagcaagatttctttatctttgaattaggaggagtggatatcatgttgggaatggagtggttggcaggatagggagagagtagggccaactttaaggatctcacattgaaggttcccacacctaatggtacacaaatcttgaaaggagaaccagctatgtctagatcagctgcatctttcaaaacagtgatcaaggcactgcaagatgaaggacagggattcttgctgaattatcagtttgcataaagaaatgacagacagctgcataccacaatacttggaagatattctcaaggagtatcaagaggtgtttcaagatcccatagcccttcctccaccaagaagacatgaccatgctattgtgctgaaaaaggggactacaattccaaatctcagaccttatcggtatccacactatcagaaaaatgaaatagaaaaattggtggatgatatgctgagttcaggtgtgattaggcccagcatcagcccgtatgctagtcccattattctagtaaagaagaaggatggagggtggaggttttgtgtggactattagagcctttaataaaattaccatccctgacaagtttccaattcccacaattgatgagttgttggatgaattgggaggagcaactatcttcactaagctggacttaaaatctagataccaccagatcagaatgagggaggaagacatccagaaaactgcattcagaactcatgagggacattaggagattgtggtgatgccattagggctcacaaatgcaccttccacatttcaagctttgatgaatgaggtattgagaccctatttgagaagatttgtcctagtttttttttttttttacgacatattaatatacagtaaaaatggagaggaccatggtagacatgtaagagcagtcttatccttattaaaagagcatcaactgtttgccaacaagaagaaatgcagttttggtcaaggacaattggaatatttgggccacataatttcaggccaaggagtagcagctgatcccaagaagctggaagtgatgtttgattggcctaccccaaaagataccaaggctttgaggggattcttaggacttacaggatattatcgacagttcatgagggactatgggaatattgttaggccactcagtcaactattaacaaaagatgggttttaattggagtgaggaagcacaactagctatggaaacactaaaaaaaactatggctgaaatccccatcctcacaatatgttgggaaatcgagagggtaaatattggagagatttacaccaatgggttatgagtaaccatataagtgaactagacaccacaccttaacccaaaaccttaaggctcaggtttatgggtcttatcctcacttatatggtgcttaacttttccttttctatccaatgtgggactttacctcacacttgtacttcaacaatctctccctcaagtgtgagtctctcccacatggtagcctccccctcgagcagaagtcattatcatccacgagtattccatggtggtcattagagttcacatgctctagtaaacttgtaccgccgcaacacttgcaagactcgctatctggcctccatgcatggactcacccgcctggaagactttcgatacaacagatctccatgtccatggatccatcgtcgacatctttactcgtccgaaccggtcaccaagtcgaaccatcggctctgataccaattgttgggaaatcaaggggggtaaatattgggagaatttacaccaatgtgtcatgagttaccatataagtgaactatacaccataccttaacccaaaaccttaaggctcaggtttatgggtcttatcttcacttatatggtactcaacttttccatttctatccgatgtgggactttacctcacacttctactcaaacacaatgcctgattccagtcaaaacttctgcatagagactgatgcttctaataagagactaagtgcagtcctcatgcaacaaggtaggccagtggcttttcaaaggcaaacattgtcacaagtcagtgtatgaaaggaagcttatggccatcgtcatggctgtaacgaaatggtgacattacttgggaggaagtttatcatccatacagattagaagagtttgaagttccttacggactcaactcaaaagggatgaaataagcttcagaaagaacaaaaggatagctatgtaaattaagtataaataaataaattacaatcataaattccaggtttgaagaaacaaagagcggctgagtacccagttgcttttctcatttgatgggcagggataaataaatgccatgttgatgttcaacttgtgctcccaaatgtatcagaagtgaaaataatctcaataacaaaatatataaatgaattatatcatacccattcagagacataaaagcatggccccatttgaacttgccaagcaacaaatttgcagttttttcttccccactgcaagatcatagtaaagaactttaaccatatagaattgagaaatggataatattctataataaatattaattcaaatcaagcaagttagcagtaatattatacatgccgcaaatgcaagaccaaattttttatttgaatgtttgtaattgttccatttacaaacccctttggagatagcatgatcatgcacatctctagcaatgacaatctagtagcaaatcagacaacaaaaaacattcctgacaccaaacttcagttattttttgaatttttgggcggggaggagggggtgaataaattatagaacacaccaaagaaagaaaaaagatatcctctagttagtagccgcagataaggccattttgtaccatattgtcaaagcagcagataaagcctctacacaagatagctgacatggccgaccataatttactggatttgctgctacaagccatggcactgcaataaaaggaaaatatgaaaactaattattgttacattgcattccatgtcaaattgtcaatagaggcaacctttaaacaaggcaaaaaagattaaatacagtggtactaggagtttttaagcatcacagacaactacaatagtacattagtacttgagccaagcatggatatttccatagactaacatatttgaaagtgtacaaacaaataagcatgcaaaacaaagtatataaaaccaattttgaatatattgttgtcagtggttaagttcatacagaggcgaggagcagtacaacgcagcctcacgaaaggcacatcatctaagcgtgcccatgaacaatccacaacagctaatcctttcttctggattaaagagtaatcttctcttgagacacattgatttccagcaggactgtcaacagaatcacagtaaatcagtaatcactatttggaggggagaacacaggaactcgcaatagatagctacttaacagtcaaaagagaatgcattgttttagaagaatagcatcgtaatgcctaattggtcaggctgggaaattttggcttcaagaattgcttccttaaaaaatgcttcgatagaaatgttgttatatagaaacaactttatgtgaactttgtttttcttcttttgctttctatgagaagcaagcatcaattgcttgcttatctttagaagatttttgcctctcctgtcataaacttctatactgtgatcaaacacctcaaaaaatcaaaacatgtgtttttcaaactaaaatatagctttatcaattgcatagcgttgtaacaggttcttaatgaagggattagtaggtgttagtgctacaaatgcattaacaaccctaatagtgaagactcatataaggttctaaccaactacctacagtccaaagccaaaataaattattatcttcaatgattagttatcatccattatttgagaaaagcacaaaaactaaatactcaaccaaagagctttcaagctgcagtaactttaacaaaataaattatattgcgcgaaagagacaggtaagcaactacacaactaatagaggcagaagccaagaaaatgccctaacaactagtagatgaaaatcatgaaccagttgacatgatatatcaagataaaccatgttcaggcaaaagtaactaacattttcttcatgcatatagtaagaagaaatatagtttccaacaaaataccttaaaacaacgcccccaaaaccattactcacacgtaactcctgtataaaatcaatcaaaatcagtactactaacatattaagctactttaaatagtgcaatttgaccttcatagaatataaagtgttatttattttatttgccaaagaaatagctaaacctaatcatgacaacaacatctaacatctaattaactcagaatgtctcagatacaagatatatgcatacatatttatatttccaggcttatgcttatatatgtaaatatgtatgaagtatgaacacggtacactaaatcatgtgtgcaaaagataaccatagaatgaacaaaaaagaaaacaaatacttgcttttagcatgcccaatcttgaaagcttgcgtccagtgcaccttttggcatcgcattgcccaaaatcctgagccaacatcacaaaccccaattacatccaaaatacaaagttacattacatgccatatgaaaattagatctgaattcagagataaaatatacagtaataccaaacaaaattgaaacaacttttcccaatataattttttgccaacagaaataggagcggaagcatgacagaaatccataaaaaaatcttattattttttatctaatgccaactgattagttaccataagttttgataaaaatgaaagaaagaaaaatgaaacttttttaagaaacccaacagtaaataaatagacaagaatggattgctagaaagctcggttaaattaaaataagtaaaacggttatatgcatacccacattgcaagctttatttttggttccgtgagctcctcctcctcttcctcgccctcaacattttctgctgttagaaacaacatatcgtgttttgtttgaaaataaaaaaagaaatttgaactaaaaaaaaagatggaatcgaagagtacctggaagagagctttgagaatcgtcctctctgaagtacagttagataaataagcaaacccgcgtaaataggaatcaaaaatcgaaagcgtaagtattgggaaagaagttacagtaggagttgttggtggtggtgtcgacttgattgtgcgcgatgagttttgaatctcctttgtctattattccccatttttgcgaaaggaaaattggtcaccaaccaacgaacgcgttactgctagctgcttctgctatttattgttttggctctcccgaatcagccagaggggtttagttttaggtctttaccgacatggcaacagggcggggcgggcgcagcgcctttaaaatccgtttccgcccccgcctccattttctattgggttttaaaattcagacttatttttgtctttgttggggttgagttttccctgccctatgcctgtttcactcctattattaattaaaaaaataaaaataaaaaataatgtgactttttttttgaaaaaaatgacaaaaaagttgactaggtaacaaaaaaattaataacaaactcacttcaaaatatgagatcataatttaaaaattattaaacaaaatcaatcaatttaattaaaatcattatggacctacatatttaatttctcccaaaatataatatcatttaaatatatattgttccaaaattaaaataaaacacaacaaagagtagaggtccattgcagtaacaaagcttccaaaatggaattaattcagaaagttgttggtcaaggttcagcgtcgtcgagaatgagaaatgaggaggagggttagggtttcgggattttattcttatatataagggtaaatttgtaatttaattatggcgggggcggggcgaggcgggtaccatcattaccaaactcgtcctcgtccccgaatttttgtcgcagggtcggggtgagacgggtatcatcaataacaaatttggtttttccccgttaaaatcgggacgagttttgacgggtacttacggactcgaatctcgttgtcatgcctaatctttagtagcacataaataatataatacatatctaatttattaaagtaattgttattaaaggaatcaatatttatatgatgaatatattatttacaaaaatttaaattatattttgtgattagtaaaaataaaataataagatgaaaacttatgggatgcaaatttgtggataaaaaaaatatggtttttttactccattgatccataataattttttaaattttaaaaaaactaaaaccaaaaaataaaatactcaaaagactaaatgatattttaatcttattaaaaatatataattattttaaatcaaaaaaatataaatgataattgtgaataagcataacaacaatgtaaagcatggacgtgcaagttgttccattttttattccaactaaataacattaaaaccaaaaacaaaaacaaacaaaagagcaaaagagcaaaaggcattttaaatatgtcaaaatctataattatttaatatatataagtgattattgtgaatagacatgatatcaaaacaagacagaaatgtgaatatgtttttcgttctcatcttcattctcatttttgtctctatccttgatttctatcagaaataaaatttcatacccaccttcattcttgtgtgggttcaagtatatttgctatcttcatatatctctactaaatttttattattttacaataatatatttgtagatattttaaatcaaaatttagaataacttttagtataagattttatttatgaaattatttaaattttctttataaaatttctatttaaaaatcattttataatttttttaagtaaaaaaaattatatttatattattttttactatcaaaatcttaaccttatcatacaaatattaattaataaaatatttatttgtaaaattatttaaacttattttatatgatttttaagtaaaaataattttataaatttttaaaataaaaatgttaccattcaaaattggatatattggttccgtccacatccttccactaaaaatgattattatttgaaaataatatatttgcaatctaattttaaagaatagatataagtataaatatgaaaagaaaaaaaaataaagagagagaaagaaaggatagaaagaaaaaattgaatgatagttacgtgtatcttaaagaaagataagtatatacatatatgatagattaaataaaatgtttattcatattattttaaaatatacataatataatattaaaaaaaatatttaatacaatacataaaaataatatgtaatatcataataatatgagagcatctttagtaatatatctcaaattaagatcttagattattttttatggtcttcatagtgtcacatgaagatttctctcactttatttttagtgatagatttaattttgaaatcttagagaaagaatttttttttggataatgtgcatattttgaaagttcttctatcataactcattattcaagttggagatctcctcacattttttattagaagatttagtgaagataggatcttgagctcaagatctaacactaaagatactatgataaattataatatatatttacatatttaataataatgatagagggaaaaggtgaaaaggagtctgtagttgttgtgttttttaggaaatagaacagaaagaatctaaaaaaggaaaagcaaatgaggtgttatagttttggaagaggaaaaagattaaaaagaaaaaaataaaaaggaatagagaaaaaagataaaaaaaaaaaagtgaaaagaggtagagaaggagttttggaggggaaacttttaacaaggtgtttgatgtgttataagaaaaccttgttttattaatagatatatagatatagaaatggatgggtgctcattttagtatcactcttaaattatttaattagaaaataataattattggtgaaaaattagaaggatgaattttgattaatttctgtaaaaaaatgtagcattgattattaatatttttattaatgaatgggatttaaaaaaaaacatatctaggaaaaattttaattttaatttctacaaatgtagaaaataataaaaggagaattttatctattaaataagaataggttatctttttcccttaaaatcatggaacattattatagtaattatgaaattataaaaatgacaagaaaaaataaaaaaaatatattttttgctcatcaaaatagtttttttgattaattttcctcttactcttgtaacaaatatgtgatataccaccttttttgttacattaagagtcatgtgactatttagtgattgacattgtaatagagaccaaatctaacaatttttagaagtaaaatgacattaaatttaaatcacaaaatactaatcaagttggatagaacaattgtctatcatggttagtccctgtcaatgaaatgtgaaaaaaaattatgacacttatcaactctcacattcattctccacttacaaacttacatgttgggactcaccattgataggcatttgtcataattattagttaacatatttagtatgtatcccattaacgtcgttttagtttttaaagttgtctattcaatcccaattaatgtgttcataattgaataattaagtgatatgctcacaacacatgtggccactaaagtgacaaataacatgatacatcacatgtttactaacaaagttggtggatgactaattataaggactaacttgactaacaatttaaagggtttatttgtcattcttatacttataagtattaatatgacaatatttcacaagtttaaggatcaaaatgatagtttagtcattcaataattttgagtacgagtatgaatttttatttcaaaatttatacgggattgagtttgtacattagtaagttaaaatgtatctcattccacaatcatgtggagataaggaaatgtttcatttatccattttatctcttttttttttattgcattttcaacatggtcttacttgttcatatgattgactattagacaatctcacacctcattgataatgactttgctcgagccaaaattatggctaatatttaacattaactttgtcctaatggttcacgtaagcctttgacgctaacatggaccatcctatcaccttctataataatatggacaacccattaaccacatactatctatatgaaactcttaacaaagtaagttgttttacattagattcctcatcaaatatatgattaatgatatttgtcccactaatttatatccatttggacacttggttaattacttatgtaatttctcacttttacgctcttaattctttccctaatttttatttgttggaaaaaaatatttttagttattgtattttgtaaagattttgattttgatttttgtgtttcattaatcctaaaaccagatactatataaaaaataatattaacaatatctacttatttttaaaagtttaaaaactaaaatattcgatgataaagtataaaaactaaaattaagaattttaaaatatataaaaattaagaatatattttattatattttattttcctatttttttatattttttaaagattacttattgaagattgtcttgccattttttattatattatataaaattgattttaatttatataaaaaaataacaaataattttgaattaatataaaattttgaatatatgatttatataaaattaatttttaattataacgataaatttttaaaaaatattattcaatcaaaaagttataaaatgatataataactattaatattatatcaatataatctgattcctcaaagtataagtattattttaaaaaagttttaaaattcatcggtgttaagttaattgggtgttgtgtggcgtcaagattccgggtcggactaaaactaaacgggccacacgccatacgatcaatttctaaacgcaggacaagattggagattagaatcacaaactgcaaaattgttgtgtgacttgaattgtgtagccaaattaaggtcgtaaccgtagttgttgtatgagtatcaggggcttggggaacacatcattccctccacactcccactggatcttcactctcaatctcaacacaccctcttcccactgccatgttccacaggtaccctacgcctatccaatcgaatcttttttcattcctttgatttctctaacctcactttgctgtgacgcgaactcattcttaggtccattttgcaaatatcatctcgcccagctcttagaaggaaccccagacgttttgtataccaggtacctacctgttttcaatgcaattaattgatggaatatagtggaggaaacaaatgtctaatccgggcactcaaattgcctttgctcattacccatatgttttaatcttttcaaccattttggtctttacccttaacatgtagatagttctgctacaaagtactttactagttaccaaagaaaaagaaatgcttagcacaaatagtacaacatccttgaatatttgaagatgggagattactttataccattatgacgggattgtcactctcgcctgaatgtatgtcccctgttgccatgttgaatcgagtcgaaaagcattaagcactcaagtgcagcatctaacctatctgcatatttggtgtcttcatattatacattgaattactgcttctaactaacaaaattgctagtattaattccgtaataacaatctgtggcactgaatattgtgtgataaaatatcaacaagagaataaactcaactagaagaaatgagaatgttgcattggatgagtggacatactaggcaagataggattaggaacaaatgcattagagagaaagttagagtagtacctgttgtagaaaaaaaatggtagaatgtcatcttagggtgtgtgtgagaagatctgtagaagctccaattagaagagtagattggatggagggtagctatattactaaaggcaaaggaagatctagaataattataggtgaaactattagaaatatttggaggtcaatggtttgtctgtagacctaattttgcaatagaatggcatcatttaatccaaatagccaaccccacttagtggaaagaggcttggctgttattattataacacaatgttcgatgaatttatatgcaaaatgtattgcaaaactggtagtgttaccacttctcattgcttttgtactaaattgattataggaatgtaggacaggaaagtgtagttgaaatacattctgcttgctataaaattaaccatatactgtatttatgtgtgctaggaactgcttaggttgttgatttggtagtgcttatctccaatttcaatcagcttcatatgttacatctttctaattcattacccttcttttctttttcacataattcagcggagacctttacatctatcttcacaaaagaatttctcaactacatcgaaaccagggggtgcctcagcttctggatctccgggcaagccacccaagtctactggcactctatcaaagtttttcattggaagtgtagctttaggtgctgcttttctggcagcttatcagacgggttatttggatcaatatcttaagaaagagcattatagtgttctgcaggaacctcatgtcaatgcaactattgaagacttgaagagtgtacaacattcaacggaccagttaatttcacctagtgagaaatttaaccacgaaaatcccactgtagagattacagagcaggagattgatgcccatttttcactgccagaaattgtagtagaagaccaagtggataaaccgattcctgtgcaagacaaatctgatattgctgaagatgttattgctgctgccaaagaaaaccaattgcctgaacatcctcaaagcagtctaacatctgatgatccaagtaaagaatccgtggcacaatctgatgggattattggaatacaaagcactgagacagacaatgcccaaagactggaagagggacatcatacatccacatctacacagaccagtgcagttccagatgaaaatgggatgaaaaatattcaactagagcaacttgaaatacaagacacagagagaagagaggtacttatgagtttttgttggcttgatatacggttgtatcattcagttattccctagcattcaccaaggattttttttcctgttattttttttctaaactgaattttgacatttatttctttttaatatatttcctttgttactccattacagagtgcattaggcaatggtgtagagcaacaacctaccctccttgaggagtatcagttaagaaataaatcagaaagaagccctgcaacgtatatatctagtcatggctttactgagaatagctgttttcctgaaggaaaagaggttactttagaatcttgcttatatttttcttttatgtgtggtacagttatttatgatcttaatcatacatgaaaactaaattgttgaaacactaggcacttagtggtgcaatggaggagttaaaagatggttacatttctgagaatgggaaactggttcttgatttcttgcaagccatccatgccgcagagaaaaggcaggctgacttagatgcacgtgtttttagtgaagagaagaaagtgttaaaggtttggcctataaattatcatcctttgtaacccatcctctaaaaccatgcaaacgtgctttgtttgtagcttttttggtttattcatgagctttgaaatctttatttttacttgaaactttgttcatgttaggaaaaatatgaaaagaagttgaaagatgctgctgccagagaacttatgctcactgaagaggctgcaatgttggacagggtaaaaatctttttggtcttctctttttatttatttattcaatttaacgtatttttgcttgttgatttttgtcttaaatacatgggttggaataatgagtaccaaagacattgagagaggttggctctgttatcagaacaaagaataattcctgtttaagtggtgatggttgatgggtttgttgttcaatgtatatacatttaactcaatcatagttatttactcttgattcagcaaaatagtttgtattaaaattgaagctatactattatattctgagtttgacttaataatggtcacacaaaataatcagattccaatttgaactcagtctgtcagatttattttgtaattgtgaagcttgtccattggtcaagttgaatgatttctttgatatgtgctgtttgcctttccctggctgtttctgcccagatgaatagaatccaaatctataaagttaataactctctatctttcctcctttttcattttaatacttttcaggagctaaagagagagagagcaaaagcatcccttgctatcaattcacttcaagaaaagatggaagagaaaatgaagacagaacttgaacaaaaggtgctcattttgttttttgttgattttacaagtactgttttcccactttctctacatgtctgctgttactgttatcagttacgatataatacttgttaaataaaatatatctttggtaattgcaggaaattgaagcagaattgaagttgaaacaagctcaggaattagcaaaggcagagttaaatgcagccatagcaaatgagaaggcagctcaaattgaaaaaatggctgaagcaaatgttaatgtgagatttctgttaaaatcaaagatgggtagatgcacccattttaaattattcatagcttgatttcaattaatttatgaaaagggatataattttgataggtggcttctagaacaataaaatagccagaatagttttatgagtataaaaaatttctggagcaacttatacaaagactagctttgtcaaggtctaacaaattaactcatgatgtgcaaaacaatttccagttatggctttagctgtctcttgcaatttttatcagaatattgccaattagaactctgcttagtaggcaggtgcattcttagtcatcaatgagtttctgaacaaagtaaaagtttgtttaccagtatattaattggtatagtatgtaatctaccagtgttaggatccaaatgcaagtgcaaacagcaaaaaaatggtgttccttcatgtattagtgatactagggaactgctttacatgctgagaacccaaataacatcaaatctactatttgtttgagtctcctctggtttgtggtagacctttctgtacatccaaagcaaaatgttgtataaattgtttgcagataactttcagtacagatgcttatcatcctgaatggaaatgtgaaatgtaaataagtgaatttcatgccttcaaatatttttggtctacggactgtgttggcttgtcaaaggatgaaccataccactataagtttacatttgattgtgctggatatttattttgtcagtggaagacattattttcttttcaccaatatgtgttgttagacaagtacagcatgtctgccttaaattattgggaaaaacgcctgcttatgcaaacttaagcttctaagaattgatcaggaacattcatgttgaaaaggacaaaacactgggtagacttttgatagttgcaaaattgacatcatattttagccagcaattggaatttttattaattgacatacctgtggactttatttagttaaagttgaaatttgacttgtttaaaaaatttctttccctccatttctgtagataaatgccttgtgcatggcattttatgctcgatctgaagaagctcgtcaaagtcatgctacacaaaattttgcactggtaatattttttctttctcctgtttctttgtgctgtttttatctgtctttggccgtagaggagcttaatgacaaaatatgggtttatagtattgtattgatttttccaatcctgcttactattttcttttttgtgcatggatcctgcggagagcacttgcattggaagatgcactatctaaaggactgccaattgagacagaaatagcatctttgcagtcttatcttggaggtatagataaagattcagttttggatttggtgctagcatcccttcccaaagaaacacgaagcaacggcacagacacacaactgcagctaaagcagaaggcaagctgtgttcttgtctgtatttaactttacatggagttttttgtattacatgttctatataagattgctacatttcttcaattcttctcaagttgttattactttttgaccttgttaaacttttatttgaatacctgctaaaggttatattctctggatgcttatagcatggatataagtccctttaaattggtttctgtaatttccatcagttatcaatcccatctgttatatttttgacattctttaatgctcctatcttgtgaagctgccatagtgataaatttgtacaaaacaattagaattgaccggtgaagcaattctggaattacaaaaattgcagtttcctgaaatgcacttgtctgtttctaaaattctagaatgaatcatttacttttgaatttcagtttctaatttttgcgttctgttgcagtttgatgccttaaaaggtagtgtaagacacttcagcttcttcccaccaggagggggaggtatgttggcacattctttggcacatgtagcatcctggttgaaggtatgtaattaactgaccagcatgccatttccatttaaggctgtgctttatgtgaaaacaaaatttatgggagaagtaataattggtggccatttagacataatacacacttcgatacattaactctgtttatttctccccttgccctaactcgtcccattttcatttctattgagctcatcctaagttcaaggagagatatatgtttgactttggcatgtactcaggttagggaagacgatcgattgggtgatgggatcgaatctgtgatcaataaagttgaagtttatttggcagaaggaaaacttgctgaagcagcagattgtctagaagaaagtgtaagaggcacacaagctgcagaaattgttgcaggttgggtgaggcaagcaagaaacagggctatttctgagcaagctgtgctgctgcttcaatcctatgccaattcccttagccttgcatgattctcgaattttgaatatttacaaaatcatgttgattcaatacaaaaggttgcagagattatctttggcagattatgccaacgggaattattgacctacgaggaaaacaattaacgtttttgtttcatagcagcggaaattagttgattctgtgatttctgtgcaactccaatggctttggagttttgactgaagtgatatcaggctctgtataattttgtcttttgttttactgaataacagaaatgttgtattgcaacatattgaaatttcaattatatacctcaggcgatcgggaaaaggttggacgtcacatgttcatctttgctttcaattaaagtaatggttattttacttatttattattattttttgagggttggggggggggggggggggggttgaaaattatttagtaaattgatggtaaagtaaattattgaaaagcaaaccagttggagtataatttatatgttaataaatattgttatagtataaaacaaggatattttttaaatgggattgaagtaatatgcatgataggttagaacgattattgtaaaataaaataaaaataaaaatcaagacctttaaaaatagacccaatacttatatgtttcttacatttttaattacacagtgctccttactttaagaacttacgtttgaattttaggcatgctctaagtggccttttaatttctgaaatgcgccatttcgttgggaggagagcatcattgatgcgaagactgacttgatgatattctctcatcctaaactattgaattatcactaattttaattttcttgcagtgttataagaacatctttaaaaatttatttatttttaaataatgtatatattttaagaaattttttacaaaaatctaatttttacgtttaagatctcttcaccttttttattgaaaaatctagtgaagatcagattttgagtttaaggtctttgttcaagatctaacactaaagatgttcttagtagctcacactttcttagcactaacacaagagaaattatttaaaaaatatataatttaagctatcccatataaaattaaataaggtataattgttttttgggttttcttttttattaaaaatatgtatgcaagttttaatgcatataactatctctatacatattcgtattagattatgtcaacccaatcccgtgacctaaaatttttgtgtcgtgattgtttcttcattctattctactttcatcctaacaaaaatgagaataagaaaaagactccaaacctactaaactaacccctgccctggcttgacgtagatggatttaattcgggtcaacataatggaacaactaatcaatgctatacaaagctattgaattactttgttattgttgtttggtttaagtacttatcaacgcaaagtcatatattttgtattatggattgctataacaaaatagaaaaaaaaatcattgtgccaaataaccgttattcaaaagcaaaaacagtataagttaatgatgtttttctttgcacaatgactagaatgaaatttaataagacttcatgcatattatcttaatgaggtttgatcaacaaaatgaacacttactggtttaattgtgctatttatataaaatatctacaatagtttttatgatataatatttttattttatttttctccattacaacaataattttatctcacatttgttctctatttttatttcctatctctttcttattgtataaatttttgcataaaaatgttatataaataaatattatttttgcaatttgcctttaccataagaaaaggtgttatcagggagaaggacttctctttttctttcatattttaagatgacaattggtttgaactagcttcaatagtcatatcaatattcatggtgatagaagcagacaaaggcataacgttatattcttcttctacaaatttttcagatgctttgtaagtaaagtatcaaataaaaagaaaaggcaaataatggtttaaaaatataaaaaatagttaatattttctcagttttgctagtaggaaagttaataaaatgttataaagaatttagaattgacaaaaacatttgttaagaaactaaaaataggaaatattaaaaaatactatgataccctctcaccataacatcccaacataatttttaataaaatattttatgattaattcatttcttatgttagcgagatcctaagagaaacattcatttattatcaaggtcatgttgtgtagctgaatatagtaataaaaaaaaattggtactagtcatactattgttgatgattactgacttctctgacatttttcttatcattatttaatttgctttttagttttgattatttgataaataaacttatgtaattagcattaacattcttaaacattttaagatatgataatttttttagtattttcaaaaattccatacgaatacttgttaaagcaaaatcataaaaaatattggtcgcatattattattatcattttagaaagaatggtataacaaggagacatcctcaaactaccacggtgccaatgatatgctcgagatgtcaacaaagatttactaagaaaattactacacagattcgagtcgttaacagttttactcaaatgcaactattcaactaagtgacaaagatttcctttcacagagttacacatcaaaccaaaaaactatgttagagttacacatcaaatgaaaaaactatgttcacagaggaggtgaaaattcataccgaatcattaatcacttgggtcaatcacattgacattacaagtgcaatattaacattggttgcttcgtttttctatttttaatataaaaatataaactctggttgattgttttcaatcattttgtacagaacaacccccaaatgttttcttcttcttcttattattatctccaactccggagtctactatctcaatcactggtgctaagtggtgacatttcaacttccgttaatattagtattttagggagcagaaaaacgtaagccctcttcataaaatgtaaaataaaaatagaaagaaggaaaaatagaaccccgcttatttagggcttgtacttacattgtgtttgtttaacgaactaggatgagattattttttattcaactcattcaaaattttaataagaattaatatttatttaaatttaaacttaattcgttaaaactcaagaacatataaaataagattgaataaatttgatttgttaccataatatattaattttaacataatacataattttattataaaatttaaaattttaattaatatacattttataatatatatttcaaaataaataatattaatattgttttgagatgaattaacggtggatggttgcataactcctctgacgaggttctcctacggatgtgtccaactatttgcatccatatccatatagactttgcatacttatagagtctctagcactcaaatattagagtttgacagagtaatgacactatggttagattgtgtatatgatttaagtggaaggggtcttatttatctagtgtttttttctaaggtcatagcttttaggtgataatgaatccatcctttctgttaagagcgtgaatttcaatatgcaatattagtccaattgtatacaaaaatttgcagctgcaagaattctttggtgtcacctaagccgatatgatatgattaataacaatagataataatgtaatgataatccttatgacgaaaactattaagtgatcaataaaagaagttataaacttcttttgtcaatggttagctataaatgcttggctttgttatttcttcggtataaatataattataatattacgttatataaaatattatttattaagtcaataaattcaattattaatactaaactcaaaatactaaactaaaaattaatttataataatcttattcgattttaacaagaagaaaaaaaacttaatatatgtctctaattcgtaaatctgctttgcaaacctaatgtactaaattgagatgagattagtttaagaaaataaaacatataagtgatgagattcttttgatatggtagggggtcccaatcataagagggatattaacagcaaatgtttaattatatctaacctcataacttgccacttcatattccagcttgtacaaataattataatttgcttgtctctctctcgtggctaataataacaccgtttttataataaaaaaaaatgcttctcattgtattttaggtaccaaaataaaactttgtactagtattttgttaccgtaagttgcgtcaactgtcctgtcctactctgcatcaatgcattgcaggtgtgttatcgtttacgaaaatcataaaatgtaactccattttttatgaaagaaaatattgcatgtattatgtacctatttatatttcaatcaacaaactaagcacgctgaaaaagataataactaaggaaaaaaagagattgaaaattgagacaaatctttaatgatatttcatttctggttggttagactttttctattttcttttaacatgtaagaatcgaagataacactaaagaatttattatgtttaatcaactgaattaaattttattatctggttagacttgataacagtattatgtttggggctcaactcaaactcaaacccatgtgatgaacagttaaagttaggttcatcgtagatattgcatttgctttggtaccaaggcacactaaaaaatgagtgtaatatttggtgataaattaacatataacttgacttgaaactgagagagtacgcaacatttcaatctcacgaaaaatagaaaatgagacttaaaagaccaaatttatgttaaagtagagttgttgcattatattccaatgctaatcacttgtccatttgatgagcaggagacctcgaatgcaatttttagcaacacgttgacttctagtttgtcatgggctctgaaacaacgtttgagtttattagacatttgcactttttgggtatagagcgatatcaatttttgtatcaaataattgttggctttgtatttaactatataacatatgtctatttacctttggttgaggtctacattagatacatcatgtacaaatgttttaaagaggtgaaatcatcggttgactattcaaagttttcttggttatattttatgtaaatgttataaagagattgaatattgtaattattgactcataatcgagattaaatcttaaacaacatgtttttaaggaagtcaaatatgatattcaaaatccaactttaaacacacacacatatatatatatatatatatatatatatatatatgttttaaggaagttgaatattgtacttaagatccaactttgtttatattcgatcatatgttttaaggtggttaaatattataataaagtctaacttaaaatatatttaatgcatatattataagaaagtcgaatattgtagttgagatattttctatttttatatatgattattaaaatcatttttttcattattaaatatttatatagaaaatattttattattttatttttgttgagaatttggattgattcaattttaatgtaaaataaataaatatacaacaaagaaatgcaaatataactgtgataaaagagacaaaagaaaaaaaaaccagaaattgttataaatctctgttgtatgaacaaacaataaacttacaaatttagattaaaaagcaatttttttaacccatggacctagtagtggagcatgagacttatgtttgatttatcattgtaaaaaaataaaaaataattatttatatataaaaaaaataatgaaaccaagcatattgaaaacctttcatctccaaaatttgactcacgtggagtgtgtgaagccgacgcttagctgtcagctaataagctttgctatgaagctgaagtagccactgtcggtgctccggtgacggcgagatcctcaaaaattccccaaactaaaccatcttgccctcaaaaacacttcctatccttccatcacattgaaaagtggaaaacgtaagacacaacaaaagtaaaaataaaataaaaacaaaatagaataaaaaaagaaaaaggtacaagcaactacatttgttcctcttccaattgtgtcgtcttatcttctacgaaacccattcatagatgcatgtgatgtgcaccttcttcttcttcttcttctattccactcactccctctcacaccattgctgaattcttcaatattcattcactgtacttaaccatattccacttccacccataccttgcttacttacttacttcgatattggatctgaatgaaccaatgatgctttgtctcttccagatctgaacttggttcaactcaaactgaacccaccatcactatggccacctcactcgcttggagactctctgccaacaatggcaccaccctagccgcaaatgatcgggtaccttcttcactccagtttcatctttgtcttctgttgtttgtgccattactcatatcttcactattttattagttaaggtcaaaagtgttgtagtcagtgtttgcatggggtggagtttatggatcttgttcccatctggttgcatctgggtattttctgcccattgctctgttgagccaatgttttactctcattctgtactactgtactggatatctgacaattctaggaagtattatcgaggatcactcattattggaagtttataagaactatgggatttaattatgcaaatattaaggatttcctttttgttgttttgctgatgtgtgattcgtatgttaatttgtccccaagaaagtagaaacatgtttgtgactgttctacatattgaggtgtgtacactttcatgattgtagcatgattaaccgttcaacagatcttgtgggatgcagggcgtaggtaaaaaaatggaaacaaaggatggggtttataaaatagttcgggcctgtttgtgtactttactgaaatgttcataggtttgttaagatatgtggttctttgctgatatcttaagttgttgtacgattttcactgctcatcaggtttcccttatgttttgctcaatgagatgcagtactaaaggatcaaaaatcaactgtggtgaaagcaagagcaacaaatctatttgtttagtactctgaatgttttcattttcttgataagaaatgcaatcaaactgtgatatatattggttcacctatcttccatttgaacttgatgtcccatttcatctcctctttattttaggacatattacttagttatccatccatcactggctttatgctattcctctgtttgtgtttgttttttttgtttccaatgttttagttgaagttttcagagatatgctacataccttgccatataacattccctagtttcacccttttgattgcaggaaagaaatggtgacgggaggactcaagattcagagccccctactccacattctgttatgaaaatgggatcgaggttggttacagcttaaaactcacctaaaaaagttgtcacactacaggaacagtgtgcaacctgataaaattattgattaattgcttgcaatactgctagaataagtgattgtaataattacttgcagccaaacaagctaacagtctaacccgtgagaatgaactaagaaccatgtgaattgatgctttgatttatggactatggacattcacaaatttgtgaacagaaatttgtgaacaaaattttggtttcttacatgttttactggttgcttttgcagagagcgtaacagcagcatggaggatccagatgggacattagctagtgttgcccaatgcattgagcagctgcgtcagaactcatcttctgtgcaggagaaagagtattccttaaggcagttattggagcttatagatctgcgtgaaaatgcttttagtgctgttggatctcactctcaggcagttccagtacttgtttcccttctccggtctggttcattgaatgtgaagatattagcagcaactgtcttgggctccctttgtaaagaaaatgagctaagggtgaaggtcttgcttggaggatgcattcctccattgcttggtctactaaagtccagttctactgaaggccaaattgctgctgcaaagactatttatgctgtctctcagggtggtgtaaaagatcatgttggttcaaaaattttttcgactgaaggagttgtaccagtgctttgggtgcagctgaaaactggcctgaaggcaggaaatgtagttgaaggtttattgactggggcattgaaaaatctctccagcaataccgagggattctggaatgcaacaatacgagctggaggagtggacatattagtgaagttactggcaacgggacagcctagcagtttagctaatgtgtgcaatttacttgcttctgtaatgatggaggatgcatctgtttgttcaaaggtgttgacagcggaggtgacaaaacaacttctgaaactattaggcccaggtaatgatgactctgttagagctgaagcagctggtgctctgaattctctttctgcccagtgcaaagaggcacggcgagagatagccaatgctaatggtattcctactttgatcaatgctaccatagctccttccaaagaatacatgcagggtgagtgtgctcaagcattacaggagaatgctatgtgtgctctagcaaacatctctgggggtttgtcttttgtcatatctagccttggccaaagtcttgaatcatgcacctcacctacccaaattgcagacacattaggagctttggcatcagctctcatgatatatgataacaaggcagaatctaccagagcatcagatcctttggttgtcgagcagacattactcaagcaatttaaacctcgcttgcccttccttgtacaggaacgaaccattgaagcgcttgctagtttgtatggaaattccatactttcaaataaacttgcaaattctgatgcaaaacatctgcttgttggtttgataacaatggccgccaatgaagttcaagacgagcttataaaagctctgttgacactgtgcaaaagtgaaggcagtctatggcgtgcacttcagggacgtgaaggggttcagctattgatatctcttttggggctttcatcagaacagcagcaagagtgtgcagttgccctgctttgccttctatcatatgaaaatgatgaaagtaaatgggcaattactgctgctggtggcatacctccacttgttcaaattttggagacaggatctgcaaaagcaaaggaagattcagcaacaatccttaagaatctgtgcaatcatagcgaagatatacgtgcttgtgttgaaagtgctgatgctgttcctgcattgttgtggctattgaagaatggaagcccaaatgggaaggatattgcagcaaagactctaaatcatttaatacataaatctgatactacaaccattagtcagcttacagcgttattgactagtgatcttcctgattctaaggtttatgtcttggatgctttgagaagtatgctttctgttgctccccttagtgaaattttacgtgaaggtagtgctgccagtgatgcatttgataccatgataatattattgagctctaccaaagaagaaactcaggcaaagtctgcatcagctctggcaggaatttttgaaacaaggaaagatgtgcgtgaaagtagcattgctgttaaaactcttttgtcagccatgaaattgcttaatgctgaatctgaaagtatcctgattgagtcctcacactgcctggctgcaatatttctttccatcaaagagaacagggatgtagctgctgttgctagagacacattatcaaccctagttgcactagcaaactcttcagttttggaagttgcagaggtggccatgtgtgctctggcaaacctcattttggatagtgaaattgcagagaaagctattgcagaagaagttatcttacctgctactagaatattatgtgaaggcacaatttctggaaaaacccatgctgcagcagcaattgctcgtctcctgcattctcaggatgttgattatggtgtaactgattgtgtgaatcgtgctggaactgttcttgcattagtttctttcttagattctgctgttaatgggtctgttgccacatcagaggctctagaagcacttgccatcctgtcaaggtcagaagagaccagtgcaaatattaaatctgcttgtgcagttttggctgaattccctaaaagcataagcccaatagtcttgtgcattgttgattcagagccaacattgcaggataaaacaattgagattttatctcgattatgtaaggatcagcctgtttttttaggcgatactatcatgtcagcacctggatgtatatcttcaatagctaaaaggataattagttccacaaatgtaaaggtcaaaattgggggagcagcacttcttatttgtactgcaaaagccaatcatcaaagactggtagaggatctcaattcatcaaacttgtgtgccaatcttattcggtctcttgttgatatgcttacttctgcacagccttctttgggttacctggatggtgacaagaaggaattcattagcatatgcaggtacacaagagaagaggtcaacggttgtgaatccaacactagcaccagcattatatgtggtgctgacttggcgatatggttactgtctattcttgcgtgtcatggtgaaaaaaataaaattgcaataatggaggctggagcaattgatgttctcattgacaggatctcaaattgtttctcacaatattctcaggtatttaagtgcctttttcagtaaatccaaagaaatagttagtctatttgattctgaccataggtaatacttaatagggaaaatcatgctttaacccctccgcctcccctccctctgaagttttgtccaaaagaaactttagtgcaccaaattaaaatcttacaattcatgcaatgatgcaaactttcaaaatctctcaattctcacttgtacagaatttaacaagttgtatttgatatttatcttctgaaacataatggttggagagacactgaaatgtgttcaagacaatgtatttttgatgtaaaaaatggaaaatgaagtgttaggataggctatgtactcttttaggtgaatctttgtcaaacacaatgatcaaaactcacaagtttggctaatgacgtacccgttgtcagttttaattaaattattatccactatgatgttttatgtttcttttaggatttcagggggtgggggtgacaggttgtatgtttcagaattgtaagctaagttaatgtcttaaacttgatttagacaaaattcatgtagataagctgtaattttccccagtaaatgtttacttctttgctaagacatccttagctgtaaaactgaaacaatgttgctatatgacaattatttttgtatataaactttgttagctcccttatggtgaacatgcagattgactacaacgaagatagcagcatgtggattcatgctttgttgttagcaatattatttcaaaatagagatatcatacgggcacatccaaccataaaatctgtaccagcacttaccagtttattgaagtcagaggaatcagcaaataaatattttgctgcacaatcaatagctagcctggtctgtaatggtagcaggggaacacttttgtctgtggcaaattctggggcagcaggtggacttatctctttgcttggctgtgctgatactgatatacaggatcttctggaattgtctgaggaattttctttggtacgttatcctgatcaagtggctcttgagaggttatttagagttgatgatataagagggggagccacttctcggaaggcaatacctgccctagttgatctgctcaaaccaattccagatcgtccaggggcaccatttttggcacttgggcttttgactcagcttggtaaagattgcccctcaaatatgagtgtaatggtggagtctggggccttagaggcacttacgaagtatctttcactgagtccacaagatgcaactgaagaagctgctacagatctgctaggaattctgtttagcagtgctgaaatacgaaaacatgaatcagcatatggtgctgttgctcaacttgtagctgttctacgtttaggaggaagaggtgcaaggtatagtgctgcaaaagccttggaaagtttgttttctgctgaccacattagaaatgcagagattgctaggcaagctgttcaaccgttggtggagattctcagtaccggttcagaaaaggagcagcatgctgccattgctgcattggttgggttactgagtgaaaacccatcaagagcacttgctgttgctgatgttgagatgaatgcagtggaagttctttgtaggatcatttcatcaaattgttcaatggacttgaaaggggatgctgccgaattatgttgtgctctttttggaaatacaaggattcggtccacagcagctgctgtttgctgtgttgaaccacttgtctctctccttgtaactgagctcagtcctgctcagctttcagttgtccgggcattggataggcttgttgatgatgagcaactggctgaattagttgctgcacatggtgcagttgttcctcttgttggtctactgtctggtaggaactatatacttcatgaggctatttccagagctctggtcaagttaggaaaagacaggcctgcatgtaaaatggaaatggtgaaagctggagttattgaaagcgtacttgacatcttacatgaagcacctgattatctatgtgcagattttgctgaattgttgcgtatattgaccaataatgctagcatagctaaaggaccatctgctgctaaagtggttgaacccttgtttttgttgttgacaagacaggaatttgggcctgatggacagcacagtgcattgcaggttttggttaatatcttagaacatccacagtgccgcgctgaccattcattgacttctcgccaagttattgaaccacttatccatttgcttgattctccaatttcagcagtgcaacagttggctgctgagcttctttcacatctacttgtagaagagcgccttcagaaggatccagtgacacagcaagcaattggccctctcattcgagttcttggttctggtatacacatattgcagcagagagctgtaaaagccctagttagtattgcactaacatggcctaatgaaattgctaaagagggtggtgttattgaaatttccaaagttatattgcaagctgacccttcccttcctcatgctttatgggaatctgctgcctcggttttgtcaagtattctgcagtttagctctgaattctacttggaagttcctattgctgtactggtaaggttgcttcgatcaggctcagatagcacagttgttggtgctttaaatgctcttttagtgttggaaaatgatgatggaactagtgcagaagctatggctgaaagtggtgctatagaggctctcttggagctcctacgatctcatcagtgtgaggaaactgctgcaagacttttagaagtattgctgaacaatgtgaagattcgagaaacgaaagtaacaaaatcagctattgtaccattatcccagtatcttttggacccacaaactcaagcacagcaggcaaggttgttggcaactttggctcttggggatctgtttcagaatgaggctcttgctcgaacaagtgatgcagtttcagcttgtcgtgctttagtgaatgtgcttgaagagcaaccaacagaagaaatgaaagttgtagccatatgtgctttgcagaatcttgtgatgtatagtcgatcaaataggagagcagttgcagaggctggtggtgttcaggttgtattggatctgataggttcaagtgatccagaaacatcaattcaggcagcaatgtttgttaaacttctcttctcaaataatactattcaagagtatgcttctagtgaaacagtcagagcaattactggtgagtttttctttgctaatcttgcagtttttacggcttggctgattgagcaccttaatacttttttcccttctaaattcctacaaaaagatacataataacatgccctcattttactttctagaagaggcagccttggtactggtgtaaagaaaaaacctgattttattggaataacgcaagttttagaaactgaacagaacagatatttaaataatagtaacaattagttctttaacagtagaagtgaatataagtagtgagcctttgtgtgcatttctgatgataattttatgttggtttagttatagtaaaaacataatattgaacattttgggaaagttggagttataaggttagcttggagttggaggtcgtagattcgaatccccccactaacaaaaaattaacaattaacaactaacgtttggcgataaagaaacattttgggaaagttaaaaacacactaaattagggaatacacttctacttttgttgaacaaattgacctaaaatggtctttttgatgttatgatgcattgaacatggtaaatgatttttgccttgctatcataagccaaaggcataacttgattgctaaaaggagaagtatatcaaataacattacatatgaagaacaaatcttttgattaatagaagagctaattttcaattgatcgtgcacctaaaatttatggaaggaaacaaaaattatagaacatgtgtcctgtgaacttcaatctattattacattatttaaacatcaagactgcagttgtgcttgtatagcctcttgtagcaaaaatagacacttattgctttttaagtattcaattaatggaacttgaacaattacagattgcacttcaaagcctaatttacatgtataaagttgcagtttttttcacagaattgattgatgaacaatgttgattcatttaagcagaaacacatctccccctccccaatttatatttctaactaggcttttgttcttatagccgctattgagaaagatttatgggcttctggaactgtgaatgaagagtatctgaaagccttaaattctctatttaccaacttcccaagacttagagcaactgaaccagcaacacttagcattccccatctggttacagccttaaagacgggttcagaggcttgtcaggaagctgcattggatgcacttttcctgctcagacaagcttggtcagcatgcccagctgaagtttctagagctcagtcaattgcagctgcagatgctattccattgctgcagtacttaatccagtctgggccgcctcggtttcaggagaaagcagaatttttattgcagtgtttaccagggacattggtggtgatcatcaagcgtggtaacaatatgaagcagtctgttggaaacccaagtgtttactgcaagcttacacttggcaacactccaccaaggcaaacccaggtcattattttacatttatggtttcatacttttctgttagctttgaatcttttctgtgttgttatggggaagaggctacttgctttttcggtgtatgcactaggatccagtgacatgggtgtaaaagtaaatttgggttttgtctctccatgtcagtcatctacaaatttaaccatgaatgctgtttcttgaatgacttaatattatctgccttttctcaatgaaaatcatgccaattccaaaaatactcaattaggatatgcatttttagagctgtttcctagaaagaatttcagttgatcatctacggatctacctattctgctgaggttttgctacatatgtatttgtagaataatctatttacttaacccaaatcatttttttctgcccctttaggatacgtttgtcttaattgttggtttgcaatttttttggtcccttactcttgggaatactctctagtgccacttgcaagttgtatcttgaccttgattttcaaggtacatgcaagagtttgaatcttgttgaatatcataaaggcaaagaacattgtgttttctgctgaatgtataaaaaaattgaggattttttttatggagctgtattttttatttttacatgttgcatgctgtatactcttttccagaaaaagtgaatatactaaattactaacatcctttatgatgatgtgctgatcaggtggtttcaactggccctaatccagagtggggtgagagcttttcatggacctttgagagtcctccaaaaggccagaagcttcatatttcttgcaaaaataagagcaaagtgggaaaggtaaatgtgcaaaaacatgaactataaaggcagtgtattcatcttcaaatattttgtttctactttctatgcttcattaaggagtgtcttaagggcactaattaagaaacatttaatcggtttaattgaatattttaattactttaataaatataattttattaaatatcttatatctttgttttcttagtcagtgttttaagaacacttgtgtgcattttgtctttgtttttacacttccacttgacccctcttctgtgatttttgatgacagagtaaatttgggaaagttacaatccagattgatcgagtggtaatgcttggatcagtagctggagagtatgctttgttgcctcaaagtaaaagtggccccccgcggaatctagaaatagaatttcagtggtctaacaagtgatacatccagctggaaataaatttttggattttttatattacaccacgtgtatatagctgttgtttatttttggtcaaaacagattcttttttcataatattcttttgtaacttgatctttcattcctaggataaacactaggagcacgaagatcaggccagcttcgagtttcttgtatgattctttgcgtgttgtcaatttaaagtgatatagcgagtctgtttttatcatttttgccttggggcttgcataagtacgacttactataattatttggcactaaattgaatgtaaaaaaacagtgacaaagattgtcgtacttggagagtggatagcttggtaatcatccgtaacggagcttgtgcttacctttacttttgactgcttgatgttttagttttactctattttgttttcacacatgtgcatataagcatgcattgtactaagcaagaggtagaaccaagttaatcttgagtatccattttaaatatgctcaaaatttattctttttacagttatatttgtatggtatacagtatacagtattttgactagagaattaacgtagcataaactttctttccactcataactccaaggcagcaaacatggtgagcaaatagctggcatcatcagcttcaaatactatatacatgatatgatatgacatatttgtgcgagaaagacactgctagaatgacatttttttatttattattattgtattatagtatatgatatcatgtgatgcatccaatgaatcctaatgtgggccgtggagccatgttgtggtgtttgacaaaagcatgaaatgtgacaaattgaggagtgcattatgtataatggagggcaaagccgaatggatctaaaaaggaaaacccgactgtgaggttatgtcatgtggaccaaatagagaatccatgaatattgcattgcgttatagtctcacctaattctgtttaatattgcgtgccagctgaactttacgtatattttattttgtttcttacataacaaaatgattcactggacaactggtttacaacatttaagaggggaaaaataaccattgaaccaacttgaatgcatggcacaatgtgatgatgacctgagattgaggacaccattcacacacgtttcagatatgtatgtgatgttgacttgtattattccatttttcactgaagatgctactgctaaggtgttatgactcattctgagttctgaccttcaaaagacaaaggatggaataaattacggtttctataattttaatatcaaatcatgttgcatataattattttacatatgagaatattatcacagctatccagattagagaatatcgtaatggtgtaaaagaaacttttacattgttaggatgtgttagtttagtggaaaaaggtgaaagaagaaaaaaattggaacgattttagtaaaaaaaaaaatataattatgaaaatcttattgaacctggacgaggcctcattctaatggaacatgatacttacaaaagctgagaagaataaagtacagtataatgaagaagaaaaacatacatttcaatacttttttcccctatactttatcctaatttaacacaatcagttgagaaaagaagaataataataaaaaaacacgttcaattcaaacttaaatttttataaacaagtgtgtaagtgatcgttttgagaagggaatgggaagagaaaacacagaaagcttgatgcagcctttagctgcaccttccatccccatttcctaaagtagttcctttttcttataataagaatatagaatccaaaaagaagaaaaaaataaaagaaaacacagaaagcttgatgcagctttcccttgttagtactcttcctgcttccttcagagttcaaacatgagcatccaaaagatagaactccatttgtatgtcatgagccagaggacaaacaattaattttcttaaagcagaatatgaacaagtaattgctaattcctatccccaatatcaatatgccattccagaaactgcattccaaagtttcttttgtgttcaaggagaaaatcatcatcaatcttacagaccccaacaataagaacatataattggtctgatttttacaaaactatagttttgttttctctcttcacattatcattatcactctacataataataataataataaagtttaatttgttattaatgttgtgcttgaggttaatttgaactgttcatgctcccacctaaaagctgcccatgagggacgtcaatgttgacatctgtgtttgttatcatgatttcaaaatcacatatagtatatagtttatcctaaatgctttagcgtaagtcagagttaatccacctctagctagtggctgatgttttatatttccgccactaattaaaaagattgcattgatattgtggtattgtgatacatgtttctcttctgagtttcgacctagttactctatgttgtgagttcattggtttagtttttgtttatttttttgtttgcctttctctttgcatcctacttttcccaaaagtgagagctttatgtgcagtgttgatttgaagtgaaaaggttctcatgcagtttgattaaagaaaaaatgtttgacaaacatctatgatgctatcttatacttagagagagatttgaaaaagagaaaaaaaaattatagatgtgataggattgatagaaagaaagaggtaaacaaaaatgagaaatattaataaaatatttaaaatagaaatatgtatgtgtatcattatacttggttaaattattcaattaattgctcaatttggatcattttagaaaaacatcagcaatggaagttgttgttaccttagctttcgttaaaagaaaaaaagcgtaattgactaatcaaagctaattcaaacatgaagggattttttatttttttcaaaaagcagagattatttttctagcaccgaaaccacggtttcccctaccatcccactctttatgtttaagagaaaaggaaagacagtgcttgaaattacaaatataattagtctaacttttgaaattataaaatattattttatggtgaatgatgaggttataatctaacctcaatccgacttttgtacacaaaagaaaataaaaaataacgaatttttccttttgttgctcagtatctttttgtatagaaccatgattgattttcatggatattcactctaattatatatgccagaaggcttcaaggttacttgttctaaaatagaaatcgaattatattaggaagtttataataatttataaacatattgtttaactaacgtgttggtttgctaattatagtttaatacaactaacaaaacaaacacacacatatataaagatgttttcacaacttaaacctacaacattcaattcaattctccaccaagtcttaatcctgtcatactaggagccatttattttggagaaagaataataaggatgacgcatgatcctacttacctacatattatgctctaatttgtttaaaacaaaactagaattaacactcaccgttaattcgattgcatttcattagtattaactctaacctccaaataggtgacattgatggctttgtccatatgtaccatctatcttttaggtggaggcaacaatttcattagggcatacacttttgaagaaatggttattttaggtatattgatccatcaaataatagactaggtgaccagtcatatactagagtctatcactgtagtaatatatgcatgggagtgtatgattgagtggaaaggtatgttcatggggttggtgaaaaaagaatggggctttgttaaatcacatccattcaaatggacatctatgtatagaggccataatagctgtaagaggacaaaaccaaacagagaaaacgacatacttacatttattatgtcctatttatccatttgttgtcatgtatgttgtgtgttcgaaagttttaagagacaggcatcgggacttgctatgagtccagcgacatgaataaataaatgaaagggcaacagtattagatagttctatatatgaaaaccaattattgaaactagaaaagaaagaggttttataatgatgtatctgtaaattaagtgcaaacaaactaattaactttcccccttaggttttttaagtttgttaccacatagtttctcccgtttttggctagataaaccatagtaacggacagtacattcttagtttaacacattattcaaaatatagtatagatattaaaagatatatgctatttaaaaaaaacttaaatttaggataaaatacaatttacccctttaatttattagttctattgtatttctccccctaatttaaataattaattatattttccttagacaataactacaataagattagaatgaataaaacttataactttgtgcaaattatccaatcctcacaaagaagatctagttgaatttgttaagtaaatagtgtgaattattataaattttataaaatttatctttaatttctgttgtgattttttcccaaccctccttcgtagaccgaatttattaggttaaataattaagtatattaaaggtgtccaaatgaagcaattaattaactgaataatttaaccaaactgcatgagagcctttttcacttttgataacaatgatcaaatatcaatatatatgaaagggatgcagttttatcagaccacaaatcctttccttttctccaattaaaccttatgaaccaaaaaattaaagatacgttttttgtgctgagaagggggatcaacgaaccttccaaaacagtagacttcctcagattcttggattaaagtaatttatatacttgtttttgaattcataattgtgcaacaaccctttgcaacagctgtgctgtgtgaatgttcccaaccaaacgcgttcttggcttctgtcatttgaccaacaatttgttacataaacatatttgtaacgtaatgaatcatttgaaatgaataactcaactcttgccctcattgctaattatacttaaattgtaacagagtagctctgtagtggtattcaatttatgaaggtgaagtcagtgtgcacatttcgtcaaccaagaattcacgacaaaaacgcaaatgtggtcccacatttgcatcaagagcctaaatttaatgtaatgtgtatttggatgtcaacttcattggctttgacgtggagtgaattttagtttgatggagatcataaaagaacaaataatacattgtacaatcctccaattatgtactataaatttattatttttatgataattatataaaagtgatttgtgattaattaatactttaatatatactattttttaattaattataaatgctattttattttataaaatgtaaagaagttgaattcatttttcttctaggcttttaagagcgcggccatggaaggctccagctttacatttttcacagaatattttcttttaaaaagggcactgtggattgatttgagcctcgtacacaatctgtgttccttcatattatttttttgagatcgataattgttttcatttaattcactattgctctgtaatttaaattcaagaactttagttatacatttatcgaaagctaccattttattatattaaaaaatctcaaagaataataaaacaaaaacgtaagcaggaaaaaaaaaaaattaagtgagtctaaaaacatctttaatgggagttgttaaactctagaatttcccttcaccaaatttatcattgtacataatttagatatcttcatcatggaaattaggttcctcctcaagaaagatctccatttcaaaaaaacaaattaatgtctctctccggatcgattgtgatatccacaagagtggttcaagaattaaatatggaatttatcactagaactatttttatttttttttacatcttatatgatattatggagactcataaaaagtaataaaaaatttaaaattgattttctcactaaaaatactctaaaagaaaaaaaaatataaaagaatatgaaaaaacatgatatcggcctaaaactcgattccatgaacattaatatactcttcaaattgaaaattatatctccttttggctttatggtcacgggagggaaaatgagttttgatgtgaacagcgtaagaattatttttctctctcaatcatttccatgttgttccaaactcagcgaaatgtaacgataatttagttttctttgcctttttttttctttatcatttgtcttatagcaaataaagtactagtgagagtgtgggacatgaaagaaaatagtttgaactttgattaaatgattaaaatgaactctgatacgcttcttatgtataacaaaatagatatcaactacgtacgatggtatttttagtatatattgttataaatgaatgcatctcaagcttttgcatgtcatataatgtatacatgtaatatattttaattttaatttcaacttacaccagccatttagtaataattgagtgttatttcatcaatgtttctttatctattttcatgacccctttaaaaatactagttctccgataagaattttctttttcatttaacgttaaatattaagagattttttttttatgaccgttccattgatgcacaatattataagttttgataataattaatctccataaaaatttgactaattatctttactaaatgtttcctttcaactatttatttttttcatttacaatattcaaactacacacttgaaaaatccgagaaactgagttcaattgagaacccattatatgaactagaattaataaatatcagccagcaatgttttgttttccggttatcctaagacaaactatccaaggcaaaatctgggggtacgaaaaagtgttttgttttctggtgttgtgggggccaccacctttgctctgtttgaatctgattaaacgtctctataagtaggctgtatgtaggtctgtgaccccctgtaagtaaaagatctcaaacgtagtatacaagttcttcccagcacagagcagagcagcgttattttatttatttattattattacaaggtaaggaacgaatccattttttttaaagaaagaaagaaagttccttgcaactactacttcttttttcgtttcagagctggcttccttctgtttttcaatattaatttatccgtttttatacattcaaataagtgcaattatattccattaataattaaagtcatgtacaaactgttatacacggagacgaaagaggaaacaaaagggtctcggataagataattaaagtgacagagagatagaaaataataatgttgtaaaaaacattgtacgaagttgtagtggtctctctagaaaatgatcaacctatgtgctgctatatatatatatatatatatatatatatatatgctcccttgcttcactcccatcgaagttcttttgtgacacactcaagaagtttagtccactaatcaatcttgttcttatattcatattcataacatacagaaatgggagttggaggtacattggagtacttgtctgatctaatgggcagtggccaccaccaccacaagaagaagaagaagcagttccaaaccgtggagctaaaggtgagaatggattgtgatggttgtgagcttaaggtcaagaacgctctctcttcactaagtggtgagttacataaattgttataatgatctattatctatttatttatcagtgttattcaacatgaagataatgaaatgaatggtgattaataattgcaggggtgaaatctgtagagataaaccgaaaacagcagaaagtgacagtaactgggtatgttgaaccaaacaaggtgctgaagaaggccaaatcaacagggaagaaggctgagatttggccctatgtgccttacaacttggtggctcatccatatgcagttccttcttatgacaagaaggctcctcctggttatgtgaggagagtggaggcccctgcgcacactggaaccatcacaagatatgaagacccttacatcaccatgttcagtgatgacaacccaaatgcatgctctatcatgtagacaaaaaaaaaaaaaaagatgttttttcccatggcactgtaaatttataaattttaatgcagtgttttttttttttttcttttagatttttcttctttctggtctattttcaagttcttgttgctttcctagagtgtcgtcttcttttttggtttttacataaaaagataagaagagacgttgctgtgatcattgtttttcaatttttctgcttcagtgttccagattgtatgtacactgtacttgcctccttgtaggtttgcagtaggtagtttcggtgggccttgaccttgaccttgagatatgatgttatttctttgttgttatttatggtcttcttttctttctcccttatatgaaaccggtttgggagtaaaagtaaagcatcaaaacaaccatatcatgtgaattaagccggtaagggtgaaataatggtgaataaaaacaacgcctgcttgtaatttatttttctgtttgcgtgcttagttaaagagaaaagtatcaaatacgtattattagtggaggtagagggtgaaaataaaacaaaacaatgctataaatgaagtcaaagaaaggaccaagaatataattgttaaaatactcaaaattggtcgaagttacaggcattgatcaatttccctgtagactgtagtatacactaacattcgtattgcattttgcctaccccagagcatttggctccccttatcaccaaaaaagaaactttgatagtatgcattggcattgggactattgttgatagaaaaagcatacataatttaaactcaattccaaatacgcttgatttccagaagaagctggagcaaacaggttcaaggaaggcatatccttttcctctcaattaacgtgaggcaggaatcggctttactttttctgctttgcctttttctgtttccctctccctttaccagatcctcacaaagtgtaaaggcacatgcaacctcgggatagtataaactatacaggattcaacagaattatgcagatgattgttctccttattattatcaccacccccaacgtcatcatttgtaagaagatattcaatggtgcaaaatacggatacggatatacacaattgttaaggttgaaacaattcatatatgctttccaatctcaaaatcagtcaatcataccaactggtgagcacaagaagattggggtgggtgtaacatttatttggcatttccaaattggagagacataaattttagatttaaaaatttgcgctacttgtataaaatataaaggtctaattacgatcaaaatgcattcacagtgaactattactgttcagaaagaagaagaaatttcagtttggccatgcttatgacctagtgaaacactaagatcgagccagtcactgagttagctagtgtgtaccagggctaattagcctaataaattgaaccagacacataagcacaatttgcatttgagaaaattacaaattaggatatctttatgaacatatttctaattttagatggattacccccaaacggatgattaatcaagtcagcatagaaaacgtcgttgaacactttttaagttttaactactaatcctgttgaccttttgaaattatgattctccctttgcatttttctgctctaagcatacagagccatgcctatttcagacaggaaggtgaaaagggtaaaacatatcatgtaattgagatggcatttatcatatgaagaattaataaatttttatcattcagagagcagtattgaaaattacatttacactaaagatacacaagctgctcgcatgtcatgtgcagaaatacacatgaattatctaatatatatatcaccaggagggattgctcattactctcaaaagggatatccaggtcaatcatgtacaactccactaaccaggaacagtaacttgaggtagccgtaatctggaagaagattctgccaaacaagttgatccacattctctagcaaaatgtccatttcgttgctctataaactataagaaattagaattatacctattttagataatccatgccagagataaaaagaaaacatactgtaagtgtcaccagtatcattttccccttatactataggaagatatattgaatttataaatatgctggtctacttctacctgccattagacatgtatataatcttaaatcacccggtcattaaacaacatgttgtaaatttcacaaaccctgtgtctcaaataagagttgaaatattaagcagcctatgttttaactatgatctcttgtgtcatcaaattttaatgttgcttattagatataattaataacaaccgattaaactactaaagcccgtgatcaatgttttatcaagcagttgctacatacatttgaagttgttgcttactattttattaataagaaagccaaaattttaaggtgccaagcatgcagaaagtaatccgaacacaataatacgagtgattgactaccatttcaaccatctattttaagaacataaatattctaaggagatctggaaactcaccccatccatctatgattcatatgatgtcaagtcatcatgccccttatgtcctgggcgacacacgtggtacaatggacgggacaaaggatcgcgatcccgcgagggtgaactaactccaaaaacccgtccttaatttggattgtaagctacaacctgcatgaatctggaatcactagtaatcgcctgttagccatacggcggtgaattcgttccaaggccttgtaccaataattaattcgtgatgtccacgttctatggagatcatcgaatccataacaataagtcctgtttggagaggctctctgttccccggataaatctcaacaaaattaatatcatacagaagagtggcattgccgggaatattgcagtcacctattgaatcagtggcaaacatgtcaaaatctaacaaatttaatgacttaaggcatcttctgataacattcacaatacacttatctaaaactcaagtaaggaactagaaaatgcatgtcccctgtgataaaattaaccaatgaataatgatttctcccttctctatggtgtctattctattactttataggtgttgctgattgttgaaagagtctttcaatgtttatgactaaattggataatatagcaattttccaaaatgcgatgaaacaacatgagaagcaccctgcaggttcagggctatatgctaattgcggaggaatctgcagtttgcgtttcccactggggttaaaaaggtaaattagcaagtgacacgtgtcatgattaaagaatcttaaaatgcccaggtactccttcaccccctaaaatcccctgatccagtcccctgattaccttgactcaacacactctcgtaagttgcaaaatagcaaaactatgttacagaatactttaggataaaaaaagtttatataccttgcccacaccaatgcgcatggtgagaggtctagcacgtttatagctgctatcaaatactatcccatcagcgaatctcgcaatatagtgaacctgtagtgtatatatttatgagtaatatacacaaattaatatttatttttaaacatcttatctaacaccttttattttttttactcataaattttattatacttatattttttttctttttctctctctagatataagataatagtgtttatcaaacattttcctatatttatataccattcattcataagtaactacctaacatgtttgttcgcatgctgacactgagtgagtgagtaactaacattgataagctaaccaagtggagcttcgtcaccgaagccctcagcaatgtcgcagtaaccgaggccagacttaacatagtcgtactcacacaaagggctctgttgcgtagtattcgattctcgtggcgtccgcatccaatgcagttaaatccatcacacaagccgtcacaacccaataccgattccaaccaatggattcttattatcattgtgagctgcacatgacaccttacgctctttgcaactcttgccatttggtttccaaaaacatgaaggaatgcgtacgcaggagaaggaggagagtgagagtgccattttccttccagtttcacgttatctatatctctattcaactctttgtatggctcactcatgatatgtgaccccaggcatgggtccaccttgagccaacaattaacggtatgtttttttcttctttttttactattattaaaagaaataaataaagtatctttatttttgggctacaaaacttggttaggcaaaagcccagaatactaataattattaattcataaaaaaaatcaagaaagttctgacctctaacaactacgtaactaacaagcacgcttccccaatattccctaacgaacttctcaaaaccgttgtgttccctccctctccgtcactttcacccgcgcgcttacatataaataccactgcacctcctcactcgcttcatttcccgcgattttcactctgaaatcgaatcatcacttcttcaatttcctctccaccatggaaaactcatctttctctcgacgattcgcgctcctctgcgccgtctccttcgccgccatactctgcggccccagggtcaccgccaccatcgaaggtttcgaagctcccttcgctcccttaactcctccaccgcctccgcccgatatccacgaacactcgttcttctcccacacggcgctccttcctccgatcttgtctcacctcggcttccacgagctcgcgacggccgcgccgtcgctctccgacgccgctaccaccggttccgttccctggaccggtccttccactatcttcgctccttccgacacctctctccgcacatgcttctcgtgctccgttccaaacctcctccgcgaacacatcgttcccggccttttcaccatcgattatctccggaaactcgctttcggcactaagatcgagaccttgagtccaggccgttgtatcaccgtaacatccgatacgcttaatcggaacacgaacaacaccgccgcgaaggtattcctcatatattaacttaattatagatctttcagttatttagttcctagttagattcagtattattttctctcgagtttaatttttttagttatatttccatgaacaacaccttcgcgaaggtatttttcagttattttcagtagtttgatatttcgttcctctttggcgaaggtcttcgtcggaggagtggagatcacgcaaccggatctgttcaacaacggcatggtcgtggttcacggccttcaaggtttcgtctctccgttatctccgttctcttgcgacgtggagaggatgaactcgctctcgtttccgttccatccagatcaccgatccggtcacgctcagcatcatctccaccactccaacagcgccacgacgcagcctgctgctatgatgcgcctgatgctccgagacgcgatgctgaggctccgcaacaacggcttcaacatcctcgccctcgcgatgaaagtgaagtacgcggagctcgtgatgctcaacaacttgaccgtgttcgccgtcgacgacctctccatcttctccggttcgcacgcgtacatcagcaacgtcagattccacatcgtgccgaaccattacctctccatcgcagatctcgagaagcttcctgtcggaactgctctgcccacactggagagaggccagtcgctgctcatcactacctccggcggaggagagaccttggcgccgatgaggattaactacgttagggttaaggtcgcggatgtgattcgcaacgtgaagatcgtggtgcatagtgtgtatttgccgtttccacatattaatcctgtggctgcggcttatgacagtatcttaggcggtggcgaaggagcatcggaaggagcggggaatattgcagattctgcagagcagaggacgcaagggacgtgttctgttgttgacggacgtggaagttgcgtcttgcctccgatgcctgatcaggttcaggtcaaaccaatggtggagatcgaagaccaccatggcctgtgaataatgccatatcttcatccacgatgatcttttctgaaatgaaactttgtcacatttgtagttagttcactctgttaatagagatgttagttctctttagtttgtctgtgtataggtgtgaaatgccagtgttgtttagtttgagcgcttgttttgtattcagcatagtcaatactgttgactgttgttcttcaatagaaaaatgttgagtcaaacttcacaaattttggcttgtatccaaattatctttgtttcttttgctctcaagtctcgattctcatcgcagtgtgcttattgacctgaaaggttctcttctaatttgacagatatttgacatgtcatttatttgtcctgaaagtcgtttggctaaatgaatcttttaaatgtattttatttattgttgtttaaattttattaaaaattatagattaaatgacttatttagttctttatttttttgaaaaattcattgagtattttatctttttaatttgattcaaaataatccttccatcaacctaaaactaacatcattaatcaaataaatattttgaccactaaaaatcaccaataaatataaccttttcttttcacttctccttctaatcccttttcataaacaaaaatcatcaatgaaaaataaattattcagataatgaataacaatcttaaagcatgacaaattcaaagttggacactaaaattacaatcgcatatatgtcaaagttggtgacgtcgaagttatgatgcaattaaaggggtgtgaaagtcgtaaaaacaaacctcaaaattgcgacagatcgacactctgtcatgacaaatttgcactccatgccatagatttgcacttcgccatgacagatatgcaaaggactttttgactattcattgacgacctcgggaagattcccaataagatgattttatattcaaaggactttttagctattcattgacgacgtcataaaaatttccaataagacgattttagttttcctcctctgacaccaggaagatgtttgtgtgatgatgttttagcttattgcaaacatcaacttccccactgaccccgccaggcaaacacccttggatgttgtcgccaagatggtggtgcgagaaatggtggtggtattgcaggaccaccacatgaatgccaacgttcacaccgtggaaggcgtgacccctttggacatccagagaaccctaaccttgagcttactcttggacaatcccacccatattgaaccctagcccatgttaagaagaagagtataactaagaaacacattgggacggctaaaaaatcgctaatatttttaaatcattaacaatgttagtttgcaatagtcgaaataactaatttgaactaatttaaaaagataaaggattaatatgaactttttaaaagataaaaaatcaaattaaaaaaacaaaacaaaataaaggactaaacaggtcatttgatcaaaattaaaaagaattgtgagtgtgtttcttatttaatgaacttataattttatatttttcaatacttttttataataaaaaaaatactatgttagagagtgttattggcacgtactctccttttattatttccattttggttaaaatagagaggcatggtaaaaggataacgttttttaatttaagataataaaaaagtcgccacttttaattttgaagtagtatagtttaattctttaaaaaaaaaaaacaaaaagtagtataattttaatatacattctcaatttttttttaccgtaaaatgccgaactgatgaaggattcacttacgaaagtataggcctttcctacgtagcgacatttttttttccattcatcaattatatgccgatactggttgggtcaatcccagattaaatttgaccttggtccaggtcaaattcaatcttagaaagaaagtcaaccaatgcttttgcccagccttaaagagagataatccaagaatgcattaactttgaactgaaaaacctattttgggctagctccatcaaatgtttgtttcactagctttgctagtgggcattctacaagttaacatcttgaaagttgactgggagaatagggagttacttcctgtgcatccaaatttgcttcttgcacctaattcaaaatgtaaaattatattttgaattagtctttctgagaggttaaaagaatgcatgatacaaaatttaaagtgcacgaagcaactgcatgaagagtgagacctaagtgtatgattggattaaaattgtgagagctcaaaagtatttttatttcaaaaataataaattaacctttccttctcaaattatgtattagaatgcattatttttaatggaattcgtaaaagtatttttgtaaaattgaactaaatataataaaagtttataatgctaagttgaaggcttagtttactctaaaatgcttagtttataaatgttatcatataacgaccttatagagactaaaaacgttctatttaactctgtaaaattataaacttataaaatattttttaatttgagatataaataaaaatgtagatttttttaatgtgaagtcatgtaccttaaagaatgcctttgaaaaatgtaattttgtagaagataatttgtatagaatatgtgttataaaaaatgatgacaatacatattgaaaatgatgtatagaagttgagctcaaatgaaattagctcctctatcaaaaaataagaaagggacagactgtgtaggcatattcatatatgtaagttgatacagaaggtagagaccaagaaacaagaaaaagaattttaggagtgatttaatttgagaaaaaatgttttttttaattgtgaaaatgctgacttattttttaattttaattttagttttgaataaaaaataaggaaaacaacttatttattattttcaaactaagtttgtgacagaaaattcatagattgaaattttgatgtttttcttacagcgtgttgagcaacatctccccgtcgcttgcctcgtagtttcctttgcgattcagtaatcagtatatggttttgacccccagctagcctgtgctgatctagaaaagtacaagttgtaaattatcatgaattgatgtccgagatttatattaatatatgtttttagagcctgtagttgtaaaaggaattgtagagagtgtagttttgcactgaataaatgtttttctagcttttgtttagttctgttccgttttggaatgatggaaatgtccgacgagtgtcgtcggaagcgttgttataggatcggactctcccctgtcggtctatagtgatgagaccaacgactgaagagaagatcacaccgacacggaagcaattggggtgctgtgtgtgccgtgtgaagggaaagagagagtcagaaaagtgtaccttgaggtctggagggttgtatttatattgaatcaagggccttgggcctcagctcatgaatgacctatttacggacagaataataggaaataatggcaagatatgattactagaattagagttattgcatacctggtaaaaaggatctgattaccaatcaggtatccgaattgattgagatggattctttcctttccgtaacagatgtcccccagctcggttgattagcattctgatctgccgagctgtactaattacttactttcttcggagtttgtaatggccgagatgagtgggttacttcggagtttgtaatggccgagatgaccgtttgggacctgggaccttgtgaagcattgagtttcgacttcgtatagggccgacctcgtataaggccgaccttgtacagggccgaccacgtgtgagggatccaagccgaggtagtcgatatccgaggtaaggtttgcttttgccccttgccgaggtaatcattgttgaggtgcgacctttgcttttatcgttctgccgaggtggttagtgtccgagttcgcttttgcctcttctttccttgcagtttattctggtgttttatttgctctttgcttctgtgtcttttgcatactctttctcttttgcgtatcgtggctccaattgttgagcgtctatttggccgggaccattggtcgggcgttgaacatatttggccgaaaccactggtcgggcgttgaacatatttggccgggaccactggtcgggcgttgaacatatttggccgggaccgttggccaggcgttgaacatatttggccgggaccactggtcgggcgttgaacatatttggccgggaccgttggtcgggcgttgaacatatttggccgggaccgttggtcgggcgttgaacatatttggccgggaccactggtcgggcgttgaacatatttggccgggaccgttggtcaggctctaaacatatttggccgggaccgttgatcgggcgttgaacatatttggccgggaccactggtcgggcgttgaacatatttggccgggaccgttggtcgggcgttgaacatatttggccgggaccactggtcgggcgttgaacatatttggccgggaccgttggtcgggcgttgaacatatttggccgggaccgttggtcgggcgttgaacatatttggccgggaccactggtcgggcgttgaacatatttggccgggaccgttggtcaggctctaaacataattggccgggaccgttgatcgggcgttgaacatatttggccgggaccactggtcgggcgttgaacatatttggccgggaccgttggtcgggcgttgaacatatttggccgggaccactggtcgggcgttgaacatatttggccgggaccgttggtcgggcgttgaacatatttggccgggaccgttggtcgggcgttgaacatatttggccggaaccactggtcgggcgttgaacatatttggccgggaccgttggtcaggctctaaacataattggccgggaccattggtcggactctaaacatagttggccgggaccattggtcggactctaaacatagttggccgggaccattggtcgggcctgggatctttgtcccgacttagcaactgttagcgtatttgtaacatcattataagtgtaattctttcggccgacccgatgattcacccatgatagttacgtcggcttgatcaggaccgaaatgatacggaacaacgactaagcattcaaatctgtgcacagtaattttccttataacaaggattttattaaatttcttcgaagattacatgattttcatgatctcaatgactgatcacacgggttgtaccttcccgagttatataatcagctaaagagaaacacatgatccatcagttataaagtcctcccatgaccccaatgatgggcttgacagccaactaaaggggaacacatggtaaggtactaatccatgatccctatgacgggcccctcggccaattaaagggaaacacatggtgtccacgattccgatgacgggcttgaagccaactaaagggaaacacacggtgaagttccgtgatcccaatgaccgactaaaagccaactaaaggaaaacacatggactttcttggctgcatccgtttgacttgcttgtcgtctggtgtcttcattaagtatgctctttgcccatgattttggacaacccattgcggttctttccggcctgctgctaactttccttgcaccttggtcggtctcttaccgatattacctgaggtatttctaccatgatgacgttgcattcgaactcgggctctgagaagtcttcgtcttccttgctcctcttatcatctcgttgtttattctcctgctgggcttttctcttcccgtggtgtccttgagttcggatcacgtactgtcgcagtttgccttcccgtataaatttttctattgcgtctctgagctcccagcactggtcggtcgtatggcccggtccattgtgaaaatcacaataccgggaataatccaatccttctctccttactatcggaggaggtcggttgactttcctcatgtcggtgaaggcgacctccttccatatttggccacgcgggacggtcaacggagcgtaattgtgatatttcaactcgtatcccccgggcctggagtgagggtcgggactgctccgtggtggtcggcctgctggatgtcggctggatggtccgacctggggattcttctgtcgtcggttccaaggcgaggaaggttctttgttttcccctggtgccgagtttgcgatctccatttgttctaactccaaatactttttagctcggatcctgaactcattcagggatttgaccgggtccttgtagatcgacttggcgaggcgggacgttccgttgagcccggcggaaatgagatggacgtgtactctctcctccaggccttgtacttgtagtgcggcttccttgaaccgatccaggtaactttgcaatgtttcttcaggctgctggcatatcttgcctagagtgaattccgacttcggctgtttcttgctggttgcaaagtttaacagaaacttctggccgagatcctcgaagctgcggatggatcttggcggaagggaatggaaccaggtctgggcagcccctgttagcgtggtggcgaagattcttgaaatgataggttcgtcgatgcctcgaacgcacatctgcatgtcaaattcatcaatgtggacctgtggatcctggctcccgtcgtatttggacagaaacgagccgtcaaagtcttccaagaactgagcatccactattcggtcgacgaacgggctattgttttgatgacctcgacggtactttcttcgatatgtgccatcgccatgatcgggtcggcggatggcctctattggttcccttgtagttgagatagcacggaatgtcctttgctgaggatgtgatcttcgctcttggtcggaatggtacgtcggttccctattgcctgtctcggcagctcgggtcggtgtttcgggcctttgtcttcttgccttatgctcctggtggtcggtattttgccgacgttcttcctctcttctcttgttactgcgttcttccaactgggccgtgaggtgctgcctgtcttcttgccgctgaagctcataccgtttctctagattctccatccgggccaacaaagattgtaaggcgttttggataaaacgttgggaggtctctgggtcgtcttgtgctgccggtggtgtattggccggcacatgcgctgctgatctcgtacgggaggaatcggtgtgggacaatgcaccctcttccaccccattctccgaattcggattcctgggtggttcttcacgtctggcgagctggtgtcttctggtattagccattgagagttcgtgggattcgaaatttatcgtccccacagacggcgccaatgttccattctggaatgacggaaatgtccgacgagtgtcgtcggaagcgttgctataggatcggactctcccctgtcggtctatagtgatgagaccaacgactgaagagaagatcacaccgacacggaagcaattggggtgctgtgtgtgccgtgtgaagggaaagagagagtcagaaaagtgtaccttgagaatgtctggagggttgtatttatattgaatcaagggccttgggcctcagctcatgaatgacctatttacggacagaataataggaaataatggcaagatatgattactagaattagagttattgcatacctggtaaaaaggatctgattaccaatcaggtatccgaattgattgagatggattctttcctttccgtaacaagttctatagaaaaagtgggaatgaaagggatgaaagaaatcacatgaaaatgaaagaaagtggaaacttagtgggtcctatcttactaaaaaataccttccgtttccaactacgtggaaaaattatatactgggttaggttaatttttgtgtctaatgcaataataaaggactggattgagtaatactagcaggaaaacatatgcagcttgaattctcactttctctcgattttatttttaggcattttcattggtgatatatatatatatatatatatcttaaagggctttcattggctaataacaagtaaactgtattgaaaatcagatccgttattaaattgctgtaagcagtagtttatggtttattagtttaattatagttcaatagagatcaaatcaataatatatatatatatattaaataaacatttataaaagatgtatgttttctttaatatgatttaagatctagagttagttttcttaaaaaaataacaaccctgattttagactaatatataaaaaaataaacactcaaatcaagagttaactaatatttcactatattttaagtacctattttaagagtaattttgattagactgaccaataacaaaccaaactcaaacattttgcaaagcaattctaaggcctattttagaagcatataaggaaagaatagaaacctaatatttcatttgtttttacttaactttgataaccatcaacttctgatttaattaacaaccttgattagttatcgatggatgtgccaaaagaagaatataataatatatgagaaactccttcaagctttctttcttctttatctcatttcctctctctctctctctcaattatgcgatcgacatattccaaaatttaaaaacaaaaatcttcagttactccagcgtttcatcgatgcaactaaacttgtaaagaaaaccacattaatcattcaattaaattcttaaaaaacacacacgtatcttcatttattttgtttatatccttatgatcttcagtattattaaaaatagagcatgttgccctcatcgttttcgaaaacaaaaaacaaaaagagtacgtcgcccacaaggaaatttcgatgcatgcgaaaaaaaggagcacgtcgccttcaaggaaataacaatgtatgcgacttgtatataaactatatattaaactttccctttcgagctgaacgcgcttgcagcattcctagcctaataattaactcaacacgtattactcttaaaaaaaaaactcaatacgtattataaaagtgaatgtatatacaaatacaaagtatagtttaatgtacgtatatataataatttcttagagtgaagctttaattttttttaatgattttaacttataactaattcttaacaagaatatttgcataaatggacttggtcttgacaaagctggtcacttaatgaaatgtgaatgtttaagcaaattcacgtcaaaaagtatgaaatgatgcaagattgaatattttatgcttaaaaaatgacgtgttccagacccctggctctaacgcaaaatcaacacgcgggaactcattgagaagggaacttcagataatcatcacaggccggaacttggaacaaatcacgatgatcaaatccaacaaaaacgtaccaataaaaaatatccaacagaaatgaaaaaaaaaataactgtagaatatatttaccccgaaaataaaccttaaggcaaagtagaaagctaggtttcataaaataggttaaaacatgtttattttatatatttgactcaaaattttcgtcgagtcgatcatttaatttaaaacctaaactggagtcgaataaaagttcgttataagactatattaatttaatttataaatataaaatatcaatcatagaaatagagaaatctatatatatataattaaaatatattttacaatttatttatgctatgcattaaatttacccaactaaagtcaagaatcctagttaaacaaatgtgaaaattaaatggtaatatctatatttattgaaaaatctcatcagatttttaacaactagcagaggctagttgactataagttcggtgactctctgatgagttgatcagagaggcatgctttgggaccaaacactgtacgtaaagctttctagtttctagagtctggaccggtgaagatcaaatttacgccaaagttacgataacaataaatattccaaatgatatataatacttagaagataagctcaaatgcaagtggcttctcagtcaaaggaatacgaaagggatccattaatgttatatgtaagcaaactcaaagggatggaaataaattgatgaatgcaagttggtactagatggcaagtggcagaccttgatggaatcgttttagccttctcatacacatttgacttcttcttcttattttttttttaattttaagattttttttcacaccttaatttattacctgtagcttttggttcaacttttttggtgtatcataggaatattcttagtcaacaataaaaaattaatttcttcgacttatagatataattaaggtaaaatttgactttttatatatttttttttatcatttaaaactaaaagtattttttctcgaatagaataagattattataaaagataaaagttccttttttgagtattagcacaatccttttttaatataaacaattaagaatcgaattgtaattaacatacttaaaaatataccggacacacgattattttgtcaattgtactcgattttgttgatttttttcaacctttagtaatatattcactagttaattatttttttataaaataaatagtgagtatttcattctttaagattataaacacaaattagtgcatcaactgaaaaaaaaatctaataatttatcatgctataatcaaggaattactaacacaattacaatttacaacctaatgaaggcacaatttgtataatacttgcacatttttcgttaaaaaaaatacatgtgacgataattcttttggacacattgtaaaaagaattgaattaaactgagtacaaactaatttgcgaagaaattgaaagaaaaaacaaaaagtatgtttaattatggcctatgaaaacctcttgtttgaccacaacccatgatagatgaaggcaacttcccaaccctctcaaccccttcttcaaaaaccactcccatccccatatagaagtgagactctatatggcaatgaaaagcccacactccaggattatccgtcctaaacctcaatgcggtccaaccaaaggggtgcaccggaaccgtgttcttcataatcgggttctccaaattatactttctggtgtcattgttcacgtcaaactttcccttcccatacccaagaacccaaaaatcgtgcccatgaaggtgccacgggtgtgtctcgctattgtttttgttcatagtgttggcgttttgaagtataatatccaccgttgtgttgaacttgagcctataaatgccactgctagacgtcgcattcgcgttactaaccacactgaaaatgtcgtagtttgcaaagtcatagccatcagggggtggagtggggtcaaacgcgccggttatgttctctttgagggcaatgaggtaaggggtgtgagggagtgtgaaagagacattgttcacagaccaatgccggtattcgcttatgttgttctgcgtgttgaggagtactatgactctgtccgaggttgtcgggggtttgagtatgtacccttggcgtgccttgatggaaaggctttgtgccagccttggctcaacgtcgtcccaagcaggaggagaaggtggaaccgttggaggagaacgtttagggtggttggggtagtagttgaacatgcccaacccgggtggggtggttctgtttctgcttaccacgtttgaggtgatccaatagttccttgatgggtcttgatcggttttcactagaaccgagtaggtctcacctgagtatatgaagaggttttttacctcaaatggctctacatagtgaccatctgcttcaaccactatcatgttatggccctgcattataacatgtcagaagttatgagaagggggaaagaataaagtaataagccgaagaataacattcttttaacacattaactattttgataaacttgaactgttggacataagaatgagttgtgatatttcaacacccttaaatatcaaacatctcatcaacataatttatttttatctctcttttcttatcatatcacataatctattatctggatatttctctctcttctctctctatttatgggtttatgggtttttgtatgcaaagatttttttcctaagaatatacagaaaaagaaaataagaagatgaaattaaatttttgtcataacttaaaatcaacttatatagctcactctttgaaaaagttatatgacagaacttaaaagttgaagtgtaagttgacctttaagtggtagaaactttttcattaattttcctctgccttaagagtttacaaagaagtttatctaaagagaacatttgattacctcaatttggaagctaagtgctgataaagcagtcaagctagcaattctgagtcggtatgtttttcccgggatcacagtttgtacaaagggagagcattgagggtttgatgtgtcacaaacatcagtgcttaagcttggggaattagagcagttgaatcttccttttccatgaatcagaagtgactgaggaaccaaatatacacaaagaataaagccaaaagttagataattgaaaaaagaaaagaagagaaaaaaggagggtagattttgaattgaactattaatttacctgaggttctcccacccattgaaagggaattgaagacaatccagcagcttgttcataagtgctcttgtggtaccaatcgttgaggataatgcttcggtcaaggtcataagcaaagggttcagggtcacggggtgccacacgaatcatcccatatagccctgcttctctttgcattccatagtgagcgtggtaaagatatgtaccaggctgtcacaacaaaggtgaaagtaaattagatactataaattgttttcatgatgagatgaatggattacaaatatagcttgttctgatttcttgctatttttagaatttagattagaagaccaaacaaaaagtaaggaattaacacaattacttgtgtgggttaatgtcagttaggtttttacaacttaccctgtctacaacaaactgataaataaatgtgtctccaggcaatatgggacactgagttaccccttctgttccatcaaaccaaggagttccaatctggccacatacacatgaaaatgattaatcaataaacacaaaagaaaaaagtctatattttttaatattcatattttggggcagaaaataaaaaccaacctgtcttatcccgtgccagtggatggaaaggttttctgtcactaaactattgttaacttgaacaacaatggtatcaccctcctgtgcctggatggtgggtcctggagttttgccattgattgtgataaccagcttcttaaagcaatcaggggacctaaactcatactttacctcccatttgtgatgtctaattctggcctcagctttgtggaaattcccgaaaatgaggaagaaacacagaatcaatagtgttggcaattgcagagctcttaagcttaaccgaagctcaaccatgcctagctagtcaaagtatatatgtcttacactgagagaggcttatagagttatagtttagagatattaatcaactttggtgtttgatgtgtggagccaggattgcctttatataatggatgagcactgtggaaatttgaattatattatatgtattgtattgttggctccgccttttcaaactaagttctacatagaaatctatcgagagtgaaattttgactttttcgcacggtgttgaccatgacctagctccccctttgccttgcctcaaagtttctccgtgattcattatatggttttgttttgactatctctatgtagattggaaaagtacaagttgaaagttattctgttttgatttctaacgttgatattgatgtgcttttctatataaaaaaaggttgatattgatgttttcattgacattttgataatacttttcctttattttcttaattacataacatattttatctcttttttctattttttttattgtagaaattaataaagtttaaataaatataacgttactcttattagtcttatgctcatagctatttaccaaacttttcaagtttgacagctgagattcttccaattaaagaaacaaattatctttattcttatgacaactttaatcatgtaaaataaataaaaatactaaatatttagttctttaaactcgtatatatatgtgtgtgtgtgtgaatattttattttccccactgtatgagtttttttgggctgtagtatagttttatttaagtacacacatacctaatgatatttatttacaaataaaataaaatcaactctcttttgcacccatttagaccatttttaattagattcttaagatgagtttttaagctaaaaaatttctcttagttagatatatcactagacatgctctcaagttctccaatataaaggttgaattctagtggaataattctaaaaaaaatcatctttttaatcaaaagtagtttttaaatatctttttctttaattaattcataaaatatattcaagtgagatctattatgaaacgaaaaaaagcttgagaatccaaagtaaaatttatcattaaaataagaaaataatattacattttatatgacatcatataatccataaaaaataatctgaaaatttaaaatgaattctattactctttgaagtctaaccatgcaaaataggtgtagccttataacttgtattttattagttcttggcttaaaaaaaataacaatcttttttttatgctgattttaataatacccagtcctctatttcttaatccttacttagctatcaatatatataccaaaagatgaaattgtaagcatctaattcgaagttctttcaaaactctctctatctcttgcttgcatctttctcttctttaaataatgacacagtgcgtaattaagaaaacaaaaaatttcggttactctatgtttcgttgacacaacttgtaaagtattttttattagtacttgtaaattaagtatactccataaatcattaaattaaattcttaaaaacacaagcacggttcttatcttcaatagtactgttaaaatagagtacgacgccctcaaggaaatcgcaagctcgcagtatatgtgacttcacttgcatataaattatgaaaaagtatcctttctgaatgaacaccggaacacgctttccacataattatattatatataatatatacaaggaaacaattgaaggaacatataaaaaatttatctttctcgaagtcaagtagtaatttttcataatttaacctgtaacttgttatgatgttcaccacaacccataagaggtttgatattcaaagatgagtagagagaaagagcagggagaaatagagaagaaagtttcttgtatggattcgtgtatatgctaaaatgagcatagtcggttacattcaattagtgtttccttatttattgttgtgagtaggaccctgttaccacgtgtcaaactcttatttgtgtctgttgggccctgtggtcccttaccctaaaactgagttatagcattggtctaatctttgcaatagtttcatgccttaggcctattttattttcattaattacctgtctagaatgatttttgtgcaatttagctgggatttatttcaaaacagttatttttgagtcgaaattattttgaagaagtaatatcaattttataagtaaaatgaatatttaccttgaaacataactgattcttaacgatatcaaaattcttttacacaaattgacttaatctgtctggaaaatctcagtcaaggaacccaatgtgaaaagaggaacttcagatcattatgaaaatggaagttgttctggctagggataattggaaacaatcaggatcatagaatccgacaaaagtgtaccaaaaaagtgaaaacaactcaacagaagcaaaccaaaaagaaaataactttatgacagagtggaaaggaaaaagaaaagatgattaagaaaaaaattactacttgacttagagaaagataaaatttcatcggaacacgctttccgcataattatctcttcattcacgagttaaatttgcttctgtaaaaaaaaagaaaaaagaacgcgcttcttttatcttgtatatatggaagtacgtttatacgagtttgcgaatgtcctgagatgttgatcgcactgtagccatgtggatttgttaactttatgttcctcttttaacatgtacgctccaacataccatgggaaagttgcagagacagactacggaaggaacaacatttttccacattttatttatattaattatattctcgtttgaaaacaaaatagaatataattttagtcttaatttttttttgacagatttattttagtcttataatgtgattttaatctttcaattttttttattgattttgaaaatttaaaaatgttatatttttaataaaatatttctatcattacttaataatgatgtaatatatatatatataatattattacaatcatgtcgctttaaaatagtaactaatacaacataattatatataaaatatatataccatgttaccattaaaaagataataaaaactattaaaacttataaagattaaaaataaataaacttttttaaaagataaacctaaattaaatcatatttaaatctgaaaatgataacaagctagctagttatgacttgtaagtattgtctgcacggtgagaaattattgtacgtgattgactgaccttctcaagtctaagaacggtttagatgcttaattactgggaatcttcgctaacttgggcctctattaatattgttgtgtaaactctaaatactgaagtctaaggagctattttacggtgttttgttttttgttttacaaataattttataaatagttttaaaaacaagagattgaaaaaaagtttagattttcacattaatcatatattcatctcacttacggtaagttagcagcgtaattaagcatcatagtgagttggggacagagtaatgcgttgcggtggttcaaagttggatccgctgatcatggagttttgaggcaaagacacgagctaaatttgaaatgtatggttgaaggcaaaatgggagaggatgtatccaaactaatccaaattatttggattagatttttttttaagagttttgatcaaattccatcttatttaattaaatttatgcactgttgggtaatgaattttttaaattccatctaaagattaaattaattattaaaaaaacattaatttttaactaacatgatttattggattattaaattaaattatccatattttttcttttttaagttatttttcatctatggcttgattttgtttatatttttttaagttaatagtctaatatagtattttatttttatctaaaataaaatatcatattagcattaaaattatttattttattagataaatattgtcataatttagtcatttttattacatttaaatcattgtatacttacataattttagacaaaaagaaattattatgctaaataattttagttttataaaaataaaataattaacatttaaaccaagttaactcaatcctatccaatctaattatgacttatttgatttggattcgatccgttaataaaattatataaacttaatttaactcaagccataaaatttaaatcgggtcgagttactaatttaatcaaataccatccaagtggacccggaaacaatctggagtcagaagcaggggctaccagcaagcacgagtgtacacatcttgggatggtacatcttgtgatcaccaacttgacaatgacaacaaccattctccacttggttagtaggattgcaatggcaggatatgggcgggtagggccactaccggagcagattatttgagccttattaattgtgttttttatatgatttatgaaaattaaatacacaaaaagttctacatgtatacaatggatcatttcagcagcaaaaacaatattacaacagcagcagcagcagaaaattaaatttagttagagttgtattactgaatttgaaaaacaattaaatacaactgtggtgcattacaaagaaacatccggaggtaagactttcgacataaataaaaattgctatccaatacattttagtagaaactcaactatatattttatgagtttttcaattttcattttataagttcatcaccaccacaaaatatatacatcatgttgctcgttgcattggcttcatacgtcatcctactcactgcatccctcagtatcagacttaatgcatttgctggtcctgcaaacatcaaacctcaaataatcaaataacggccaacatcaagaagatggtaaaaaaaatctattgttgcacccttgagaagatggtaaaataatcaaataacgcccaacatcaagccagcattgaaagggtcacaccattttatgttgaaacgtgatcaacattcacatgttacaattttgtgtcttgtcagagatgcagctgcccagcaggttgactgaaactattgatattgtattagagcaggagtttttattaaggaaaagtatatattattgaagatggctctgatgttagggggcccttgaatcgattacattatgaacgtaatccatgtgtaggatttgatgggaaaacagagcaaaataatgtcatgagcaatttactaattggccattgttccatttgcatatattaccacattggtcattggcattgaagaatgaagagtggtctctttgctacgccgcgaacatttttctatttatttttatatgataagaagttataataaataagtatacatttacaattacataaaacttaaatgaagaataataataaatcatttaaattctaacagattttttttagcaattggtgatttcatttttaaaaaaatattaaaattaaatataaagatagagataaaaagatgtagtcttagcttgtttgtgtctctctctctggtaccattgcaccttgcaccctatataatggagtagtctccctccttcatctccatgaaatccttcaatcgtcattcattcatctttgattccgccaccacgcaaacataagatggcaacggcaaatgcagcatcctcattccaacaaccacccatcaaatcccacattgctgtactccctagtccaggcattggccatgtcacacccctgcttgagctctccaagctcttcgtcacacaccaccactgccacgtcaccttcctcaacgtcaccaccgaatcttccgcagcccaaaacaacctccttcactcaccaactctccctcccaacctccacgtcatcgatctcccacccgttgacctctccaacatggtcaacgaccaaaccacaatcgtagcccgtctatgtgtcaacctacgagaaaccttgcgtcccctaaacacaatcctcgcacaactacccgagaagccccaagccctaattattgacatgttcggaacccaagtttttgacaccattctcgaaaacattcccattttcacgtttttcactgcctcagcacacttgctcgccttttccctctttctcccacagctggaccgtgacgtgacgggagaattcgtggaccttccgaacccggttcagatcccgggctgcaaacccatccgaaccgaagacttgttggaccaagtaaggaaccggaaaatcgacgagtacaaatggtacctccatcacgtgagtcgcatgactatgtcaaccggtattttactcaacacgtggcaagatctagagcccgtcaccctaaaagcattgacggagcactctttctatcgcagcataaacactccaccgctttaccctattggaccgctgattaaagaaaccgaatcggtgacagaaaacgaaccggagtgtcttgcgtggctcgataaccaacccgccggttcggttctgtttgtcacgttcgggagcgggggcgttttgagttcggagcaactaaatgagctagcgtggggtttggaacacagtggcgtgaggttcgtgtgggtggttcgggtgccgaacgacgctaatgcatctgctgcgttttttaacgcgggtggcgatgatgatgcgacgttgtatttgccggaagggtttgtcccgaggactcggcggaggggtttggtggtgaggtcgtgggccccgcaggtggcgattctgcggcacgcgtcgacgggggcgtttctgtcgcactgcgggtggaactcgacgttggagagcgtggcaaacggggttccggtgatagcgtggccattgtacgcggagcagaggatgaacgggacgacggtggaggaggatgtgggagtgggtgtcagagtgagagtgaagagcactgaaaaaggtgtggtggggagggaagagatagagagggtggtgaggatggtgatggaaggggaagaagggaaggagatgaagcgaagagcaagagagttgaaagaatctgcggccaagtctttacgcgtcggaggaccatcctatgagatgcgagcggcaatggttaatgttttgcttgattgcaagaataaatcgttgcacccaaaagcccgttcagagggtggatcatgaaactgaaatcaaaggttgaaaattaaccaacgtgttttcgcgcgtgctctttagccgaatcttcctacaataaaataaccgtcacgtttagcggtttcggtaataaataagtaaattaaatttttctacatgttgtagtaagtggcagtatgtttggtttccccgaaaagtactcttgccacctaggtttagaggtaaattgggtttgcttctccaaaccttagtttagccacccacgtttgtgaaaaacaataaatgtcatcagcttcctattttacccactcatcatttcccaactcctcagagacttggattttcaatggtgatcagatggtgttcgacggaggttctgctaactcattgtatttgggtgtccttttgtttgcttttcgtattcgtttcgggatctgagtgggaggaaggcttctaattattgttggattcgtcactctcgtgtgttttgcaatctagtcaggtttgccttggatgaggtgatttatggccatttgtatacccctccttttctccttttgttctttgcttttaacgtatgttcctgtttttgggtacatctgccacttcttggatttatttataatatatttgttttttttgacaaaaaataaattgggatgctattcaaagagagcctataaaaaataatattaatattacattatatatttcatgttgtaccccctcgatcttctcaattgtaccaacaaggaccattttcctacactaagtttttcatacttacacactcgaaaccataagattatgtaccccctaagtcttaccaatgacggtcactttcctacatttaatctctctgcgattatgcactcgacattgcgtagttgtgtatccccttggccccctcgattggtttctgcccttcagggcttgccaattaatatcatcaaattcgaaccaaccctctcatacttccaattgagcactccactacaggcgttgatcaatccttagccattaaatgaccttaatcgattatgatgtgtgcccaaggatcttgggataatggatagaatcatgtctgatagcacttgtaagaatatcatattggtcaatgatgaggcatccctatataaccctaatgcttgacctagataaggcaaattatgcttaacacttgaatgctcttgaactaaatctccttcctaggtacaatctatttacaataatacataccattttcaataattaagcatttaagagtatttttggtagtattattataaaaaatatcatttcatcaaaatactttatttgagtgaagaaatattctaacatatatgtgtgtgtaaactcttttttattttattttatgaaacttaagttcaccaactttaatccaacacatacatgcaacggaatggttgtaatgatgcactcaatattctaaagttctatccctaatttgactttaaataaaaattgaaataacctttgttataataatgataataataatgcacttaatatttgattaaccaggtgagaatttttttcgaattcaggttatttaagtaatttactttttataaaaataagaaagaggagtgtacttaataaaaaaaatgaaagtggacatagtaaaacgttttttttttcttgaattgaaaatcaaatgagctcggcccattagcaataattggacccaaatgaaattttatctcaagaataactcacacttaatcacctattactttgttatttcaattttttgttttttctaaattattgtttttgtcctttaatttatttttaaaatttgatttggtcctttatctatcaaatggttttatttggttatataatttttaaaaacgttccatctaaattgattctaatgacgttattatatgatcatggttatttatataggatatttttgacgctttgaatgttcaaaataaatactaaagattgaattaaaagaaaaaagttactcatgtttttattatccaaaaataattaaatttaatatctctttaatactatataagtgttacaatgtgagtgtcagaaattacttttaaaaactaaattcactattcatcttgaagatatactttatatgatatccaagtgatcaataacatcgacattttgatattaagagtacatatactgtaagtataaggattaaattctagcaaaaaatttccatgaactttttcaacagagttaatttatcatatttgaaattaaaataaaaatatatatggtccactcagtgtatgttttacaatttgttggtggaacatgaaaatgacattaatcaatatatatttttctttcttcattcatctgttagatttgcattgaaagtgcattgtaccaaaacaaacataccttaggcgatgaggttgaaataaatgaacttagactctattctcattatcgccatgataaagaaaaaactatcctaaagattatggtcataattttgaaaatgagaaaaaaggccaaagaaggttgatttgaatatgaaagcggagagtttcaccaactctccccaccccatcctaccaaactccctctacctaccgttgttcaaccttctccttctcatcatctcactctttctcattcttcagtaaccccttctctcccaaattctctctctgtctctctctgttcagttttcatatggccaatacactatataacggcgccacatcccgaatccctctccgggaccaatccctggccttctctcgccacctttccagatccctctctttccttcccatgtaagttctctcctctcttcttccctccaatttcacttcacacaccaatttctctttctcacccttcgcagaacacgtgcgggaaaacaacccaacgcaattgcggttaaggcttcttcgcactctgacttccacgttgacctttcgctcagtccccgtgtcaatgccgtcaagccttccaaaaccgtcgccatcagcgaccacgccaccgctctcgtccatgccggcgttcccgtcatccgcctcgccgccggcgagcccgatttcgacacgcccgctcccatagccgaggttttctttctactttccccctttcattcatgataactacgtgttctttttttaatactgtaattgcaggctgggattaatgcaattcgtgaaggttacacgaggtacacgcccaatgccgggaccatggaactgcgccaagcgatttgtcgcaagctaaaaggttggtttcactttcattatgtaataatgtgcttttcgtttggatgattgtaagagatgagggttttgaattgcagaagagaatgggattacttattctcctgaccaggttgtggttagtaacggagccaaacagagtattgctcaggcagtgcttgcagtttgctcccctggagatgaggtaagtaaaaaaaatagtttatgctttaactccatacgtaagcactagagaaactgactacttatatgcttcattgtcatttatttggctaggtctcaatggatcatttaatttgaccaaacctgtttgaattattcgaatttgtctatcatttgcttgcagaaaatctttgatgatttgtctggttgacaacggtgccagacttgtattatcattcttcaatctgtctcaagtttgaaattagttacttgcacttgtttgttcaaaagattcttcaactggcttttcagcttctaaagcttttgctctatgtttgttttatgtctctggtagtctgttataattacttttgttgaaattaaataatgttgtttattcttttataattgtaccatgtttatatacaagtctgagagactcatcaatctcataaatttagggactaaaatcaaggattagaatcaacctacgtatataaaagtaatagaaagagagcagaatttccctatttacataaatagacaatatttccctaattatacaaaatatgtcaataacattcccacaatatctcgactactttgttatcaatttatcatttattcagggtccagtaatatgcttgctgtggtaaaagtcacaaataaaacagccactccatactacatacttccatttattaaattatgtctgagttgttttggaaagcttaatgcttatcacatactccatatgtttttttctcttttccttttgctcacttcagtggctttcatttatggcgtgagtatttcaggttattattccagctccattctgggttagttacccagaaatggcaaggttggctgatgcaacacctgtgattcttccaaccttaatatctgataatttccttttggatcccaaactccttgaatccaaaattactgaaagatcaagactgcttattctttgttcaccatctaacccaacaggatctgtctaccccaaagaattacttgaagagatagcccgaattgttgcaaagcaccccaggcttctggtatagttatacatccatgacaagatcacaagtacttcaatgttttcagcctatatgatatttcctttcaagatcttaatagttgttttatgcaggttctctccgatgaaatttacgaacacataatttatgcaccagcaactcacacgagctttgcatctttaccaggaatgtgggacagaactcttactgtgaatggattttctaaggttagtctgtaatgttctatttctgttaagagttgcaggatgtattgttgatccctcattcttattttatactcaattgcctattctttatttcatagtgtgagtagtaattttagactgatccctcattcttattttatactcaattgcctattctttatttcatagtgtgagtagtaattttagacatgacatgaaggcctccaaatttgattgacacttttgagctgttttcctataggcctttgcaatgactggttggcggcttggatatattgctggtccaaaacattttgttgcagcatgtggaaagatccaaagtcaggtatgctacattttttattggtcactttctttcgtaagccttaccctatacatcatacatgtcttgatttccttttcctacagcctccatgacatcttacagattcttaagtttaacagattcagtatttgggaggaaacttaaaagaaattttctagcctaaacatttggaattagttggattattattgctggttcatattatatgctgtatatactggctgatgcatcttattgaatttagtttacttcaggggccagtagtatagctcagaaagctgcggttgctgcattaggactaggccatgctggcggggaggcagtttctaccatggtgaaagcatttagggagcgaagggatttcttggtaaaaagttttagagaaatagatggtgtcaagatatctgaaccccaggtgcaatttttttttttctttttccttaaataattctccttcttttgttttgtctcttccttttcatgtctgtttttctactcaaacataatttttctctttttatccgcagggagcattttatctattccttgatttcagcttctattatggaagagaagctgaagggtttggtaaaattgaggattctgagtccctttgtcgatatctactggatgtgggccaggtatatgcatgtaatggctttaaagattttagtgatttcatgagcaggaaatttcaaatggtcttgtattttacggtattgcctataaatagtcgagagttgttagcaaaaggccaaaaagtatgttctcacttttaaagtatgacccaacaagtgagagtgaaagttatctggaaggtgtcatccatggtcttttacagttaagcttagaccatcaatatgtatacaaagttgaaagagagaggaaagaaacatcgtatagttgaacttttaatgtctcactactcataagtcataacattgtcttttgccattttggcttacaggtagccctggtgccagggagtgcatttggaaatgacacttgcatccgcatctcttatgcagaatcgcttactaccctacaggcagctgtagaaagaattaagaaagcacttgtaccgctgagctctgctgcacttgtttagtgtcgatgttttttcgttgttatgcgtgtattttatttcggcaatgtgtaatctgttgattctgaaaataataagctttggctacttttccacaaatgaagtgatacaactgtcttattaatggtttaaaattataataacaaaattgtcctccttttttatgttacatatgttgtctcgaagcgaaggggaagcaaataaacaggcgttcgatggctacaatctgaaaagggcgtggtaatttttaaagtagaatccatgaagggataattttctcaggcaagagtttattagctagcactaataaaactatggaatatttgaattagccacaatcaaagtagcattgataactctggctaatggtaaatttcatgtttcgttttaggagagattgaatttgtggcgactccatctttgctacttttaacaactgcatacggaccctacgctgactagtagtacattgcgtttttgttttttttgttttttttttggtttatcaggggatgtaaattgtgaaaagtggtgcgtgtgtctcatttcatacagaatcgaaactgatccaacgaaacaatgaagtacaccccctccctccccctttttggtcaaaaaagtatacccctcaagtcgggccttggaagcaaggcttccatgaaagcccattaagaatagtggatgaaatggaagcccaatatgcccataagttgtaagccctgtaagatgtttcggccttcaacttttttttttcgggcatcgaggaagatgagttaggcttgcaagcgtaggcccaaattaagttaattaactggttgggaacaaagacgtggatgagttgattaattgatgcaatttgcggcatacatatgcttgatttggcatagaatcaattccaagataggagactgcttgacctaccccacaaccgcaagttttccaataggtagggacgtaaggttatggtctcattagaagtttcctgttggaaaggcaatgcaacaacacatacaaaaattaagagcgtgggagggaaggaaggtaagaactaagaaggaaaggcaattttaactctcttaaatattcccatctacaccaaactttaacattctccagaagctaaggagctcccattccccttaatgcaatcttgcatagtgacttcaacttggagacaatcaaccttcatacacaagaatttggttttcctctgcatgcacttttctgtcccaaaagtaccactttcccatctaaacttcatctatatatacatacatatatatatatatatatatacatatatatattaattagtaaacataggaaaccaagttggagagaagcaaaaaaaaaaaaacaaaaggcttgtgagttgtgatcatggacgtctcttattcatgcaatgaacaacaagcacccgagatcgttttctttgatttggaaactacagtgcccaaaaggagtggagagcgtttctgggttctggagtttggtgctattgtagttacactccacaaactcaccgagattgagagctacaccacgctgataagacccaaagacctatctgtggtctcagtgaaatccagcagaagtgatggaataactcgtaaagccgttgaaaatgcaccatcttttgaagatgttgcagacagaatattcagtatcttgaatggaagggtgtgggtggggcataacatccagagatttgactgtattcgaatcaaagaggcctttgatgatattcataggtcagcaccagttcccgttggaatcattgattctttgggggttctaactgacaagtttggaagaagagctggtaacatgaaggtatgtaagaaatagcagcagcaagtgattcattcttcacacaacaaaaacaaaatcctcataattatttcaagttcttaattgctgttattttttatgggcagatggcaacactggcttcttattttggcctgggccaacaaaaacacaggtacacatttctaactctagtgccaaatgcattgtaatattgtattaatttgagtattatatgtgcatgagtttaattttaatacactaaccaatttttatatgatattatatagtggcttttgtaaaatttgagtgatgtggatatatatatgactattttgaagcaggagcctggatgatgttcgcatgaacttggaggtgcttaagcactgtgcaacggtgttgtttctggtgtgaaattaatctccatgttcaattctacctggttacttttgaaaacaaatattccacctagcagcatgattctcacacgtttgttatggcttatggatgatgttaggaatctagtctaccaaacacattgcatagaaaatggtatggatcttccagcgttatgacgcgaagcagaagcaatgggaaatctccctgcaaggaagagactagcagaaaatctccccaacttcatatggatatcataggacagtcccctatgctaggggaagtttgggaaaggttttattttatatattgacataatattagattttcaagtgcatgttcagtatacattatttttggaaatatatataacctcaaatacatatagtataatgataatggaaattctttaaatgtaggtgaccgaaagagtgaagggatttttgtgtaaagcacaagggcaaccaccacttcaacaactactcaagcattctcattcattactgttatggtcatcctgtttagatcacgtagatgttatagtttgggcctgggcccaattgtaatggatgatcgtgcaaataacttatccatggaacgtagaggctgacttggtccatactgaacgttgagaacgtgctggatgaggccgggaatccaggaagcagtttcagtacccgttacgaggtaatctaccaacaaatacacattaattcctggtgaaaggtacacacattctaactttctctttcaattacacagagcacacaccccacgtccattggtgtatctctgtgatcttctgcttcaaggtatcattctccattgatatccttggacttgcagagttagagtgatcaaatagcaaacacgtagtactttcgtgctacacagttgtgttctggaaatatacagaacattggcgccgtctgtggggaacaataaaattcgagtccaacacctttcaacaatggtaaacacaagaaacagccactctgtaccacattcagagatgccgaacagggagatttgcctaccggagaatcagaacgtggcacggagggaagaagtacatgtgacgaaagctgtttccgacaaggcttcttctcccgctcagacagaccaacagaggactccaccagtgcgaaggatgggccaggagggggagctcggaggacaactcgttagcaatgtcctcaattcaatcctaactcgaattgagaacatggagaaatgacaaaatttacagagacaggaagacattcgaaacattactcgccaaatggaagaacgtaatgaggagtggagacttgccgaaatgcaacgaacggcacaattggaacagcagctgcgaatgatagcagaccgagtacaactttcaaatcctgaggaggagacgcaggatttgaggatgcacctgaatcaaaggagaagtactgacccggaagatcaaaggcggatagaggagccacaagatctgaggacacacctaaaccaaagaagagatgccgaaccgggagatcaaaggaggatagatgagccgcatcggagtcaaaaccgggcacagaatgaggcacgagatggagtctacacaaaccagagccgtgacgaaaacccgaatattcgagcaaaacgtgacgacaatcccactgatagggcaaacaatgaaaggatcccgccagacagcggacatgataaggcgggagagcagaattttcgcgagaagacaggaccagtatatcgtcggaaatatagcaggggacagcaaaataatagtccattcgtggacgacatcgtaaatgctcgatatctggatgacttcgatgggtcattcctatcaaagtatgacggaacacaggacccgcaagtgcatatcgacgaattcgacctgcagatgtgtgtccggggcatcgatgagcccataatatcgaggatttttgttacaacattaacgggcccggcgcagacgtggttccacacgttaccgcctaggtcaataaaagatttcgaagactttggccagaaatttttattgaatttcgcaactagcaaaaagcagccgaaatccgagttcacccttggcaaagtcagacagttacccggagaaacgctgcagagttatctagacagattcaaagaagccgccctgcaggttgatgggctcgaagaaagagttcatgtatacttaatatcggctggactcgatggttcgtcaagatttgccaaatccatttataaagatccggtgaagtctttgatggaatttcgtgcccgcgcgaagaaatacttggagttggaacagatggaggtcgtcaacaactcgggacgaggaaaagagcgtcatgaaaggagaagcccacccccaaaaaataggggatacccggagagtcgagctcggaataatgatccaaaatctcgaccaggaagatacgaaaacaaatatgacaaatacactccactgaacgtatcccgttcacaaatttggaaggaggtcgcacttacagagatgaagaaggttgaacgaccccgcccgattttcaacagggccggattggacaagtcacgattttgtgaattccacaacggacccgggcacaccacggatcaatgttgggatttgcgggatgcaattgagaagttcatctgggaaggacgattaaagcaatatgtcatccggacacaaggaaggaagaacaaacgaaagggagacgagaatcaaaatagagacgaaggaaagagaccccgagagggcaatgatgagttcccagaacccgagttcgaatgcaacgtcatttccggaggcatgggcggtggcggggatactgccactcaaaggaaaaaatatctgaaggaagtgttatcggtccaggcacaacctaagttcaaaactcggaccggacaaccagaacctccgctcttgtatttcacaaaacaagacatggagggggtggtacccggacatgaagacgggctggtgatatcggcgacggtggaaaattgccaggtaagaaggatgtacgtagacaacggaagctccgccgatataattttgttgaatgcatttcggaagatgaaattggacgtaaaggaattaaggccgtgcaaaacgatgttgatcggttttaatggcggcaacacgaacgtaatgggatctatccgcttgcggttaaccttgggaacgagaaaagcctacaagtcggaagaagtggaattcgtcgtggcagattttccatctcaatataatatgatattgggaagaccaaccatacataagtgggacattttaatgtccacaaagcaccagaaactcaaattcattggcagcaacaggcaggtggtaaccgtatgcagtgatcagaaagaatctcgacaatgttattacgatacggttcgaaaaagtgaacgagaagccaacgacgacgttcataattatgtacgttcagtaaatgtggtggaattggatatgcgagaagcctcggatgagtggaggtcggaaccagtggagaaagtcgagcagattctgattggagaccaggtcggccagtgaccagcattggtggaacattggagcccgaacaaagggagcaattgatcaaatgtctcaagaaaaaccgcgatgtattcgcatggaaggcgtcagagataccaggcgtcgatcccgagttctgcagtcacagattggcaatgtacccggggtcgaaaccggtggaacagaagaaacgaaaattgggaccagagagagctcaagccttgcaggcccacattgatgagctgttgcaggccggcttcatacgcgaagtccaatacaccacttggttatcgaacgtcgtaatggttcgtaagccgaatgggaaatggagagtgtgcacggattacacagacttgaacaagatgtgccccaaggatgcatatcccatgccgaacatagaccagctggtggacaattcatccgggtacaggatcttatcgttcatggatgcattttccgggtacaatcagatcgcaatgcacccggacgatcaggagaaaacggctttcataggcgacaaagccaactactgctataatgtcatgccgtttgggctcaagaacgcaggggccacatatcaaaagatgatgaatagagtattcgagtcacaactcgggtgaaatatcgaggtttatatagacgacttgatagtcaaaaccgcgaaggttaacgagcatgtcgaggatcttgaagaaacctttggccgactacgcaagtttaacatccggctcaatccgttaaaatgtacctttggagtcggggccggaaagttcttgggctttatgttaacacacagaggaatagaagctaatccggataagtgccgtgctgtgctggatatgcaattcccgaccagtaagaaagaagttcaacagttaacgggtagaatagccgccctcacacgttttatgccaaaatcagcagagaaggcattgccgtttttcaagttgttgaagaaacaagctgtcataggatgaaactcggaatgtgagaccgcctttactgacatgaagagatctttggcgtcgcccccagtattgtcaaggccggaagcaggagaaatattggtcatgtacttgtcggtaggcgaagaagccgtaagtgcagtcctagtaagagaggtggagtccacacagaagccggtatactttgtaagccgagcgttgcgcgactccgagttgcggtatcaaaagttagaaaagttggttttcgccttgatcatcgccgccaaaaaactgcgtccatattttcagagccatactatagtcatacggacagatcagccaattcgacagatcttacataagccggacttggcaggaagattgaccaactgggcaatccagttgtccgagtttgatttgaaatttgaggctcatcatgcgatcaaatctcaagcgttggcagatttcatccgagaactcaccccctacaccccgacaattggggagtggtggactctatacgtggacggatcctccaacaagaaagggagcggagccggaatcataattgagaatccggaaggagtagcaacggaaatttcactgcaattagatttttcgacgtcaaacaaccaagccgaatacgaagccttgatcgccgggctcgtacaagcaaaggaacaagaagccaagaacgtgaaagtttacacagattcacagttagttgcatctcaaattgaaggacgatatcaagtgaaaggtcccttgctggcaaagtacttgagccgagtaaaagaattgatatccgagttcggcgagattatggtcaatcacatccctagagaagaaaatgcccgggccgatatcttgtcaaagctggcaagcactaaaaaacccgggaacaatcggaccgtgattcaacaatagacgttacagccgtcgtgcataatgatgatcaccaccgacaatgattggcgacgaccaatagtaagttatctggagaaggggactttaccagacaacgagctagaagctcgacgtttgatacgaacgtcgactatgttcacaattattgacggggagctatacagaaaaggattgcatagccctttgttggtatgtgtggccccaaaccgagtaggatatatcctgtctgaaatacatgaaggtattaacgggcaacacatggggggcagagcactgacaagaaaggcactccgggctggatacttctggccgacaatgagtgcggatgccaccaagcacgtaaggtcatgtgagaactgccagatgcacgcttcaaaggtattatccccgcctgaagaattacaatctatttcggctccatggccattttataaatggggtgtggatcttttgggtccattcaagtcgtcggaaggacagatgaagtggttgatagtcgccgtagattattatacaaaatggatagaggtgtctcccttggccacaatcacttcggcccgagtgcaaaaattttttgagaggaatataatctctcaattcggaattcccggagaggtggttactgacaacgacacccagttcacggacaaaggatttcaagagatgatggctagctttcatattcgacaccggtttgggtcggtagagcaccctcaatccaacggccaagcagaggccgccaacaaagtaatccttgaggccctacggaagcggatgcacgatgccgggtcgacctggatagagcaactatattatgtcctatggggaattcgaacctctgtccagtcgtcaaccggggagaccccatttcgaatgacttacggaaatgaagccatgatcccagtcgaagtcggacaacagtcatggcggcgtactcaaatgctgcgaggcggagaggtctcaaacaatgagatcttggcattggagtcggcacttcttgaagaagtccggacaacggctcacgcccgagaattaaagataaaacaacagatggcgtatgcttataacaagaaagtggtcccgcgacagtttgaagagactgacttggtactgcgacgtgctgacatcggaaataaaaacgctagggacggaaagttagcagccaactgggagggcccgtatcgggtcgttaaaaaattagacaaaggagcatatatgttagaaacgctccaaggcaaactagtcaagcgaacatggaatgccgacaaattgaagaaatattacagttgaagtctcgacctccctttttaacaggggtacggattcggaaaatgttacatccgagtctatatggtctatgtctaccgagggtacacgaggcagtagaacgatgtaatctcgttatcgagggtatgggttcggaatacatatatccgagcccatatggtcctttttacgatgaagacattgctaataaatacgaactcggaagcctaccttctgagcacattattttcattgttttgaataagttatatcgttgtaatttctaagtgtcagtctgattctattcggacacacatatgcgacgaatataaatgcaagcattactccttatcatgatatctttattcacgattaagtaatgactttgaatgagacgttcaatgcgaatataaatgcaagtattattcggatacatataatcttcgtgatataatgacgactttgaacgataagttagatggtcttgatcaaaccattaatgggtctatcccttagcgaagtcgttcatagtcaagttattcgcggaatacaaaaaggataaacggtctttggaaccaaaagatgcacgcgcaagatattgtatgaatcaagtaaagagcttgagtaatatataaatgggctaagtaattgttccgggcaccgggcccaacaaagaaaatgaaatacataagtaaaaaccggcatcccggcccttcagttttgtggaggcagggcgtcagtagcaggttgcaacggaatggcatcagagacagggtcggcaccagacggggtggcatcaacggaagcagtggcaccaacggaagcatcaagagtaggttctcccattgccaaaacttctgttgtagccgccgatgggtcttcagatgcaggaggggggaagagttgcccatcttcgacatacgccaagaaatgcatcccgacagtagtcatagctaccctagggttcaaaaaagtgatctgttcaagggcgttgttgaagccatcctcggcagcgtcacgaagggtctccttcatagcagctagccgacccttgtaatcccggacgcaggcttctttgtcggccttggcagaatcgagggacgaagtcaagagggccaccttctggtcagcagcttcaagggaaccctgagactgcgccaaatctacccgcagggaggcggaaacggcttgggacttaagcaattcttccctcaaaaggttaagttcttccgccgactgcgtttgaagggtagcaaattgagccttaaaggaaacaagttcctcaatagctttatctttttcctccaccgcaaccccgtacctgcaacacgaatacttagaaatatacacaccatataagtagagataaaatgtcatgaggagaacacatacctttcccggacagtggtaagtgctcgagcaagagaagcactgcgaaaggcattctcctcgatccgaaccagttcggccagttcttctcctaccggggcccccgatttgagcatgtatgcagggggtttggtcaaacgaaccaactcttcagtaacccctttcttccatacattgtccgagcgaacccgcatctcaggatgctcggagtcagcagtaggggtagtacgtgggcggccacccgccacggtaagatccacggtttcgaccaccgaaaccggggtcagagttgttgaggaaagaggcagtggaacagtcggagctttcgacgccgttttttgggtaccttcgtcaaaaaacgccctataaggagggggaccacgttttttaggcggagcgccgagcttgtcagttgccggcctcttgcctttgcccttgacctcggttggcttggaaaggtggccgacatcagttttggccttaggaggaggtcgtgatcccattccggctacaatcagaaaacattacaattaatacaagtacaattataaactgagataatgcagttatcaaagcagaccattttgacgaccaccgccaatgtagttagaagtctgaggctgaccgtgagtgtttataaactcagaaatcacgaaaatagaagaagcatccgagtcggaaagctcctcctcgacaaaccggtagttggaatgatcctgtttgtaatgatcatccgaccagtacaaaggaaaaacccattccacatcagatgactcaggtccggacaagaagaagggttgctgatgaggttccgcggcaaccttaaagtacttgtctttgaagccccggaaggagtctgagaagggatcgaagagttttcgcttactctgactacgaaaagaaatccatcctttccggtcagaaggttctttacccgttctacgggtatgaggagagtagtagtagaagaagagaggaactgtgcaagggattcctaaatccgtgcaaaataattcaaaagtacggataaacccccaactatttggatggagttgggaaggggctacccggaggtgatttaaaacttcaatctcaaaggaggaaaagggaaaggtaatacctatttgagttatgacatcttgaaaaaagaagaagaagttgggattgttaccctcccgttgagcacaaatcggctcaccgggcaggggagcctgaagggcgaacccatcttgcttccctactggggtcgacactatgctgggtaggtcgaggacagaagaagtgcgaaggatttcataagtgacccaagggaacttagacgctaatgctaggggcacatctgaatgggactctacagaagcagactcgtccatagtttccgaagtagcacccattatacctacgaaaatgaagtggggaaataaaagttagcaaagcgtacctggaggtaacgcattaaattcacaagaaaccgaggccgaaaccccgtcgacgacagaacgagtatgcgatcccggttgcaaatccttggaagcaggacgcaaaatggggttatgacgacatgacctaaagatcgaatcagcaatgtcgttggaacctatttgaacataatggatggccgcggatacacaatccatacatgcatcatactcaacctccattacttcaaccgaggacgaggaggattcctcatcggaagaaggagagaggccatctggagggttagggtgacggcaagagagtcctaaagaaagaccttgtggactaccagtatcaatgttgggcccaagaaccgaagagtccaaagaagataaagttctagaagaatctaggcctaatattgggcctaagggttttggcttagggtctacagaaaccggaagaggcaggggaaatgaaggggcggaaccgccgagagtggcggtgatcttttgttttccagaggaggaagaacctccggtgtgacggcgaagggggtcgttttcactttcccccgccagaagtggaaggccaaacaatagccaagcggctctagggccaaactttttccttatctctgtctcctcttcaggggtcattctcagggcaacttaaagaaaatcaagagggaatcgaagagaaagagaatgatatggttacaaaacgcgaagaaaaacccagaaaccaagaaaagtcagaaagaaaatatgatgcaaccctaagaatcttgatgctggcagagtcacgataatgcaaaaacactaaatgatacagaaagaaaggagaaagaaggtacctgtggtaatgaggaattgaaggctgattggaagaagaacgaaaggggaacttgaagaaaatatgagagggtgcttgaaaagttaatgaaagagaagagaggaaataatagcagaaaataggcagaagtgacaagcacaagaaaagtaggcacgaatacgcaactttgaagataaaaatttgaaaatgtgatggtaacttgcagtaaccgccagaaggaaggaaacggttcagtcaccacaatgaaacgacacgcaggggtatcatggtaaaaacacgtccaattgtaagggcaggaaagtaaagtcgcgtcaatagtaatcattaccaggcgaatgaagtgatagaccctttaaaggcatttattgccattaagggcggaaaaagtaattgatttgaatcaggaaggtcaacagccgtttcagatacgtcataaacaacccgggtacattactcgtccaaggcaaatccgaccacatctattcggataagttctgtcgactatacatttgattatatttatatccagcataacctgaatacttgcgtccacaaaagtctagtcggaaatgtttgtatatccggatattcacatgattttgaaagtagactgaataaagcagagttatagaaatacgtctccgaacgtttgaagaacggtgcccggatgaacgtggttggataagttgtccggaatactgtggatgggagatgatacccaaataatactctgcacgaaggaagccgactaatcgtagtcggattaattgtagtcggattgattgttaccctgaagcctgcaaatcacctgatgcatcccgactgccaagtatacttggtaaccgggctggggggcaactgttatggtcatcctgtttagatcacatagatgttatagtttgggcctgggcccaattgtaatggatgatcgtgcaaataacttatccatggaacgtggaggctgacttggtccatactgaacgttgagaacgtgctggatgaggccgggaatccaggaagcagttccagtacccgttacgaggtaatctacctacaaatacacattaattcctggtgaaaggtacacacattctaactctctctttcaattacacagaacacacaccccacgtccattggtgtatctctgtgatcttctgcttcaaggtatcattctgttggatatttgttgaaccctttatgcataaaacgatttataaagttttgatgataacaaataatgaatgtcacattattagattaatggcaatgataataattatttgatattttgaagttactaatattttggatttgatattttgaagttattgatattttgaatttatgaagatcagcataattgataagat

SEQ ID NO: 34 - DNA, 1000000 bp, Glycine tomentella
tattgacatatcaactaacatatatttattaaaatttaaattaaataattaatagtatattaaaaattcaaaataatataaaaaattactcctataattataaaatataaatataatatttgtgctagtcatgcgacactaactaattaagttagtatggtaagaaaatacattcatatataccaacttcagtacatatataatataattcatcaatttccttaaaaagatattcataacctaaaaaatttgtccgaaaacactcctatgaaaaagaaaagagaaaacgcatttatttaccaatttcatgtacacaacacattcgattatcatcaataaaccacgaatataaaacaataaaactggtgaagaaatatgtaaaattgaattattaaatcttaataaatttaattagaatggattgacaatataaactataaatataaataattaaatcgatgacgacatatgtaaaattacagtattgaatattttagataccatttttaatgaatttaattataataatataaaaacaatttattattatgctatataacataataataaattgttttatattattatatattcatcaattgatttttaattttaaattgactattttaaaatttatatttaaaatatctaattaattggtacaatatttttagaaagttaaatttttggatttaagacaagacttaaatttaaaatcactatccgctggtaagaacaattcggtctacatattcaatgatgtataaattttagattgataatatagcataaaagaaatatataacggggattctatatagctttaattagtgcatgatggtgagttaataattgattaaaggaagagagaaatcacattccaattaccccgatatattccccaaatcgccatgccttttcactgtttagtttttagcaacacgtacgcgaatattttcttgcctctcgtcccttttcggtggttttcttctctgctattattttccaccatctgtcaacaatcaatcaaaacaactaaatagatggatacccgaatagctgaaaaagatatgtatgagtgtgtgtggatgatcgatgagaaaaacgagactaatcaaaggttaagaaaatttgaaaagtaatccccgaagaaagaaaagaagaagaaacaaatatttggtcaattttttatgtttatttatttttgtgttgttttctaaggtgtgaccatgctgtacgtaaactgctaaagccaaattggacgaatgtagaaaggtacgtagaacaaccatacgaggcgataatgcaattattcgaatattcccgtactactatttgaaattaattatatcatattatgtatggaagataatttttcaatttcctcacttgaatttcttcttttgtttttgttcaattttgttttcgctttgttcccgagaaggaaactctgtcacaggtgatgcacaccacaaatatttagagatcaagccaaatttccttattaatatatgatgcttttacctaacctaaccacggaaacaatttgaaattttagatgcttcaaacgcgtgataagacagcactaactatatcatttactaatttttttagtattgttttgcagtttaattttttttaaaaaaaacttattaattacatttaaaattaataatagcaattaacattactgttataagtcactcagttgtaacttgcacgttcacaggctagctaaatgatcaataaacttagaagaaaaacatacatgctggtcaagcaaagtgtcaacttacaaacccacggtttcatcttaattaagaagaagaaaaaatacagccgtacgagctagaaatttaatatactttgggttgtggaatctatttgtatttttgttatatgaaattgcataatctctatacattgagattaagaaaatcaacaaatacttctgagggaacaaaacctttcttagagaaggcattgcatgtattgattattcattgtactaagaattaatctaatcacatgtgttatcgtaaaaacaatagccgagagggttcttaactgttgaattttctgtgattcctccaagtccttttgtccctaagtgcatttaaaagtgttggtatattccttttggaaaagtcgtaaaattcggaaacacaaaaaaagaatacaagtgagaccctctccctctagcttgtgcggaggatgatggaagagataccttaatgatgatgcacgagaggtaacagccattttcttgatttatagatttgatatgaagatagtgatatgaatagataaacatatataattttcaatttgggaatgcgactgacatttggagcagttgataccagtcgccattttgacaagtccaatgccacctaacaattttccatattctttttttctccttcccgtaaaccttattagccctttcttttggggtacattaaactattcctaatttatttgattcaaacgctgtattaaggaggcactcgagatttttggaaattttagtgttagataataaattgtaattgacagaaatataaaaggaaagttaagtggtggaaactgaaagagcaaagcaaaaaggttggaggtaggactgcgtcaaagccacattacaagtctacgtagtgggtgtggtggggtcatgtggtccaaccatttgggtatggtcatggtagttttaatgtgtagcactaaaaaatgttttcttttttccttttatgtaagtaaaacgttatttctaacaaaaaaaaagagtctttttagagaaaattaattttctaatacagttattatatgtttacattagtagatgatgtaacgtctaaagttcatttatttaatttcttaactattttattttatgttatatttttattttactcttttgtcttttaaaccaaataaaataaaatgaaatttcagtagacacaaaagaagttaacaaaaggaacgaaatataaatatacaccatattacatgtttagtctattttatattgtcatattcatactaactatatttgacattccatatgtcataatacttcaaacattttttatttaagtataaagtttttcagctagtattcaaatatagtctttggtactatttccgtcactgagtacgatgatggggttggtaaccgagtttggatacatcggagcaaactgagagaacggattggttgggtcaaactcttcactaaacaccaaaattggaaaatgggcgccgaagtaaatatgagcacgcagtacatgatgcatagttactacataatagtttctgacttcatccacataccagatatccagtacatcaagaaatactatgatcgaagccatctaaaataaaaataaatctagtgagaaataaatttctcagtaggcaaatctaaaccactaaataggttagtaggttatgaaataagacaaaactaattcatcaaataatttaatagagtagtaaataaattaatatatctgagcgaatgtgtaaaatgaatgtatgaatgcatagaatgaaatgcaatggtcacaggtgcacatggcctctacatatgtatattatgtaggaatgctgcggtcttcttacgctaatcatgcatgaatttccatgtattagcacctgatctttggtagtaacataggtctggtcttcaaaactcgagtcaatctcataaattcataggtccgttctggaaacccgaatcattctcattcataccacaaaattcataagataaggaaaatattcctattcttacaaaaagcaaggtagttaataattaagtattcttcgttcctaagcaaggtagttaatagttcataccttgttcacgtaaaatttcaccaactaaaataaatctatttaacctctacgggatgtcgatttttagtggtataataattgtagccaaaaatcgggttcgtgaaacaatgagaataatatatatatatatatatatatatatatatatatatatatatattaaaacacagctagttatagcaaaatatagtactcagaataattgtacttgtattacttaaagcctattaggtttacttgcggtttaaccaggtttattatatatatatatatatatttatatatgtctatatatatgtatttatagtatatatatatatatatatatataaaagacattaaataattacttaagtactataactatatatatataagataactatttatgtattatagttatatatatatatatataagacattaaataaattcttaagtactatagctgcttacttggaagggccgaggtaaatatggatatataaggaggaagcattatgtggaagtaaagcttacaggctgctggaatccatatatatatatatatatataagcatggtatggcataggtacaaaggtgcttctaaatgtaaggctggctaaactacatgcacgtggtcagagctgctggattctatttattccttatgagtcaagatctatgtgtataaataccctaaagaataattactacagtatctacggaccgagatgcatgaatagagatatctaaactattatcataagtgtgccgagatacccttcgtaagtttccttcacacacacacacacatatatatatatatatatatatatatatatatatattctaggttgccgcatcttgctaaaaattcacaatatcctatttatggtaaaacttcaatctttaactaattaacggttaaccatggcctcataaatacataacttaatcgtaaattttagtttcaaattttgagatcgaaacccagcctacctatgataattttggtgagttgctttgagagctgctggagtaattttacgtgagagagagaagtgtgaggtgagaaaattgagagattttggggcagaaattttgtaagctgccaagctatttttatattgctggttatgataaaatatctaagcttccttatttcattcatcattactattattcctctcattaatgcgtgcatttacgtggaacagctgagagcttagctgagggggttttgccacctggaagatttcctaaggatttggattcaacttgtaattcctcacatggctgagagctaatgctagagtttacattaatatttgttgaaaattatttttattttttttaataatattacctattctatttttataattttatattataattatataattgaagttattacaattattaaatagaagttaaaagtataataattagttatgcatttatttatttattttatatatatatatatttatttatttttctaggatgttacagatgatgtacgctaataatatgcacaactattttcattatatcaatggataaatatataatatttattaatgtacaagtttaacgataattttttttttgttagaatcaatacaataattatgtcatatattaaggaggaaaaatttagttgcaaggtttactctcatgagtgtaattttgtttaaagaaaaataaatgcttagtaaatattaactatatatatataataataagtattatataaaatatatatttttgtatatattataattctaacaagattatcaaagtaaaaatttaaatacagacacatatgtcaacacccaattttgtccgcttttcttaatattttattttctaacatgaaataaataaattactcttaattgctaaaattggatcattccatagctgagcccaatacaagatatgcaacaaaataaataatgaaagaataataataaaacgaaagcatattgggccaacaaaacagcactctcaatgtccaatgcgtattgctattggccctaacactttagtcatcccacaattgtcgcttgaaaaattgtacaataaaatcttatttttgttgtgttatttgattttactccaaaataatataacgaaattaagattctgttgtattattttactttcactctttattgtacgacaaaaaattgactctattatgttacttatccaataatacaataaaattatatttttgttgtaggttttttttttgttttaaaaaacatcataacaaaaatacaatttcattatattattcatccaataacacaataaaatcttagtttcgtcatgatgtttttctaaacaaaacaaaacacagcagaattacacttttattgtggtgttttctaaaaaaaaagtgtataaaaaacaaaaaaaaaaaagtgtaactagagtgttactaaggaccaatacatactagaattctagaaggatgatgaaaaaaatttaattttgttttattaaacacccaaaaaaaagatttaatcctatttaataaaatgtatgttgagttatgactattgactaatgactaatttagatgacaagccatttcttttgcatataggaattggatccaatccattcaaagcagcccctggaggaagaataagcttggaaagcaaggcagtatttggatgttttatagcagaaataggtgcacgtcatgggtttcagtttttgccaccaaaaaccctttccaccattattagtgcataataatagttagtctcagtcatacccattcctaggtttatgctgttttcttcccagcatcgctccactgctgcggccctcgctgttcttcaaaggtcactctctaaaatccccacttttatatgtaattggggattttgttttcccacttagtttaattaattttgacgaattgcatcataggcatttgttatgtttataggtgtgttccctctaggataactcaatctgttagatatacaaaatcaacaaaacacggtaaaacaaaacacgatcttcatcctgtattccacccagaatccacctccacttcccaggtttctcgctcatggggtgcctatgttgttgtatgttcccttactccactttttgtctcttattgttgcattgctattcaacatccgcgtgattgtttacctcatttcaagtaaattgaattctgtgttttattccatttaactgcagccagctgctgttctaggatttgccgggcttgcagctttttttcactataatgatgagaggagagcggttcccaaaggtatttgcaatctggtattctcaattgatatctgctttgaagagtttggagttcaattatttggtgacaagtgtttctttttatctgtacccttctttaattattatgccctttcatcatgagaaatatttgcaatcttttattcctttcttatattttgttgctacgcatgttatcttgagtccagtttacaccgaaaggaaattcttacaggtttcggattgttagtgtcaaatatggttatgataaaggaggtcagagggtctaagtatatcagtgatctggcgtactggttataaagtttcagtggtgtttcatgaactatggagtaaggtctaagtatatgttagaattaatttttgaaatatgacctgatggttttggctttatggcactctgttaaatccgttgatgcaatttatgaacatgcaagcattttgcaaatgggaaactttccatggtcaaaattttgacatgacatacactgagtaacatcagtgtctaaaaatgacgagctatgcaccttttgctcattttttgcttagttatttacttatatcattaagttttttatcgcagcattgtgccaaatctacatctaccaagtcgcttttagtgccatttaatgattaggcatgtgaatgtgtatatgtatttggggacaggcttcgcttaattgccagataaacacatttgattagatgctcagttcctcttagtttaatccaacttggtttctttctgttgatgaatccaatttgaaaaagagtcaaaagaaatggttcgatcctcttatttttatttctcaaagggagagatccatgaatcgggatcctaatgcatatagatacaaatggtccaatgggagtaagaatttccaggaacattggaactatttcatttctgagcagaatagccgttttcaagtagtgtttgatcgattacatatttatcaatattcaattgattggtctgaagttattgacaaaaaacatttgtctaagtcactttgtttctttttgtctaagttacttcttttttttgcccaagtttcttctctttttgtctaactcacttcctgaatattctaatttatgtctcaataataaaatgtttctatttgttcttcatatgtatcagtgagctacatatgctttgatgagaatatatggtaaattatcaagaacaattcattacatcagaatgtagggtggatatataatctgttacatttttgcaagattattccaatacataaaggaagtggtaatggcatcataatttgctacttcttaattcttaatgaagatccattttttgttgtgttaaaactgtataatctcttctttgcaaaggtttctgttttgcaaagtaggcaattgttgggacttgttactggagcttgggatagatcctagtcccattgctttatgacttaattggttggatttttattgtctaacctgacctgtgacttgcaaatgtaaagcatgcagttgagttgaccaggtcaatactttgtaagaattacacacactcgactaaatgtttaccttgctcttatccaagattattcatagaatcacttgtgacttctgggtgagatggtttcattttcattttgaagttgtcaatttccaggtttagtcatcaaagtttagcaagttatcggattacattagtgtcatcccaatataagttttaaagtatgttttatttccattgtcctaatttctttatttcttggatcaggtcatcagggtggtggcctcagaaatgttgccaatggacccataattgggggtccatttacactaattaatacagagaaacaagcaattacagaacataattttcttgggaattgggtcttgctctactttggctatacctcatcccccgatcttgggccagagcaagtccaaattatggcccaggcaattgatatattaggtttggcacttcaatctcagtttactgtgttataagtttctttctctgggttaaccttaatattatgtattttatttggataaagaatcaaaacagaatcttaagattcttccagtatttgtttccattgatcctcaacgtgatacgccctcacaacttcgtgcctaccttaaaggttatattgtcttgctggcaaaacttcacttttaattacttcaaattttagctttggtcaattatgctttatgcttgatattcaggtgtgcttatgatagctgagatagggggtgccaacatagttgggatgtcctacctcattgccattccttagttcacctttccaaaatgttctacccttttggctttgctctactaacgtttcttgtctatctttccctctgttgtgttgcagagtttgactcaagaatcataggattaactggacctgttgcagctattaggcagatggctcaagaatatcgtgtttactttaaaaaggtagaagaggatggcagtgattatcttgttgactgttcccacaacatgtaagcacttgttctacccttattcatccttctgtagctctgtatggttgcatttaaacatggatataaactatgttaaaacaattaggtatttgctgaatcctaaaatggaggttacaagatgctttggtgtcgagtataatgcagaggagttgtcagaagcgatagggaaagagctgaacagaaacccctcttgatactttcgatgcagcctgatattattttttacccacgcttctgtttttctttttcttttaattggatcacagaatcatttacatttgacaaattaagttttacttttagaggattggatttagctctgctttattttcaactagacttgcagaaaattgtagtgacaatctgagcttcattttaagtttcgcgggcatttagtttttggcttacatcttagatggatgttttatacttgaatgttttcacatccaccttcgtctaacaagcactttggttttagttcatgacttcatactgtcacgtgtaagtttgctagtcctattcctggacttcgtttcttatatgccacctattagaagtttaaactagttaattatgaaaactacaatcgcatgagatctatagatgtaaatttgaccattaaatcctatgtaaaagtagaaaataaagttgtgatattgtaaatggttatgcaacattttaatcttaaaatatttatataaaattgtattgttaagatagtttcattaacccgtaatacaatgtataataagaatataaaattgtatatttatattcttattctattaggtttagtcaatggcatggattataggatgtgatgtaattggactcagttaagaactgatttttttagagatattttataatgaaaattcttctaataatttgctctaatgttcttaatctctttttaagggtttctgttaccttttcagctttagttttgtgattacaagtcgaattttatttgtcttcttgaatccatcgtctcaatcgttgtttatcaatgaaaaacttaaaaaatattagttctcatttttcttattttcccccttttcatctttaatatatcttacttgttgacattaacatgcatgttctttcctctagtttttcttgtataccaaagtttaaatactattaagtgcctatctcagcttcttctccaacttatttgacacatgatgttaatatttttctgaataaatatgtccaccatctccaaagatttatcaaaataccaattaaaaaatggaaacactacggtttgtttaagggtcgatgtagcgactcaaaccatgcagcaagttaattacatataacaacataatattaatactcataatctatcgtgagggttcgtgcccatgaccgggtgggtctctgggttcctgccataatcaaacaagcatctgaaacaaaacaataaaaaaactaactcatttgtgtatcagtactctgtgtcccttctagatgatgcaatttcatatgacctttccaactgcaagaaattttgtttccaaggagtccctccaggatctaggatcgaagttggtgctgtgtttcaatgttcgatttcacatggtttggttggagatgtttgaagtcatcattttatagaatcaatctttatttgtacaattcttcgttttccttgaattctgatttctgggcatgtaatatactaagagattcaaccagccaaccaatctattaaaatctaatctcccttagaaatatagtagtcctttatcatcatcttagtgaagcatcctttaacataagcaaaaagacaaacaatccaaaccattggaacatgggaaacaactccccacagggaaaatgtggttgtggtggtttcataaatggagtattctgacgttctcctcccaacaacaacaacaacaatgccaacaactttgaaaagtcatcaaacgcccctgacaaaaaaaaagatcaaggtggctgtgaagatataactttctccgtaacagcttcatctaataactcttcaactcgttctggctccaagcctctccacaagccaaaccctgttgttaaccgaacccaccaaaggaaccatcccaaagtgtcacctacggagggctatgtcaacaatggaagaagggtccctaaagaagcaattggtatttctggtgaacttgaaagcatgatcaccgatcgtcaaaagggaagcagcacccttgttcgtgcttcttctagcaacgtgatgatgtttggtaatttaggtaacctcaggcaaggagggaacacagatacctattctaacacaaacacctattctcagaaccctgttactagtggaagatactcaaaccaaacggtggagaatgtaagtaaaggaagcaaggaacaaccgggttctctatttcagggccgtgtccactagaatgaacccccaatgaggattataagaatggaagatttcaagaagcattggctctttacatgctgctgcaattgcaattgaccctaataaagcttcctacaggagcaacaaaattgcagcattaacggctctagggaggcttctggaggctgtgtttgaatgcagagaagcttttcaaatagagcctcgttatcaaagagctcattaccgattgggaaacttgaacatgagtaatctcacacaagaaaaagatggtgattgcagaatatactccttccaactcttctattttttttctttctttcttaatggtgttgtcactaattggtagtttctgtttccctacagattaggagaaatggataaggctctttatcattataaacaagcaggaccagaggctgacacagaccagattgctaaagtcaaaaaaattcaggtccatttgaacaaatgcacgtaggctaggagattggaacaagttgattaaggagaccaactatactatttcatttggtgcagattctgctccacaggttagctactagcctctattacacgagaaattattacatgatctagagtcattttggtctcgatcaatctccacaagtaacacagctttactaactttttcattcatggaaaacctgagttatatgtaatgtaaatattgattgagaccatagacatatggtagtcttgaatcatgtaataatttctcctattacacattgaactctgaattagatcttacccgcgatcgatcacatgcacatgcatttcaatcatgctgatatgactctgattgtggctttacttgaagatatttgcgttgcaagccgaggcattttttatgctccgtaggcaccaacatgcagaagaagcaatgttgaagggatctaattttgatgtggatcattgcaccaaattctttggacctatttgcaatgcaaatacattggtgacttaggctcgggttcttttggctgctggcaggttaatgtttcgtttctaattgaaaagcagaatatgtttcttaatctctgtctattcacacaataatataccagatttgaagatgccttagttgcaattcagcgagcatctaggcttgatccaaataataatgagattaaggaggtgattaggtaggctagagctgtggccactgctcgatcaaacggaaacgagcttttcaaggcattgaaattctccgaagcatgtgttgtctatggacatggttagagaatgatccatataactcggttttgtgatgcaactgagctgcatgtagatccaaaacaggccaacttgagaaggccctggaagattgcaatgctgctcttagcttgcgtccatcttacagcaaggctaggctgagaagagcagattgtaatgccaaggtaaaaacagaaaaacacttaaagaaagttccttcatttacttacataatgcaatgcacttttaacatttttatgtgcttaatttgtgtattatgtttatgatatgaatgtagttgaaaagatgggaaacttcaatgaaatattgcttgaagagacaccggaggatgaggaattaagaaggacttcgttggaggccaagagcattttatccaacagcgaggtgaatgaaggtcaacactcataaagtaatggacttatcacttatataaagatagtttagagacagtttggcgaagatatgaaaaatgaagcgtgacaaacaaaggtgagaacaggaaaaagggccctaatgtgcctgtttgtcaaggatgacagaaaagcacacttgtcaatgatcaatactcaaatcctttgtagaaaaaggataaaacacgttgttgaggaggaaaactgcgggcccgttgacaagggaaaggtgcagcataaagtatcaatgaattatttctaaagttgaacttgaatccatcaagtgaaggtacaaatttacttattttatattgagattgaagtataaattaaatggtcggagatagtttgataacatctcatattatgccataaataaaatgattttaaacaaacataaatatttaagagaagatatattaataaatatatttcatctctaaaaataaagaatagagcttgtaggcatttgttttcatctttctctctcttttcccttttagaaagaaacttttcctgggctcatgattctaaaaaaatcaatatttgaaaaacactggttccagagtcaacggttcaataagatttgaaccattttaatgaaatatattttttaatattttaatataatatcatagtaatattgaaaaaaataacataatatacataaattgataataataaaaatagaaagtaaacttcactttaaagtatcataagttataataatttttttaaaatcaaaacaatgtcgttttgaaagttttattttttaaaaaaaattaaacaaaactagttaacccaatgactttatcattttttagtgatttttgattgattcaatggtttttagccgatgtaaggatgtatcaattttttatcaaacaattgaccgattcatcgaatcaacatgtcagattcgattctcaaaacagtggaaaaaaactccaaaatttacgttggtttgttaattcgcatgttggaatgacattgaaataaagatatttacacaaacttacgctaaagcatttctttttatatattcacatgtaaattattagaaaatatttttatttgtaacttttgaataataatccagcttgtgcttacacatacaagtttctttttcagtgtccggggaaagccacttcccttgtttcttgtattcttcaatgtagcgctagcaaactggggggcacttaagtaaatgaataaattatacgggcaactatatttactctcgtgacacgttctcattagagtgtgtttactgtttagttttccactaatgagaaatcccgtatgtaaacagaaaaagtactaatatctaacgttttatgaatttcaaaaaaaaaaaaaaaatcaaacacatgattatatgaatatgaagttatatccattgtttctcttgtgaacgtttatgtgtaattttgctcgctaattatttccaacggcactatatgtaatcttgatgacaagaattactgtttatcattgaacaaccaatataatgttaagtttaacgtgactaatttaagcacaaatcatagtttaaattatttttaaaataattattttattaatgatactgataaaaggactattttaatcaatttttaaaatataaaaaattaaaataaatttttcaaaagataaaaactaaattaaaaaaattaaaataaaagataaaataaattatttaacctgtttggaaaagatgcgtactctcatccagatcaccgattattattcaagactagaaagacaaaacgggttgctaacccacaaacccgatgccaattcaagtactatggtgatctggatctgtttctcaatattgataaatacactcaagcacgtgcattcaaaatagagaacgaggatccggatccgggtcgctccgaaacggggcgggcctgatccaagctgtagcggcagtggttcctaacggcccaaagctggtaaggtgaagtgtcgagagcgagccactgctccacctcgtactgctcctgagcgcatgagaggtggggcccagtggaggtgacctcgacgtagttaaggtaccagccgtgatgcgaacccgacccgtctgaagtaacattaacggcacagacgggtccgttaagacagggtccccttccgctgaagatatcgaggttgccgcgctcgaagtagctgtggcccttgcccatcaagccgccccatgcttcgaggtttttaatgtagatgtagtagccgtacttgtcgtacagcttcagcccgatcttcgagtccgttccccccttcaacaccgaaccggttctaacgtaggccgtgtagacacaatcctggtcgctgtcgctctgcattatattggatttcaaagcttagtagtaagcacaaattatgaaattaacgagatcctgaaaagtatgaataatgatgtttttgttatgagttagtagaaggagaggatcggagggagaacagcgagttcttaccgatctaacggttgcggcgatgcagagtgagaacagaaggaggagagagagactctgtgttgcagatgccatttttgagtccaagtggtgatgagggcagtgccataggtattgataaatagagcgagccagcgagggacacatgattcatcattctcctcaagcaaattattaaattaattagtatcagatttgcattctaaatatacaaatttctataccggacttaccaaaacaagtcgttaacgcaagacacctaacaaaattacacatactaatcaaaacaatcaaatatgtttttcttctttaatttatttatttatttattattttgctccataatttttttaacaaccggtcaacttttttatttttttttcatctaatattctagtcctacttttaacatcaactaactttgaatattgatttagaaaacaaaattaatacatcaagatttatgctaggtttcgttttatgaaaaagaaaaagaaaacagaaataggaaaaatatttaaattaaaatagaaagaaaaaaaatgagatctattttatttttaaaattaattttccttgaataataacttcttctccacaaccaaatcatcccttaaagaattctacaattagttttgagacaacaaatatcttttctttttattattaaagtgttattagtataaattgaaaacgactttagaataaggttgagtcacaaaggaacaaaaacttattctttaaaaaaattaaaatatatatcataaaaatgtaagttctgtgatcaatcaactaagtttaaacatgtcttataaaaccaaagtgtaatttttcatatttataatttaactaaattaaatcttttaacatttttatatattactttaatgctcaaatcagtgtttatttatggattatgaaattaaattaatatttgaagtcttccgagacacgcgtatctttatatatgcatgtctaatttgtatattctatatttttgttactagatttctatatttctttggtgttaattaagtgttttcaatcaaaagttaaaatgtaattattaatatattgagattcatttaaaggattaatttttttatggatgctttttttatacacatcaatcaaggattgaatccataattatatgtttaaaaaaataatgttatttaccaatatgaaccgaagaagaggagggcgggaagggcccagccccctcttgacatttctcatgtatatagatttaacttagttaatgtaaatttgtgtaaaattaattatctatgttattattataatacttttaataatgattaatgtagttaacataaaattaatagtgtttgttattattatcatactgatttagatgataaataaaatataattatgtatttattgtttttatgatgattaaggttattattatttaaaataaaaattagctttaattttatatataaaaatagtaatttaaaaaatattatttatcaaaagttataaatttaaacaattaagtaagaaaaaaatgtaatccctctttaataggtttctggatgtataccaagtaccaaccatacaacatgtttcatcttagaataataaaataacacatttcacacgcgctcacacaaaaaaatttcttggaatataaaatgacacatttgcacgatttcacgttatcgaaatctctgaatgagtccctagctacttttagtatattattagaaatatctatgatggttgcttaaattgaaggaatctattaaaagaatttgaaattataacttgaaaattttaaatttttgaatacacgtatttaaactatttgtactttctaatatctggtacgtgagataacatgcaatattgagaaatatctttaagaaaaatcaagactcaaatcacaaaagcataatgtcaattcagaaaaagaaaacaacttgaaaaatgcagaaatctaaatagtttcagagaggaaagagaaattaaaagtaagtcgtttaaaattaaaagcaatttaaataaaaaattgtaaaaatgtgcaatgaaaatggaagaaaattgaatttaaaaggaaatttgagaaagaagagtatgaagaacaatgcaagttaaaatgtgctgatgaaaaaaagtgctactttaaagaaagtgctgaaaaataaataaaactaacaatttatataattgaatttatcaccttttataaaataaaataaaattagatgacagtatttggtgtctgactccaatatatgaacttgtgtgggttaatttttctttcgctaaatgaaaactttattaataggcttagaagcctataggaaaattaatacaagacatatatcaacatgcaaggcgttagaaatgaaattaggagccacataaaaaatattgtatcacaccaaagacacaaatcatacttaagctaaaacatcaactacttgatttgtcttatgcaacacatgaacatgagttctatactgatgatgttgtggattgttctcactaagttaattataataaggatgtaattgacaacgacttcattactatctaagaatcaaagtagacaatgatatatcaaaaacctctattacaagctaatttcaagtcatgaaaacctctatccaagttttgtagcatattagggttcttaattgactaaatgtcattttaatcttttatgttttatttttttttttgttttgattttttaattaagttttaaaagttttatttcaatttgattcttttagagttgaacttccatatgataagtactatgcacggttaaattccttcaggaaaattacacccactctatttttgagatctttttgaatggcaaataaagtcgtaattaacataaataaataaaataaccatcatttagtaatgattaatattaattaacatttctatattagattgtttttgggagaaaagagagaacaaagctaataaaaataaagtggtaaaaaaatatataaggtgaacatgaaaatcaaataggtaattttctttaaattttgctaaagtgcatgaacatgaaaattaataattggcagttggacgggtggttgacatatatatacaacatcatttttggttgtagttattacttgttacaagtatgctaattacactcaaagcacaaaaacagacataattcttatacgcactaaaaatagacgagttcagaaaactaatcatgtcataacggttcttaataatcaaaagttaacaaccttgaattagagccaatatagacaaacacacccgtcataacaaagctgtatgaagtcccaagaaataacaaaatatccccatgcatgcgctgtgcgtttgtgttttccacgctgtcacaacccctaagcccccaaactaattctcttcgaatgcaagcaatcgttaattcgtccaagaagaagccgcgtagtcattcttcttcccactgcgcgcgcgcgtgccggcgtgcgattgcgtgtttgccaatggaggggcacgccgacgtctccgccgcattgccgcctcctcctggccgccacggcgccgacacgtacatcgtgcagttcccgaaggaccaagtgtaccgcgtgccgccgcgcgagaacgcgttgatcgcggaacagtaccgcaacccggcaacaacgaaaaaaagacgcggcggttgttgttgctgttgcagccgtcgtgtcttcctaaccgccgctcttatcgttgtggcaatcgttgccgtcgttggcatcacgctggccactttgtactttattttcaacccctcgggtcccaagtttactgtctcccatgtggcggtgaataggaacaagaactctcgggcggcgccgcagtacgaggtttcgttgagggcgaagaatccgaacgagaagttggcgattgagtaccaggatggggacgtgtcgctgttgttcgataagattaaggttgccgaggggaagtttccgacgttggagcaagggcgaggtgaggcgagtgaggttacggttgaactgaccggatccagtggagcgttgcccgggcgaatgcatggtggggacgcagccgtggatttgaaattggagatgaaacttgcgatgaggataagaaccgcgggactcgaaacgtgggccatgaggtccaatgtggcgtgtgagtttacggtcagcggtctcgggaacgacactcgagtcttgtcacagcaatgcgataccaaattcaagcaatattaatttcattaattggagaatattggttaattaacgattaggagcattggatatatgggattgggatatgtatcttattgctgtagcggtgattggatgatgaaaaaaaaaaaaacatggctaacacttcaattaaaccatgaagtcttccttctctgtcttatttttttctcagcttaatttgttgggtacggtcttcttattggatatattttatttttgttttggtttttgcgtgattaaacatagaaatggaaactaaacagtgttctaacgaatgagaaaaaaagggaaagtgatgctgaatgaagaatggaagatatcaagatttcatgttcaccgattcaagattgcttcactgaaatttggaaaaattattaaatagttttagattgttatgatgcctattaatatttacatgataaatattaagtactagcactattttttttaaaaaaaaatctgaaattacctaatactttttcctgaaattacctaatactttctgcatgtgtgtatagccactacaatttgtttaatagatccaaattatcaaacgattaatataaacgttcagaatctaatcatctattgagattgcgcgccactaacaaatgaacaccagacagagattgcacgcccacagtaccacccaaacctggttccacccatcggacacaaaaattagccaccgacacccaatcgggttgctgtgttaaaccacatttttattgaatagttatgcctatcaatatacgtgcaaaccactattctaattctgcaacctaaatcaaattttaaatgattttttgttcctctcttcaagtatttccaggtttcatgtgtgattttttttaatagattgttttcaagaatgacgtgtaaagtttgtgcccataatttaattttactccgagcatgatatttctgacttacagagactattatttcatccaagtcaaccggacactcccccacacgttgtactccgctcctctccaaagtcaaagacggggcaaaatcctctgttcttggatctgaatcttaaacaccgaacatgtcagaacagtaattaatctaaaaatgaagatgaagatgaaaccggagaaattgacgttagtgctggtgaatctggcaggtattatggagaatgcaggcaagtctctgcttccaggagtgtacgaagaggttggtgctgctctgaacgcactcactttcttcagaacaattgttcaatctctatgttaccctctcgccgcatacctcgccacgcgtcacaatcgtgcgcatgtcatagctctcggtgcttttctttgggccgctgccacattctttgttgccatctcctcgcctctctttcaacattttgtcctctcctgacccagtgttgccagggtatttatttctttaatgaatcaagccaacaaacataatatattgaatgattatataccaaaattataaaagaaacatacctttttagatttttggaaacacttctttcctttccttgtatataatattttttatcgacgaagctgaatagttttcatcatcgcatgtaagaattttcaaatcagatgcgatcttcactcttgaaactgttacatataattatacatatccatgtgagaatacaggctttgaaaggaaaatcccaactttttatccttaattttttaatgaatacatattgtaaatatattctattaaatagtactagtcttcctgtgtttccgtaaaaacttaataaaatacaaaatatgcgaacaaaattaattttgatttaatgaattaggtaatatttgtggaaaaaaaaataaaaaatcctaacaacattctctacacattcttttcaatacactctttattattgaaataaatcataaatttttatgaattttatatcttatttaatgattctctttttattaatgattgaaatttattaaaaatcataattttttatgagttttatatctcatttaatgattctcttttttattatgtaaatttcaattacttctaaaaaaatagtaatccctagaaatatagaattataacaagattaattacacaagacacacactcatatatatatatatatatatatatatatatatatatatatatatattttgcaacttctacttatcgcataacatggataattaggcaatatggagaggtttaaatgggattggactaacccttgttactccagcaattcagtccctggttgcagattccaccgttgatagcaatcgtggtatggcttttgggtggctgcaactaacaggaaactttggaagcatcgttggtgggctcttttctgtgcttatggcgccaacttcatttgcgggtatacctgggtggagaatagcttttcatcttgttgcaatggttcgtgttgtagtgggtatattggtgcgcctctttgctaatgatccatgcttttcaaagagcgatggcagagcaacaacatatcaagctccaaacaagtccttttgttctgaaatgaaagatctaatgaatgaagcaaagtcagtaattggaattccatcatttcagatcattgtggctcagggagtgtttggaacatttccagggtcaagcttgtcatttgccactctttggttagaactaataggcttctcccacgtcacaactgcattgctttggacactatacgtggttgctacttcatttgggggtctatttggaggaaggatgggggatattttatcccaacggtttccaaactctggtagaattttgttgtcagttgtcacaaataaactccagttcagccattcccctagctgcaattttgttgttgggattgcgttatgatccatccaaggccttcatgcacggtctgcttttatttttcatggggttaatcagatcctggaatgctccagccactaacaagtatgtatatccaacactgtacttgtttattttcttcagaaaacaacataaaacacatcgtatttgctttagataatctacttttttataaaataaataatcttcattaagatgagggtgttacgaataatctttcaaagttaaatgatggattatctatgttgaattgagtgcttaccatatataaataaaaaaatcaaagttgtcttatacagcaagagtgctacttatttcatcatagcttgttaagcaaattaacgaatcccaagggagagatgctgactaaatgaaaccaattaagagattagatttattgtatttaaagataggttgcttaatattatgttttgcctctacctttgtgcataatgttgtggccctgttgttgaagtgagcataaagatatttagttaggagtatggtggcatgttcaaatcgtaattcagtcaaccattgtataaatcccggtgtataggtgtttacaagcaccaaggcaccacataaatgcaacataaaaaatgaaatgtacaaccattatgaatttccattatttaagaaattagaaacacattatgaattttcagttctcattttttgttaattggattgggggtggtgtatctccatgccctgtgttagttaccattatgatctaggtatgctagcagcgatcagaacagtagcagtacttaatcaatcatctatctataatggcccagaaacttgtgatgactgcaaaatgacagttaaaaggggaggtagttgtagagggtttacattagagaaatgttatttgtacatgtcaactaagagaaatatgtggagtaataaatgataggatggaaagaaatagacgcagaaagtgttgtataaaatgttatatgaataatacaattacattatgtgcacttaattagttgtttagtttgccttgaaattgaaccgtgtgaatattccaatatttgcagaaatagtccctgagaagtcccgaacaactatatatgctttggatcgatcttttgagaccatattgtcgtcctttgcaccacctattgttggagctttggctcagcatgtttatggttacaaaccaattccaaaaggatcctcggttactgttgagatagaaacagatagagaaaatgctgcatcactcgccaatgcactttacactgcaataagtattccttcggtactctgcgtttccatcgactcgtttctatattgcacgtacccgaggaacagggagcgagcgagaatggatgcattagtggaatcagaaacgcaacagctagaggtggaagacgtcacaaaagaagaatacagagaaattcatgttttagaatcaaatggaatggtaaagaaagtggcacgtttgacattgattatccaaggtaagaggatgataatgatgagaaagttttgttgtcccggtagttcacttagcgggaacacggaggttcatacacatatagaaacattttcatttgataattcaagatcacttgaagtgaaatataggaagcatcgatattttcatttgctccacgtatttgtatttcacacatatcttactccatatagaagtatcatgaatgatctcaaaaaggaacgaagttgatgtacttctatttgtagagaatagaaagtgatttataatttttattttgttcttaataatgtttaagaagtatgctcttgattttcactcttggttgcatcctaacctcaatgagaggagatcaagcacggggctgacctaaagtgtgtatcacgattgaagttatgtttaagtagccatttctagatgtttaagaagcattatcattgaaagtcactcccaacaagttacttagttaccgttaatttgattaaaactctcacattatccttggcacagcttgattcaagtcattcaccatatagctgaatctatctcgtggacacatattgttcatgtagccaattcgatccatgatgctttagccaaatacggtatttttctatgtttcggcctttaggaccttatctaaaaaaaaaacaagaaaaaaaaattatttatactgccacaatataccataccaattacgtcataaaaaacaaacaaaaagaaaagtatgccgccctacttgttcctttttaattaaataaataaaaggaccataaacttgttaattctttataatcgtccaacttcttttctaaggtcgtttctcttgataacctaaaaaaaaaactatataatatagataccggcacatggaccagcaggatctttgccagaaaaagacaaatgcgagcaaatataataacatatattttgtgaatttagaacttcatgtatcctacaatttttttaaaaaattaatatttaaaaaatataaaaaaattatattattatcaatcagaaatcatatttaaattatttttaaataattatttcaaaaatcaataaatttataatacataataaattataattgaataattatataaaaaaaattacattttcaatgcgtaattaatgttaacccatcaatcaaattatggtcattactatattttgaaaatagcaacagctaaactaaccaacctcgagtataaaccaagctcagcatataaaagtaataaaccagtgaggtttgttcaacattttgtggaattacgtgcaaggcaagctcatcatctcccacagttccgatcctgtgtgttgcccccaccgtagcatccatgtgtccgtccaagggcacagcgaattcctgtgttattgggttgtgaaaagtggagaaatagagtgtgagaagagttattgttggttgaatatgtgtgtgaaaatgaaatcggagacagtgaacctggtgctggtgaatctggcgagtattatgcagagagcggatgagtcgttgcttccaggagtgtacaaagaggttggtgaggatctgaaggctgaccccactgcgttgggttcgttgactctcttcagatcacttgttcagtctctctgttaccctctcgcggcttacctcgccacgcgtcacaatcgtgcacatgtcatagctctcggtgcttttctctgggctgctgctacattcctcgtcgccatctcctccaccttctttcaggttcttacccctgcttttcttatttggattcaacatgttttcacttcttagtgggcaagacaattcaatttctttttttactatgattcatgaaggattaattcaaggtcacatttctttcttctttttaagagaaagttaaagatcacatttttataggccttttttttttataaaaaaacaatattatataacatatatatttctcgtttattcttataaaaactacataaaaatgatataacattgttatttcaattttagataattaagcgtgaggattagataactatactgctaatcaatttatgttaatacttttctttttgaagaagctaaaactgaaattcattaaaaatcaaactaaacataaggcatgtttagcttgatagaagagcaatacaaattgtaagctcacatgtagcagtttaaaaccaaaccagccgcacgccaaaacactactaaccttaaacgaagccttacctagtgctcacactaaagggtacaaagaaaaacaaacagcagttagactcaatatatgttaatatatacttgatagttattactaagtaaagaatgagtttaggttttgttaggaattattaaaattaaaaatgattttatcgattggatttagaaattcactcaattattaaatttggataatctcatgttatttattttaacacgataaagtaatgttacgagagataaagacgtaagactaattataatagtgcatttagagttcattaattttaatttgtgtctatgtcttattttcacattataataatatggtgattagtttactcataaatattgtgcgtcataaaggtgtttttaaattcatgtaaacattaactgtataaataaattaattaaaaatgtttaaggcaagcatgtataatttattcataaaaatatgaaaaatatgtattaaaaaatcaaattgtaaaaaaatatgtataattaacttaagagaatttaaatttaaaagaaaaaataaaaacgaaaaggaagaatacactaattcaagctatccttaaaagaatatactctaataagtggctgagagcttgaaaagaaaattgggtggattaaaattataatctataattaaacataatagtttttataatataatcatccataaattatgaaaaaaggaatttttatataaaaattaaatatagttgacttgataatataaaaaaaaaatattcttaaatttttttgcatgtattgggaaaaaatggaatataataagcatgtcactctcttaaaagttacattgagattcatccaagtaaagttggataggctcatttaaaagggtgaagttctgcagtccctaacctgatacttaacataaaattctgtgattaactttcaggattgaccataatttgcatgatcatatgactaattcaaaatatacaacaagataaaaataacaaacatcatgatcgtttgcttaacaaaattatagttttgtatatgcattgttactcatacttgtgttttcttagcccatgttttccctgaatcatggtacatgtttccttactccttcgtgttgcacaatatggattatcaggtggcaatttcaagaggtttaaatgggataggacttgccattgttattccagcaattcagtcccttgttgctgattcaaccgttgatagcaaccgtggtatggcttttgggtggctgcaactaaccggaaacttaggaagcatcattggtggtctcttatctgtacttatagcctcaaccacagttgcaggtatacctggttggagaatagcctttcatctagttgcattgatcagcgttatagtgggtatattggtgcgcctctttgctgacgatccacactattcaaagcgcgatgagacagcaacaactcaagctcgaaacaagtccttttattctgaaatgaaagatctaatgaaagaagcaaaatcagttattagaattccaacttttcagataattgtggctcagggagtgtttggatcattcccctggtcaggcttgtcatttgccactctttggttagaactaataggtttctcccatgtcacaacagcgaccctttggaccctattcatagtcgctgcttcatttgggtctctgtttggagggtggatgggagattttttatccctacggttacccaactctggtagaataatattgtcacaaataagcgctggttcagtcattcctttagcagcagttttgctcttgggattgcccgatgattcatccactgccttcatgcatggtcttgttttagtcatcatgggattcacctcagcctggaatgctccagcaactaacaagtacgtacccataactgcaatagtttatgactgtgttctttatattcaggattactagaatttaaagctgtaaggatttcttgtactagtagtggcctcccttaataccaaatatatcttggaattagtagaagtgttttgaggcacccgggtacactaggagaaattattaccttgttctggaccactatgatcctagtcaatctccacatgacacataatcgagttttattaactcttcttttagattgaaaaactcgattacttattaggtaaaaattaactaggaccatggcaaggtagtcccaaaccatatgataactttttgataggtcaaacacccaataagatgagtcaaacaaatttttaaactttttagctcttactcctcttagctgagggagtggtgaatctcctgaacctgtgactgtataatgattgctaccttttctatataggtatgctagcagcatttgtcagaataaaactttaacagtgattaattaatgatccatctataattgttccaaaattagtgaatagtgacgaatgcataatgaaagtatgaaagaaggttgttgtagactatttagatcattaatcaccaaccataatcaaacatttaccagtagagatacatatatgcaagaaaaacagtttgcaggttgtttttctgtcaaactaaacaaattgtttaatacagcctgcaagatgtggaccttcaaactaaacaaactgtccaaagtaaacaaattgcagctaactattgaacattgattaaaatgcaccttgtttagttttctttcaaatgtaacagtgtagacagtccaatatttgcagaaatagtccctgagaagtcccgaaccgctatatatgctttggattgttcttttgagtccatcttggcatcctttgctccacctattgttggactattggctcagcgtgtttatggttacaaaccaatcccaagcggatcctcagattctgtggagattgaaacagatagggaaaatgctgcatctctcgccaaggcactttatactgcaattctaatacctatgtcaatctgcgtctccgtatattcattgctttattgcacgtatccaagggacagggaacgagcaagaatggtatcattagaggaatcagaaatgcagcagctagaagtggaagatggcacaaaagaagaatattgcgaaattcatgaatatttagagtcaaatgtggtgaatggcaaggaaagtagcaagtttggcattgattatccaacaagggaagagagcgtcgacgtggatgatgatgataagaaagttttgttgtcctagtatttcacttttgcaaggaatcagtggttcatttatcaaatgttataaaaaaaattgttgtttaattgatcaaatgttataatgtttactgttggataaccttttttttatattggggggaattggataacttttttgattcaacataattagacaaacaggggtgaagcttatctgttaggtgactccggaaactgttgataccatgtattttttgacaaatggatcatattcaatcactcttgaggtctcaaaagtcaaaatcccatagcacctagcatggtgatttcactttatgttagggtatcctaggctagatcctttactgctgcacattgtctcatgtgacatgtgagaagtcgacattaatcaagttcaacaaagtagtcactctgggcaggtgctagatatatgtcgtcttcttttttggtgaaaataacggaaagatatattatatgtcttctaaattcaacagtttatcctgattcctgaggtggctggggaagtttagttttttttttcccacgtgtatatcgttttaataagtaaacttttcttctgtgaattgtaaggatatttttaaacttaaatcaaatttataaataaaaatacattaaagaatataattgatatttttctattaagcttaacatttttagtttcctacgtgtgtatatcgtttgtaaaaaaaaaatctgtgaattgtaaggatatttttaaatttaaatcaattttataaatttacaaataaaaatgtattaaaggaaataagagatatttactataaatttgacttttgttaattaggttatcttgatgaattgattagcactagttgtagacaggaatgttatataataccaaatatttatgtacaaatgacacaaaatggagaaggggaaaatttaattggtttttgaataaaatgtataatattagatgagtactctccttaacaaaaatttttattgttttaatcctcctttgatttatcaggggaaggaatccgaaattcagtaaaaaataaataaaatctaatcaataattattttcgttaaaagactaaatttaaagtattattcaaataattcaaccttaattttaacaagatttaaatataagaagaaaaaaaacatatgtaataaatcttaactaacttcacctttaattaatgatatcatctcaaaatattttttatttaagttgtaaagaaataagatcgagggaaagaaataggtggcaaaataaaaaagatattattgaaattcacacttttattatttccttgttgatatgcatagaaaatagaaattgcacaatgcttgagtctttcgtcactaatgatagattataaagaaaacataattgattatcaatgtcattacacattaaaatagttattttactgctgataatcaattacgaagaattcataatttaactatcagtgttgtatttttactcctctctcctatttttctcttaaatctaacgcttctatttttcctctattttgttcatatttctttcttactaccaaacatacttatagaaagaaaaaaaaaaaaaactaaatttcttaatttaagatataacgttttattaaaagacttcttatttgcatcaataacagcgtaaactcaccaagtgagatataggaggatttgttaccatgtggataggtaaggtatataattgtaatgcttaatgttcaccttagtgtaaatgtaattgttaatgttaataatacacataatttattttaaaaaagatagatgaattggattatgagaatcaacgactgaagagattttagattttatgaattaaacaattggtacgcatctacgtattactcataataaaattctcattttaagagtaaatttaaactcacatttgataagatgtgaatttaatccttataagctgtatcaatcattattaaaaataatattttttttatattttcttacattataaatataatatatgagatatttgtttttctttttttctgatttttgggatgtttgttgttaattataggaaatgtaaaaactatctatccatttataatcattgtacatttttactaatatagtagtagtactgtataatgatacgtacataacaatgataacatgtgttcccttctcacgttccatatatgttcaggcagttcagcatctatgaaacatttattagattgcatcgtattccactgacgtcaatctcgacattaatattcaccgcatttgtagtatattttattattattattagttaaatattttgaaaattataagtaagattcattagataaagaaaaatgtattctcttaattccctgctacaaataaatcaagaaattattaattgatgtatattgtgactaacgcttgcctactaccttcacatttcatttttagtcgacataattcaaattaattgtccatacagttgttaaatgaatgagaaatgtgactgaaaaagttataattttttaaagaaaaagtctacagaatttataattttggagtacaagaaatacatcatttcgagaatttgaataaatctcagttaaatatacatatatagttaaaagaatatattaaaatacgtgttattgacatttatcttaatccaatttagttttccattcaaaataagatttttataatttcaagagttaattaaagtatactcctaagtcagtatattactcttgtttctttgttttgtgggcattttgagtaacaaacttactgaaattaatgagttattttttagtattgacctctatgatctatgaatttgtctgaactcgaacaagtggatgatttttcacttattttatccagaatataaaaatgggacgcctcgaagagagtatcctaaataataaagcacttgggatcctctccagcaggcttatagtgcagtcaaatctgacccgttgaatggtctctaacacagtatttggagatgagagataacataatgtagggtagagattaagacagagaaagtgaggcagcaatagttgcgggtcagataaccggtgagtttgtttgatttatatatttttttagaaatagatagaatttattttttaaattaaatgaaaaatattttctaaataggaataatttagataaatatactaaaaaaataaattttttacttattttattgaaataaatatttattttaataaataaatttaaacaaactaacacaataataaatcgtaaggcagtcatgcgcgccatgtgataggtttccttctcctgccaactttggcagcacacacttccactctcactcagtccattttccacttcactacccataaaaactataaaatcctcccttcctttcctctctcttccgaaatctgattattaaattcgcatgtgagtgttctatatatgtattaattactacatatagctagatcttagggagcgtcctctgtttaatttgtagatcttgcttgacggaaaatattccaggataccaatggctcaactcaatcacagaaaggtactactgttctatcttcttttgttcctttctgtttctgtttgcttcagtgccacctggttggaacctcaacatagtagaagaacgttggatgccggaaaagaagagcaagagaagcctttgaaaaagaaaaccaccacccaatccaccaaaaacaacaccaagcccaccagtagtatttcctcaaagaaccaaaccaaaaccatcaaatccgacaacgttatttcctccagaaaccaaaccaaaaccatcaaatccaaactcgtttcctccaaaaaccaaaccaaaaccacaaaattacccaacaacaacattttctccaaaaccaaaaaccaaaccaagccactcaagcctagctccaccaattcaccttccaaaaccaaacccaccgacactcccctcagcaagaagctcaatagtaagatcaagaagctcaacgtcacatcaaaatccccaccctcaaaacccggcaccaccgtttccatttcaagcaacaagaaaacattggatctcgcgagacctactaacaaaacaacaaaagccaccgccaccaacaagcaagccaaaacaacaaaagtagatcaaactcacgacgcaacaacaacaaacaagaaacaacaaactcagaagaaacctacgaaacaaaaagcaccaccgagttggatcatggaggagctggaagaggaaggcgatgatttggtttcagagttcacagatctacccaacaagttccaccggacactcctccccgacctggaacgaatctccaccacttccaaagcctacatcaccaaagccaacaacgaaatgaccaaaggcttcaaaccctacgttggcaaaaaatacgcacctaccctcgccaccattatctcttgcgccttcatactcatccctctcctcttagtctctctcctctgcacaagaatcaaagcctatttctccctccagaagatcttaatcttcatccaagtctatctctccatctacttcactattctctgtgtcacatcgttcttcaccggcttcgaacccctcaggtttctatactctacttcgcagtccacgtatctgtgcctgcaggtgctgcagaccctcgcttatgtcttctacttgctgctgctcctcatgtacctcgtgctcgtgttctccacggactgtggcctgacctctaagttcttgggcctggcccaggtcttcgtgggctttgccgttgggctgcattactacgtcacggtctttcacagggtcgtgctgcagcaaccgcccaagaccaattggaagatccacgccatttacgccacgtgttttctgctcatctgtgtgcttgccagagctgatagaaggaaaaagacttacgtggaagacggtggaggagaaggcaagaaaaattgattgagaagatacctttgtatttatttattttatttattattattattattattattttcattttcatttgattcaattcaataattaaatttataaaaaaagaaaaggcaaaattgcaagcttctttaataaataagactacgtacatcatgacaacagcagtttcatgcctccggatttagatgaaaacatagcttatcttttcttatactctctcttatttgagcctggaaaatggaaacagaatctgcaaagtttacttattattcgaattaaattagactagagtatttattagcaaagatttttttatatttttatttttcagttaataaaaagagtgttgactgtttgacttctttgcatgaaaattttcaacttggacaaaggatagtataaaaagccgaaattcacgaattggattccctatggttgataattggtctgaaatgacggtgatgagtattaaaaggaacttttctgcttcaatttaatataaaagtaaatcttttaaaatattaagatttacccagttaaatatgtaattgcggaagatctcgattcatgaaaagcctgaagataaagaacgtccaactaatacatgtcaagatactttttttctatttatgagaatgagaaggattcaacgaaattagcatccttaggttgataaaaaaatcaaaacaagttatgacatgcacgttagcgtcccttataatagaacagtagttgttagtggattaattttgtaaattttttgcatttagtataaacaaaattaatctaataaaaccaaatctagaaaagttaaaaattgatctaagaattatagagctttctttcaaaaagcataggacaacatgttttggaaacgaaccgtgtcttgtaagttttaaaaatgttagtatagtgaaggcagttgctcccgttacgggtaattagttccaccgatgcaaataaatacgtagtactgtagtatttaaatttgtgtagataataaacaaattctaaatgaactcaccaatatgttaatatcttagcacatgatttatatgattatttaattaactttactggctttgtgggagctggtaatgtaaccaactggagtttggaaaagtgacttcagttatttaggacagaacagcctgaatccagcctcataaagtcatagtagtaatttgctgacacttttcgtaaagaaaccctcctccaagttggtgtatagtgattaaattctataacgatatttgaacaaatacttaattttagttgtttaaatatttacgtttcattaatcattatattaatatctttagtctctgtaattaacaatttttttttaaaaaatccttaagattgtaacttttctcattatattaatttttatatttcattatttttatgtagtgattaaaagtattttaataaattaacaattattagaatatgttttaaactaaatattgaataaagaaatcaaattaacaattaattaatctaaattttttaatatatatatatatatatatatatatatatatggtatttgtactttttttagattttgggtcgacctcttcaaagttcacaattcatgactgatgtactataagcctattactctaaggtggaagtctctaaatcaatctctttaaagatgaaaattctctaagccaaactctatattggtctctccaagactaccttttcgggttgtaactataccttctgagacccagattaaccaaccaattttagcctaatgtcttgcacataaatgctggccgagaggcaatcaacccatgacatgggaaaaccactcccaataatcttagaaacagattaagatacgaagtataataaattaaaatcctaacactgacctagggaaggatgtatcacatactcaaatgctttggataggtcacctctattcctggttgaggattcctatactggaacaggatatatactaagtaatacaataaaacatatagttacaatataatactgatgaaatgatttatttaaacatatatttaaagtatatatttatttgagcacaattagtaataaatcgagtttagaagacaatgtgtctgtcgatgctcttgctaatatgtttatggattttcatgatatatagctatgttttgtttgagttagccctttctgggctttgttctttgcttcttttttataataggggagtttctctctcctgttccgtaatcctataatttatttttggacataagtcccgcttgtattaaaaagaaagaaagaaactgtaactaatcctttagttaactagattttagatgaaatatttataatcttaataatttaatctatatatcaaatttgctcattcttaacattttatttagcctattttaatataatgtgatttgaattttcttcgtttaattaattttaaaattattgaaattgccaaataaaaaaccattgcattttatggtttataaattcgaataaaagaagttcaattcaaaaatatgaaaaaaagttaataattaatactattaaataaatgcatatattcagtttaccttactgtaagtctttttttgttttgtttgtttttttacctacggattagttatcctacccgaaggcccggagacagagacgtgaagagagcataggatctattctagccatctatctctaggtctaccactaaccttcgaaccaaaaaataccaaagcagatatgactcatggttacctacgcatataataatctgttcctgcaataatttagggaaaaagaaaaatgcaaaaaactgtaaaattaggatttaatttgacatatttttaatgagaagttattggatacaattgtttgatttttataaaatatttttttaataaatttatcctgtaagtaaacattttagacatcatgacaatacgtgataattagatgtaaatttaaatctattatgttatttggatgaaaaaaatattatatgtgtctatgagaagaaaaaatattttctattatgttatttggatgaaaaaaatagaaaaaaaatatattcaaaaatatttaaactttaagatatatcttcaatgctttttttttttcatgaataacacgagcaaataattattttcttaattttctttttattctaaatgactataactactttttacttttttatgtataatagttgcactgaaatttgaaattagaacttatgatttcatgcatgttatttaaattgtcattactggttcaaatctaacagtttaattgaaattattttgatatatttattctactcttcagaatattttttattcaatattttcatcgttttgaatgttgtcttaataattttgattgattaaataatatatcaggcttattggattatgtaaatatattatgattaattaggactataaatgtttatattaacattgcatcaaaataaagttatacgtgacaatataggttattaataaaaatgatgatatagttgattttcatagacaaggtgggtttgagtttaaaactcacaaacccgcttaatctgcgggtcaagatagataattagatataaataaataaaatactaacagtgaaaaacagcataaaaacttatattgtcagtttattttaattacttctttttttatttaagatttgtcatttataatttaaattttccatttcttgaatgatgatttagaggaaaatatctacatgaattaacttgaaaggtgtgcaatttttggttaaaaaaataaagtgcacaaatttttgaaataattatatggttacatgtttgaatacacgtctaaatgattaaaacatgtgtggttgatgtgaatatatgaagcttttcattaaaattttacgtcaaaattaaaattgatgtgattttctaaaaaattggacgcagtgtgataatcacatcaatcgagagaagaaaatactactataatctattcaatagtattattaatattaattaatctttcataaagaataatgtgtactgtgtcattcaaatcaaatctttcgctttttgatttcttcttcactgtcactaagcgtgggtttgaatgttattggcccatatcccatgcacacttcaaaattatacgctagtgcgcaattggccccattgatggggtcacgccgaaacacaacccatacaaatagcggaatgtacgagggaaaaaaagaaaaactaattattgctgtgttactacgtagtaccctatttttttccataaaaaataccaatccaactcgttaatattttatatataaaacttttaggaaggataaatataaatatgtaagttacaaaacaagtaaaattgagaatttgtgacggaaattatgccacctgattcctgaattgtgtatgatttttgtgtaagtaaattcgggttaaatatcattttttaatgaggattttatattttgatttattttaaattcgattatttaactattttattgttttttaataataactagctctttgaaaaaaacttctcaaacattgacaaaaataagttgctattttgattctccaaaatattttaattattttattataaaaattaacaacattagaacagttcttatgatcatagacacgaatagggaattaatttgacgccattttttttatataattgatagtatcgttttcaattattagtagactaaattatattcacaataaaaaaataatggtagtattttcatatattaatttttacaaaaactaaactaataatatttttatgatcaagaaaataaattaatattctttttaaaaaataaaataaaataactttagaaattaaatgaatgcttaccttcccaaatttatcatgtaaaagtaaacccaaaattttgtgaatatgattatttttcgttatcaatatgtcggtacaaattatttttcgttattttgatgaatattttatcttttaacatttaaaaattattattaatcaactaacctttcaaaattaattttcaagatttaagtattagattaccgaaataaatttaatcttgcattgcttttttttaaaaaaaaaaatgttgcattgtaggcctaactatcaacaaaacaaatacataattggcttaaagtgtttttgatatatgtaatttagtgtttttatttttttttaaatcattgtaattttttaaaaattattgtaaatcatgtttgttctattattttccgtaaaatattttaaataaacatttttttttatttaaaacattatctaaggaactttaaaaacaaaaagtaaaacaacaataatttttaaagactaaacaaaacataattttacagagagagaaaatgaattaaaaatatatttaagttctttatttattcatattgtgatatatacttaaacttaaagctactaaaacaggattaaatatttcataatttttaattaaataagagattgtaaaaatatatatttccttcacgtaatcacaatagaaaaatttgttggtgacacgataacaatgtaaccaagcactgtcactaaacactagactgttttttttattattattattattgaaactagattgtgtcttaaaaataaaaaaaaaatatattaacatcataatattttattaggataactattcaatttgtccctaaaagtgtatttttctaatatacgagtttttgaaaatgaaaaactatttttttatccctaaaattgtaaaattgtcaatatagtaattctctcagttatttcatttcgtaaagtctaacgtctttaacgtgacaagtgaaaattgaaatgtcatgaaaaatattattaattaggtagttgattcgatatgactaatttgtcattaaaatgttgatagattaatttgtcttctttttctttttttctctttccttttcttctctcctctttcaccttattctcttataacttattccatcaatgaccttagcaatgatgatgatgttgcagtgatggaagaaaaaatcaaattatgaggaaggaaattgaatctcacgctctacacaaaatataatttttgattaaggggtctacacctttgcacatgctattctccacacgaaatataattgcaactagatttttcttcaaattaaactaatccaataaaccaaaaaatcataaatcaagaaattgcaacaacaaaagaaatttctttgtctattcttcaggaaaaataacaaaagggaaaggaaaacataaaaatggttgagaattaagcaatgtataagtttgcatgaggtgatgttgatgggaggaataagatggatagtgaagagaaaagagagaagaaagaaaatgcagagagaaacaaagatagtcgaagtggaaatggtgaaagttggatccttgaaggtcgaatttgaggatttaccactatgatgtcgttgtttcaaataacacccgcctctaccaacacaactttagcaccctcctcttgcgccagatcaaactccgttgtcaaccttctctcaaacccacaatccttcgtcacatgtttgcccttggcatccttcccaacaaggccaccatcaccattgtcatgcgcattgctgcaacgaaaggcaattttggatgacacatttgagtcagtgaagggcataaacaagtgcagcaacacttctccaaggcttcaaacctacaaccctgcgttgttttgtttatgaaatgtttagtgttgaggagcatatgaatgaggttggattgagcttggaggaatgagaaatggtggcacaataaggaatgggttggggagggggattgagttgagcataattaggttgattattttctaatgacgatcaatgtgttgttcaatgagtatgactaccaagtatcaatggttagttgtttggtttggatttggtttgtgggtaaatgatgggattgtcgaatttgtagatttgattggagaaactgaagggaaataatcatgagaaatatcttttcatagtggtaggcaatagtacaataaaaagagaagaataatggaagaaaaataataaagaagaaaggaataaataaattccaaagatgacaatttttttattgatattttgatgacaaattaatcctttcaagttagctatcaattagtaatcttttctcataatattttagtcctcacttgttacgtcaagaaagatgttaaactttatagactaaattaatgagataactaatatattaacaattctacatattaagaggcaaaatttagtttttcatcttttagaaacttacatatcaacaaattatattttcacatatgaaattttagtatttatccaattttttatttatcagacattaatgtcgtaatatttcattagtatttttttttcttttcatttctatttagttttccctccctccatcaaagaataaaataagtaccaaaaactaaaataaaatcaatcatttaaaatttatacttgaacagtacagtacagtgtgtagtagaaccccagcattattccgttgtcttccttctccgttgctcactctctttctctctctctctctctggaatattaacctagatcaaagatgacggtgctgtgagaaaagcgtgagtgagaaggagagagccaaaaatccacaaagcatccgaggaacacgtgaattccgacatgtaacggccgaaagttgtaacctacgacgacgaatttggatctgtcgtttacaaccattgccgatctccgccttaaacgacgtttcactgaaaccaccacactcttcctcctcaccgttacaacttcacagcttctgtgtagtgttctacttttcccgttactgtcagaagaccgttgaacaacgagggtaatcttatcacccacttttttcttttgcatgtagaatcgatttcggccatcggaaaaaccgtttgtttctaatgcgtaatcgattccgcaacacaacaaagacaaaatataactttttttttttttgagaatttggttgacttatatgggaatgttgatactgtgactggtttgtaggtactagctaggtagtatgatcctcttcttaccctatctctttccgtgattcactctgggtttgacttttcatgtgagaatatttaagggtttttctgtttcagtaaccactgtttctttacccttactatttcagatggaaaaggaaaaaaataaatgttgcaagtcagtgttttttgttattaattaaagtgtttgatgatgtgggtgtctttctttgtctcttttaacgctggtgcggaataagcacttaaaacaattttgacttgtaatttaattttcatgatttgtggttgtattatgtagtttggactcatttgtggaattagttgggcatttttattagggcatgggaaatggttgtgaaaagaaacgatgctttgcattttttttttttacttattctttctgagaatctaatgttgtttagggaactacagatgcattggtcttttgggtgctgattactgatctgatatatggcatgtgtgcagttttgaagtggttttcttgcttcagctacccgatgaggaattgatttgttgatctctgaggttgttgttctaatttatcgagcatggataaagtttcatcagactgtccgtacccgggatgcttcttttgtgtcatgaaggaagggaatccaagcaagcgcagagcaagtgtactgaaattctttagagaacttccgtgtcaagatgatgatggtcaggttctccctatcagtggcctttggaacaccgctatggcacacccaaatgacccggagttcctagagctaggaatattcgaatgcatgtctgctctcatatggaagggactgaagaacaggcgctggctttctcatgaccaaaatatatatattccttattatgcagctcatatcatcggttcctacacaatgaatatggaagaatttgcagaaagtgccgtgcatgctggggtcattcctcctttggtcgagcttttacgaggtagattaacttgggttgagcagagggtggcggttagagcattgggacacttggctacatatgccagcacttttccagccatagcaagtcatggtgaaattcttgagctctccatccaattggcaatgagttccctggaaatagtttattcacacttttaccaatatgttgatagaaggcttagttatcattgtgatctgcttacacgtggcatgggtggtgttgaaatggagtccaggaaggctgaggaatgggctagtcagttgcagtgttggtcccttcagctaattaattgctttgcttttaaacatgaatttcttcctaccatatgcaaacccgaatttctgataaaactacctggcatgtggggtggacttgttaatgaaaattcacctgctggtattggtttattaagaacaatttgtcatcaaaagcttggtaggggacctgttgccagttgccctggtattattgatgcattgtgtaatattgctcggtcttcagatgattggcagtatatggctattgattgccttctatggctgcttgaagatcccaatacatgtcacaaggtaaaacttccatgactttgcattggcatctggttctgttacttcacatctgttgagcttgtttgcactgatgaacactgaggattaaggaatactattgtctgggaaagaatgctttgattaacatgtgaatgaaagttgactcttgtgccttaaactaacttcaattaaagaaaaatgaaattaagaacagctgttatgcttaatctcaagcacttttattaggcatggaccttcaccttgagaattatcacattgcttgcctcttttttgtatttctccttggttcaaaaagcttttcaatttctcaaatttcattgatagttgaggtctgatgagggaaatctactggatgagatggtttctgaatacaagaatggtagtccgttgagaaggtaataaagaatggttttagctaagtattttgttttgtatagctgtttcatttgaacatctaaagacattgctgttgggaataatatttcaagctcgtggtcatgtgtaggctacttacttaaaactagttattacttccctcaccagtgtccccaaagaaggtggctggtccttgtcaagacaccaatgattttgtaaagtgtaaactagatgcatactaacaaagtaacaataccttgtgtcaaagaattactcatttttaaatttctccttattggcctgatgctttcatttatacaagcaccaattgctagagattatgactatgagtttacatcatttgaatattgtaaattgattctttgtttgataaggccttggtatgtattatgtaggtgattgataaagtggtgcctacattagttgaccttgctgagattacaactctgggtgatcataaaaagcttggcgattctattattaatgttcttcaagagtgcatccagtctcaagggtcaggacgaagctcgattagtagtcgtactaaagaacagattgaggatattttgaattccaagcagagattaaagtgggaaaagaatatgcccaaggaagatctacatattaagcaggctgcagcgctggttgtcaagcttgaaggaaattccctgttctcatctggaaatattgctggagctgcatcaaaatactctgaagctttggcattgtgtcctatgagatcaaggaaggagagagttgttctatacagtaatcgtgctcaatgccatcttttgctgcaacaacctttggctgccataagtgatgctacccgtgcactatgtctccataagcctgtcaatcgtcatgccaaaagcctttggagacgagcacaagcttatgacatgcttggattagcgaaggagagtttattggatgctattttatttataaatgagtgctctcagtcaaatgatcctgatctctcactgaggcaaaataaagttccagattatgccgagcgtttagttaagaagcagatgcgtgctgcttggttatttcgagaggcagctattaagcatggtggggtccatagtcagggtgatggtggtgatatgtatggcccagagactgatgattctgaatgggagacagctagtgaaagtgatataggaaatgatggacgggatgacatgggcgatgacgacgatggtgattggaataatgatgatggtgagaggaaagattacgacaaaccctcgatgaaaggtattttcactataaatttcctatttatatgctttattaataatttccattattatgtgatcctacttcgtgcttgtgattatgcatgtttaatttggggagtggggactgaaattggctaatatgccaaagagtttgcattttaaagtaaaaggcaaaaataataggtcctatcaacttgaaatatcgatatgcaaattcttgtggatgacattgttcccacccgaaaggaacaccaactgtctatttgggaaaaactgaatacagcaacgttaaacttttcagtttgctaaaatatgtatatggtagagatttatcttcattgttggtttcatgtgtatataatctgtatctctcagctttagtttcgacttttagacttcttgaaaagaataggtcctatgcgactctggattttgggtaaccagcctttccttgtttgtagcatcacttgaccacccttcggaacgctgatcatcagctgaattgctgaaagcttgtgctataagccagacgtcctgtatttgccttggtacttgtctgataaaaccattgaatagttcagatcgttgccctttatatggttagtcagacaggctgtgatttatactcatgcaaacgagaaaatttgattgaataggttggacccagacttaaaaagaaaagaataattgttggaaaaagttaatatgctattgcttacaaaaacaactgagcccctaatcttactaaatcacatagtttttaattactgaattaagatgcaaattgcaattattatatatggcatctttttgcaagtggtgtaatgcctaatcctcaaaagtttggtttcctccagatataaagcatggatacaatgtgcagcttgcggaagaagaaccttgacatggtaatccttgcatttggtgcaattgttctctccagcacgaatgaagcagggttggctgctgtgactattctaactctacatgctttgtgggctttaaaaagagaaaattctaagtcgctcgttgtagtaagtggcgggttgaaagtgatgagtgagtatttggtcttactattatttgaggttgatattttatataaagttttccatgttccatatttgttctccccattttccttgtcaagtgtaaaaattgaagattttaagtttggagaactacatagcgtttggaggatgtgaagtttttttttccccctttattttccccggaggtttgtgtatataaatcctttgtgcttaagttttctgagtccgtttccactattattttggttgcagtttgcctcattatttgtgcatgttatagtttctttcatccattgtgatgattggtttctaatttagaaaataatcttgttctttaaattcttttaaaaagctgttgaaatttattattttttaaagttaattcaaacatgtattaattgaaggtttaaataattttttgtcattgtaatttagtgtttttttttgtttttagtcattgtaaattatgtttctatttttagttcttaaaacaatttaaataaaactttaaataatgaaaaaaaaacgttatctaaaacgtcacaataatgaaaaacagaaaaataatttacctttttaaggactaaaagtaaaaaaaataaattaaattgtatgaattaaaaaatatttaaatcttaattaaataataaattacttaatacatcaatctggactaatagaatttggtttttaaacctaaaggtgtctgtgggataagatttttattttattttaggctaataaataagagatgccaatgcggtgggacaagtctggtcacgtgcatgattgctaattggcattttgagtagtgatatctaactaaccgatgaccaaccgactgcctatatttttatttcttttggcatgcctatctcaactattattattgtagctccagcaatgtatttctgtccattcttatacactggttctcaatatttataaattcagtacttttcaacatttatatttgtttcatttcagtagaactaactcatgcatagtaatctaattccaaactcatttaaaatattttgaaaacaatatttcttataagtccaattcgaaatattgttttcatttattattataagccgctacttatgaagtcatgaaacgcacaggtgtaacattaatataaaggtttgaattgaatgcgttgggtgatttcttccaatcaatgtctttaaaaagttggaaacgggttggccgttggcttggtgcttgttccatcgatccacaaattcttaggtaagactatttggttctgtagaaaaaagaagactatttggtttttatgcatgtacttttaaaatacaattttgttcgttatcaagaaataaataaataaataaatattttaaaaaaagataaataaataaataaaattgtgttctttattttttttaataaatttgagataatattaattattactttaaattatatttattttttaaaatattaataatgtcataataaaaattaaaactaattttaatataaatgaaattatgaattatatttgtagtctatatattatatttcaaaataaagaaataaaaaaggcacaaagataataatatttattattcaaaaaattgaaatgtgattgttttaaagtaagcaaatgcaactttgtttgtttaaattttaaaaaggctattttataatataattttttaaaaaatacactagttttattttaaaaaatattaaaattctttaagagcaagtgcacttcaatcatatcctttattataacctaaattgtcattgacagagttttttgaattatatatacacttttaatatgctacatattcttatatcattaaggccaatgtctatcttacttttttttagtgcaatcactatcttacttttcttcacttatttctttaaactaaataaataaacgcatattttcttactgatttgagaaacaagttcattttaatcataccttaaaaaaagttcactttaatcttatatcatcctttgttataatttgaatttattgttagctacattttattttatgatttgacatatgatagttagaggtttgaatctgtgaattaaagacacatttttaataattggaaacacaaaaatatactaatatagattaacccgacccgatttgtcaatcggtcatggtgggtagagaagaagaccacccgtgtggaacacgttggtatattgcgttccacactctaatccctcgttcgcacctatcttcacatatctcatcaattctctcttctcttcggttaggttctaccttgttcgtcttttttgtctcagtcatgttagtgttttattcttaactagatatataattcgcgcaaccaaacacgtacctcataattcttaaacctccttttctattcaattcaatatcagtggtggtgactcacttgttgttggagcaaagctgcgcgtgatcaattttcgtgttccttcttcgttcccagcttcattcaccgaatgaggattaattatcgattatatattacatattaggtttgtttgacttgttttcgtttatgtgaaaaacgatttctctattgtatacaacttcggatgcgcttatcgagcttttgcggtgatcaatgacgttattgcagaatctgagatgttgctttgatcgctgctgtggacttactttcacgaacaatcgaagatgctcgctgttgttgagctagaatattctattttttagcaaatatgttctacgcgttggattggcggagcatggttaacgtttttgaccttgaaggtgagctactgttagggatttttacacatttgggatctgctatggaccaatggagagttttatgttagtatatgtaatattttgactttgaggaaatttgtttgcgtatatttttgtttagttatacttaataatgagtgatatctgatttaaaagatacctggttacgtggctgttgttatttaattatgcttttgatgtgatgaggtcattgtttggtatcttgaactgaaacaccatgttcacaaaatatgtgcatatggtttgacatgtatatgggaacctcaataatgtgattgtgtaagtaaacgagcatggtgcatctaaagaatgccactttgccttgagattgaaaattcccactgttctggctgctgatctgtcattcttctgtgcattttaaatttggctagattttgttgccccagaagatatgaggagcaattgtgacacgttcatttgttggtaaaagagaggttgatcttccgccatgtcttcccttcaactgttccaactaactcagcatggccggagttttctggcttcaaggaggtatattaactttttctctgaatgtttttggtgatgagtaagttcatttagatgttgatgatgacttgccacttaatttgttttcctattgacctactacatcaagtttatgcttttatcaacttttttttttcccgtaatggctctataactaaactttgttttatgcttgaagagaatatttgatcacattctcataatcagcaatagaatacataatgctcaaatctcaaaagtttgatcccttaaagaattgttatggttattttagaaccacatcatgaccacaattgcatttgcatcaaccacatttatctacaattttctgcaatatccaggtttttccgaaattgtaattgcaatcagtcaaccacaatttaaaaactttgcaacaatgctcaatactaatacgtttgatccaaaaaatactgaataaataggattagataatggtttatgctacatcaaaatccctgtgttggaatctcaagacctctaattctacatgcatttcaatccttagaaacagatacctgataagtattgtagaaattggtaattatcaagaattttcgttagagtaaactggttgacccttaaacttgccttctttgggtatgattttccacctgaaacatatgcttaaaggcttatcattagagatcggaaaagctgcaaaatttgtcctaatagaactattgttaagaaatttcattattctttattgatctaaaatttatttctctaaggtcctgcttctttaagggaaatgtatgttgtggttgattgattttggatgaaatattgatgtattcttcttgagtttaacattgttatcttacatttatcagataaatatttttccacttcgattatagccttgtgtcttcatattagtagtagtatcctgtttttcattatacactaatttgtttggtattaataaaatcactacaatgttgaactagttttgcatgttatttttatcttgtttattcattgtccttctgcgccagaaaaactttgctacttgcaactggtatcttagttgctggtggaactgcagcatatgtgcaatcaaggtttagaggtaatagagatgatttattaggtgattcctatgagtccaataatgataaagaactcacaaaggaggaggtcgtgaaaggaacttctgcaccaaagaataaacaaaagaaaggagggttgaagtcacttcaagtccttgctgcaattcttttatctgagatgggccaattaggtgcaaagaaccttttagctttagtttctatagtggtaagtctattttgttatggatagtatgctttgtgcttatcttcaacatttcaatgcacagttgctttatgtattcatgtatttgttgtgatattttactctgtcaacttatccttgagattaaggggtcaatgacggactttgtgaggcatcattcatgaacatgtcatgtatacccactatgtagacatagtagactgtttaagtaaattggggaaaaagagattttttttttttttttatttgaatagaaaactacagtagactgttcaagtttgtatgagaatagatgtctgaatatcaaaaaagaaaatgtgtttgttgattcaccagaaataaataataatgatagtcaatgacatttaaatttcacatatttgcaggtgctgcgaaccactttgagcaacaggctagcaaaagtgcaaggtttcctatttcgcgctgcttttcttcgacgtgtgccattgtttctgcggctaatttcagaaaatattcttttgtgtttcctcttatcaaccatgcagtctacatctaagtacattactgggactttgagtctgcacttccgtaaaatattgactaaacttatccattctcgctattttgaggtagatattgttgatttgtatgtaaaagcttactatatttgattgtctgtattgatcttgttatccatttatgcattcctcctgtcatatgaagtgtctgtatatatactcgtgaactaaaatctttccgagttgtttttacctgtttataaggcttgtctgttttcttcttcatttgcaatgtatgaaagttcaatatgcaatgctttcaaaaatttcctgttagccttaagttctgtcatgtctttatacttcttaaagagaacaatagttgttacagactcttaatcagctaggtacatggctttgaacttattaataattaataaaaaaagaggtcttgtggttcagttattcttgttttgggcatagctttgggatcttggactggtcctgactagagcatttcagttttaagctatccttccaggtgctttgtactactgctcaatcttttcccaaaataagagtcattatccagaattcatatatggggcttgctaagacgcacacaccattttttcagttggtgtgtaatagcaatgtgcaccaaaaatataggacagaaaagccaaccttagcttttattctaataaactccttttaggatactatagtaatttgagataaattcttttttttttttaaaaaaaataaggaaaaaattgcttctctctcctaaacaatgtttctccccatgtcggatctgcactgcaacctcctccgcaacatcctcaatcgcggcttctgttttgctaatttgcacgcaacacggttttgctgatatcttctgcataaatatggaactatctcttgctagtcattattctaattctcaccatatgcacacaccatattaaatttattttcacaatagaggtgaaatgtagtgaggtcaacacatgccctgttgaaagcaaagtagaaaaagagagatgaatcctccctgagaattttcgttaaagacctaaaatgttaactgagcgtgactacatgagggagtaggagagagaagacattttttttctttattttttaaaataaattatctcaaattactatagtatccctaaaaagagtttattagaataaaagataaggttggtttttctgtcctaaatttttggtgcaccttgctgatacacaccaatggaaaaagtggtctgtgcgtattaacgagcccctatatatataaattgcaagggtgccaatcaccatcccatgcactattgcacatatttttggtggttataggaagagtagtccatgcgtcatcaaatgttataatgttttatttagtttttatgtcagctttctgtttatcatttacttttatttcagaacatggtgtattacaaaatatcacatgttgatggtcggataactaatccggaacaaagaattgccagtgatgtgccaaggttctgttcagagttgagtgagattgtacaggatgatctaactgcggtgactgatggactgctatacacttggcggctgtgttcgtatgcaagccctaaatatatcttctggattttggtactctcattaaactgtactgtatcactgatttctcactggcagctattgttcataattttgttttgggttgctgatggctggagcctgtttgatgtaatcttaagtttagttgttgtctttttgataactgttgtttccctgcaggcctacgtacttggagctggggctacaatcagaaacttctctcctgcatttggtaaacttatgtccagggagcaggaattggaaggagagtatcgacagcttcactcgcggttaaggactcactcggaaagtatagcattttatggtggagagaggagagaagaagctcatattcagcagaagtttaggaccttagttagacatattaatagagtgctacatgaccattggtggtttggcatgattcaggattttttattgaagtaccttggtgctactgttgctgttattttgatcattgaacctttcttttctggccatctaaggcctgacagttcaactttagggcgtgcagagatgctaagcaatctaagatatcataccagtgtcattatttccttatttcaatctctaggaactctttctattagtgcaagacggctcaaccgactcaggtatatttgactggtcatttgttcctttagaagttgatattagaggacatgctttgatgctattcctttctagggtttattttttttgtatacaaatattctagttatctgtatgttttacagtggttatgctgatcgcattcacgagttaatggccatatcaagagagctaagcctggacaatgggaaatcttcactgcaaagacaaggaagtagaaattacataagtgaagctaactatgttggattttatggtgtcaaggctagtgaattctgctgaactatttatgaacatttacttctatttatgttttcatatcttgattgtggtgttgctcccaaaattcaggttgtgacccccaccggtaatgtattagtggatgatctgacccttaaggttgaatcaggatcaaatcttttgattacaggtagccatttgaactctctgcttgctggtcgtttctaattttactttttgtggttggttcaaccatgataattgatcttatttcattattctttcttttcatttgttgaaataatcattctcttgtgtatttgattgggggaagttgaaatgattcatgcattttggggcttaatttttattatgtgcattcatagtgtctagaaactagaaaggttttgcatattttttgtacatacagctttgtgcttgtatctacatggctggaagtataataaggtttgtgtactattgactccaagttcaataatgtaaatagaactttgtcttgtttcctttgtctcttttttattggcaagtgcctaggttaatgcatccagccaggttctgtgtcaaagacatgttatattcaagctatgttatttcaaatgagtgttttctgcaatttctgtaggtgccattgtaaattattgatgttggctggttggaaataaaaactgagtattcccttttagtgggataaggcttggtgcttgttgttcatgtaccggttgagttggaaagctgtccagagtaacgcatgaggattgtttttacccgatgtcatctataacccacttttacccttaacacattctcctggcaattcacctcacccactggcgtgtggttagtaatgactattgatcattactagttgctgaattttctaacagttattccttaggttattctagttagtttaggattgcattaatttttaatttatcaatcaaacaagacaatgtaactggtttaataactgttatttgccatgttgatcattaactggtttaataaggtgactgctttcataagtgttgcttatttttagcaaaaggttttttgcattgataattaattttatgtgcaccaatcaaatacaattgaatgataataattgtaataaaattaattagtgaatttgtagtctagtgattgagattctgcccactgatgctacgcacagtgttaaaatctcacttcctttgatgcattttgtgggaatatcattgaaccagttctacctcttaagccttgttttgtttcacagtttgagcaatccatcagttctaatgtgtggactagcacatatccatgtgttcaagaaaatgtaaactaacaacaaaatagtaaaagtttcattgttcactcctggttggtcattataatcctgatgagcatgtgcatttgaaggggctggaaaattagataatttggaatttgattaagtaaaccaaaattgttatgatacttatctgtttagctttcatttgacaatctgaaaggactatgtttcacttgtataattggatttttaaaataagatttctaatggttgattgttttgacatgtaactcacaattattttgctgaaggtccaaatggcagtggaaagagctcgttattccgggttttaggaggtctttggcccttggtatctggacatattgtgaaacctggagttggatctgatcttaataaggaaatcttttatgtgccacaaagaccatatactgctgtaggaacacttcgtgatcagttaatttaccctcttactgctgatcaagaggttgagccacttacagatagcaggatggtggagctattgaaaaatgtgaaactcacatctaatcctccttctatctcagtgccacattaatgtttagtgtttgatgattatatgttattttaaccattattattcatctgaattgcttgtacatgtattgaaggttgatctagagtatctattggatcggtacccgtctgaaacagaggtaaactggggtgatgaactttcgttgggcgagcaacaacgattgggcatggccagacttttttaccataaacctaaatttgccattcttgatgagtgcacaagtgctgtcactactgatatggaagaacgtttttgtgctaatgttctggctatgggaacatcatgtattaccatatcacatcgtccagcattagttgcattccatgatgtggttttgtctttagatggtgagggaggatggagtgttcatcatagaaggttggaactttactgtgctgcttattattgttttactatgaagctgtaattaaatataagattcaaattttgaactccagtgaggactcgtctactgaattggggaatgatacaatgaaggctttggagacaaaaagacagagtgatgccaaggcagttcaacgagcatttgctatgaataaaaaggtttagatattgtgattctggtgtttttggtttcttcacggttcattatcttatattgatgatgaaagcttccctatttgtttttttctttgcctaggattctgcattctcaaattcaaaggcacaatcggatatttcagaagtgataatagcatcatctccatctataaagcgtaatatttcaccatctgctgtcccccaacttcatgttaatacaagggcattgccgatgagagtagctgccatgtgcaaagtattggtaagtatcttgaatagatatgctccagtaagatttttactttatattgttttagtgagtcaacaacttttccatcatattgaattattgattaattctatatgtttttgagtacattatttatgaaaatcttaggtgttgttattttctgtggttaattataaatttataagtctaaatatttcttcctagatcttttctgtcaatttaatttattatagttctaaatccctgcaacctgcagttctagtatacttctgattgatagtgattagtgacattgttatgtaggttggcttacttgcagttttgtttttagatttttgttggttgcaaagttggtgcaattataattctctcaaactatatgaccttgctagtaaagttatgcaaaatcaggatgtccgatcaaccaattcagtttttaggtttgactaacagtggtaatgagtttattgaatctgaggttatcttaagatcagggtcacttgctaaaattgaatgctcttttagtttcaggactgtgatggtggagcctgctggagaggctaggaagatttaaactaggaaccaactagggctttgaaacaaagaaatataattatttttctggataacaacatatctgggaaagttgttaagaagtagcttcaataaaaaggggggatgataaactttttaattcacaaagatagaaactttattccatttaatagcatgggggcctagacatctttgacagtttgacttagcttattgaaaaattattacaaagaccaacacttccaaaagctttttaagctgtttggtggaggtctatataggtttatcatctacactgactagaacccccccccccccccccggaaaaaaaaaactcatgtgagggcttgaagcttgaataatacccaggcctacttttatgttatgcttaaatttaatttaatccttcaaaatgggggtgacaattactaaactcttgatcacttggttatttttggaagatattagggtgatgaagttattagtcttattgttaatggggttggccttctgtttgtaacactagtacttaactggattatcagtataaatgaaagtatagggtttgggtattgcaatttcttactataatacattgttagctgctattctgttttccttttccctgtctaaaccctgaagcagctaaaatggctttgatattatatcataggctaactctcccaaaatcttgagctgtttggtgtaggctcacaaatggtttatatttctatcaaattacaatagcgcctatttaagaagttaatatgaataagatttctttacacattatgcttaaatttcagtggtgcatctgcagtcaagtgtctagtgcggtgaaacaaatgaaactctggtcatttgttttatacatatgaatcgaatgcagttatcaaggtgtttacaataactcacatacactgctcaaccaatttagctagaccccctgggccctgggtaactctatggtcatttgtgttatctcattgacgacttactatgaaaaggatgttggttagtacatcttttatgcatttcagtgatgcgtctgcagttaagtgtctaatgcggtgaaacaaatgaaactatgcagtcatttgtgcactatctccttgatgacttgctatgagccaacatcctttttaaaggatgtgttgtgcacattagttaatccataaatacgatagatctcaggtgcatttttttaatgtgtactgcatgctttcaggtgcccaccatatttgataaacaaggagcacgactagttgctgttgcttttcttgttgtttcaagaacatgggtctcagatcgtattgcatcactgaatggtattgtcctatctttgacttttcattattaagagagatcatatttataacattctagggtatttatgctctcaggtactactgtgaagcttgttttggagcaggataaagcttcctttattcgattaattggtataagtgttcttcaaagtgctgcatcttctttcattgcaccttctataaggtaatttgggattcacttgtgtctaaattgttccttccatgaatgaatattttttgtgggggtttgaaattaggtatttgatcttcagtatatgactggaatggatatctcaatacttgttcacattgacatattaccatttaccattcaatttcttgcgcaaagaatcaagccatgattccacaataaatacatgaatttcttcaataaattgatcttagatgcttatgaaatgtttctctattattaggctgagcctaaatcttggtaatctgcttattgttcatttattgatatttgtacatgacaactgctgtctttcaatgtaatgtttgatttgaaagacaagaacttgaaaagaaaagaactgaaaaaaaatattactaggtgtgttttacaatacaagcacaaatccctatttataggctaaatttattaaacaaaataaagaaattaaacatatcaagggaaagaggtattagactaagaaagttgcagatgaaaaactgtgttctcctgtggagaattctgcattaaatagtgctcatacaatttgattctacatctgtgtattaaataaccaatctgcaataaatgctatcctacagctgggataactaattaaggagataattacaactgtataagcatgtaagatctgctattttgaatggccaataagaacaaatattctgcaatttgtgccaattaataactaatattctgctaatcaattccattgacgtctcccctcaaattgatgttggtaagtctaaaagcatcaatttgctaactaggaaattatggtgctaatgtgtcaaggattttgtgagaatgtcagcgagttgaatagatgtagaaacatgaggcaaggtgataactcgattgtcatatgcctcccagattgagtgacaatcaacctctatgtgcttcgttttttcatggtaaacatgatttgtggcaatgtgaatgacacttgtattgtcaacatgtagtggagttggttttgcttgtgaaaaaccaagctctaaaaggagaccacatagccaaataatctcaaagcatgcagtagacatgttgcggtattatgcttcagtggatgatttggagactgtgtcttgtttcttgcatttccaagagattggagtttcccctaagagcatacaccagtcagtagtggatttccggacatccagcccaatcagaaccagtctatgcttgaagttgtgttgatgcaccagtagggaagaaaaaaccacggttggaagtaccaagtagatccttaataataaggtgtactgctgaaagatgcaaacgccaagaaaattgcatgaatttgctaactatgtggacaacaaatgagatgtctggtaatagttgggtaaataagacttccaaccaacttactatagaaagttgggtcttgtagaaggtcatcttcgtctcgtcgcaatttcagattaatttccattggagtatcaggagcagaattagtgagaccaactaattgaatagatcttgaatatatttgtgctgattgacaaaaatgcctttctgttgaaagtgtacttcatatcaaaaggctgatttacctttgatttatgaattggaaatggtagtattttactttcctaagtttgttaaagttgcaatcaaattgaacaacactaaggaaattttattatcaagaacactagatttcagtaagccatgaagtacacaagagtttggatgaccaaggcgcttatgccatatttgaaaattaacaatagctgaattacaagaaacaaaaggcggaaaagaacatcgagactgagagaaataaagaggaaaaagacgttcgactttacgccccttcgcgatcatcttccctaattgttgatcctgcacaagacaaccagattttgagaatgcaacttcgctatcattgtcaactagttgatcaacaaaaataagataactagtgagaccaggggaaacaaaacagttggttaaagaggaggaaatgtcaccaatagctgtgataggtagattgtttccatcagcagtatgaatttgaaggttaccgtaatatcttgtgacatttttaagggattcaacactgttggtcatgtgattggatgcaccagagtcaaaataccacagagtacaagaagaaaaaggtttacctgaaagtcctaaagtagaaaatgcaaaaattatcatttgttggaccatttcaggggtcattggttgcgcagaggcaaaagagcattttgattcgcagaaggaccagctgcagcagtaaaggctgtttcagttttccttggtgggcttatggggtattctttaatgatatggccatcttttttgcagtaattgcaaaacattttaggacagtgtgaagcaaaatgtccaagttctttgcaatagaagcattggacaacactcaggtctcgacgtttaagttttccttgtgcagcatatgcaactggaaaagagccagatttttatgttccatggatgcttgagttaggagacgttgttcttcacgaagaagctcattgaggcatgtatccaaggatgggacaggagctctattcatgagattggatcgaatactctcaaagtcaaatcacaatttcataagaagttgatctctttttgtagtctcatgaacttgttgcactgcaatttgaccttcatttgacaaattttcatagacaatgtcagtgtattcaatccaacaattcatgaactaagataaaattcagaaattgagagactatcctgctgaaatatgacaatttcttgttctagctggaaccttctagcagtattattctggctataaatcttcttgagataggcccatcacttggctgcagtgttgaatggtcgaagattgagaacaatatgatgatcaacagagcctatgatccatgccatgaattctggctataaatcttcttgagataggcccatatcttggctacagtgttgaatggtagaagattgagaacaatatgaggttcaacagagcctatgatccatgccatgacttaggcgtccttgacttcccatgcatcatattcgttcggctggttttctttgttagaagcagaactggtgccgtcaacatgaccccaaagattgttaactttgacaaatatttggaactggaatgcccaggcagaatggttcttgccattaaggcgaatgaataagcatcatacttgtcattagacataaggctaaggaaaaaaaaggtaatcacaagagagaaatcacaaaaggaacaaggagcaagaactggatagtcttgcaaaaccaagaggttaggaattttggacagaactatgatatgatcgcaacctagactgataccatattagactaagaaatttgcagatgataaactgtgtgttctctcatgttgagaattctgcattaaatagtgtttatacaatttgatttctacatctgtgcattaaatagccaatcttcaataaatgctatcctacaattgggataactaattaaggagataattacagctgtataatcatgtaagatttgctgtttttgaatggcccacaaatttgtgccaataacaacaaatattctgcaatttgtgccaattaataactaatatcctgctaatcaattccattgacaagagggaaataggaaaaaaattatctgaataattgcaaatatattctaaatatataaaaggagattttatcctaaattagtgcctatttacaatggcttgtgatgtagttcaactacgcccttttgttgagtttacatcccattgattctatattctattattcataaattattgattgcacttaaaatatgaaaaatattggataatttgtagatagttcaaagcattgaaactgggaaaaagtttgaataggttgacctcacaagagtctttgaaaagtaaatttaaaaattaaaatgttgtcttgttctacagacacttgactgcgaggctagcccttggggggcagattcgtttgacacaacatctactcaagaactacttaagaaacaatgcattctacaaggtaaactattcattcattcctcagcttcacttctttaatttttttcatactgtaaacttgtttttgtgtccataactccatacctatgcttgaataattactacttcctgatgaaccacaatcacatattgttttatttttatatgttgaaccttttattgaaataattttgtatctcagtcttattgatatcattactttctactattgccccttcaaatttaactcagttttcaattttgttccttgacctcttcatagttccagtgtccccaactattgagttaaataacaaaatttaccttcacatacatttatgtgaagttggcaatttttaggattgatggtattagatttaaatttaaccacaaatcattttctcgtaaaatgtggaaaaattaaaattaattaactcagtaatttgacactccatagggatgttatcccaggaaccttactgatgccacagaccaaatttcccatgtcaatagtttgagaacgtcgactaggtttggatttcactaacaaaaaatgtgatgttattattatgaataataaatatattattcaccttgcttttaagctatttaggcagatgccggatgactggggcttggttctgaattcacattacatacatttctttgtaggtcttccacatggcaagcaaaaatgttgatgctgatcagaggataactcatgacttggagaagttaacaacagacttgtcaggactggtcactggaatggtaaagccatctgtggatattttgtggtgagtaattcatttgcaaaatagagttattatgttactatggtgtattttacttgtacatggtcaattaacatattgatgcaaaatagagttattatgctctttttttttttttttacttactgagtactttcgttattctaaaggttcacttggagaatgaagctgttaacaggtcggaggggagttgccatactctatgcttacatgttactcggtttgggatttctaagaactgttactccagattttggtgatttgattagtcgagaacaacaacttgaaggaacatttaggtaaactcattctactgtcagctaacaatccaggtactaatcaaatagttctgttgaaattattctgatcggtttctctttatgcttttctaggttcatgcatgaaagactttgtactcatgctgaatctgttgctttctttggaggtggtgctcgagaaaaagctgtgagcatcctaactctgcaatatttaatgtattttctttaagtgtttgcttgtttgaggacatgaaaggttgaaatgaaacctgatgcttgtcataataaaaatgtgggatgactgaaactagagtgccaattcaccattcaaattttggacactcctgttacttgaaagtgagttgaaagaagttttatccttttggaagcaataaagggcagttgggttataactatgagttgagaggttgtttctgcaattagaaccttgactgtctggtcataaagcagcaactgtaccattatgatgggggttcatcatcaacctttaccaagcaataaagagtaaaactcagcctccatccccgtgttcagtcctctcataactttccactttctcattttccacctccttgattaagcataccctaaattttatacatgttatgtgtttgatcaaattttatataatgtagggctctaatatggggaagtgtgaagtgggtctcagtttgacaggaaaagttcaaaaaatttatttttctttttagttcctatttatgttctgataatggttggatgactctacttttaataacaggagcagattaaaactatggttatcgtcaatctctaaattaaactctcttaatgttgagcagatggtcgagtctagattcagggaacttctcagccactccgagtaccttttaaaaaagaagtggctgtttggcatcctggatgattttatcacaaagcaacttccacataatgtgacttggggcttgagcttaatatatgccatggaacacaagggagaccgtgcatcagtaactactcagggtaagatatttgcattgaatcatttactctatatttctcttgttgctctcctctctcacagacaacactatactaataggtgagctagcacatgcactgaggtttttggcatctgttgtttctcaaagctttttagctttcggtgatattcttgaattgcatagaaagtttgtagaactctctggtggaattaatcggatttttgaacttgaagaacttcttgatgcggcacaatctggtatttaatccttctttagttttataatcaatcatatcaatcaatatcttgctgtttgtatggcagtaaatctctttaatagccatcaaattatgtgctaatatgaccttctaccgtacagagaatttcacgagtgttagtgctatatctccagtgagggatgttcattccagtgatgtcatttccttctcaaaagttgatatcataaccccttctcaaaagatgttggcaagggagttaatatttgacattaagcatgggggaagcctacttgttactggttggtatagtcattattttatttgttttgtcccttcagaagagggaattccaatgtgatgtaaattttggtcttacatgtatcttctttttaaaaggtccaaatggaagtggaaaaagttccattttcagagttcttagaggactatggccaattgccagtggaagactatctagaccatctgaagttgtggatgaagaggatggatatggttgtggcatcttctatgttcctcaacggccatatacatgtttgggaaccctaagggatcaaattatatatcccctttcctgtgaggaagcagaggttaaagtactgaagatgtatggaaaaggtaaatatcttgggtgggagaaataaggcaggccttagaaatgccattatgggtaaaaatgaaagtttctgactataaattaacataagcaagtagcaagttggtaaatctgctttgattctctatttaattttggattattaccatggttaaagtgagtaatttgaagtctagatgcaataaagtactctttctagcactatgttaatacaaaaatgaaatatccccattagattttttggggggtggggggggggggggggggggcgggggtcaacaaggctttatctgatatttacttaggggattggaacaaaaccttatttttaactctacagcttactgtttttagtatttgagtcaactaaagtttataacaatgctattgtgttacttttcattaatcaccactagctgagaataagttttcttctgagctattctaaggttgtggcaattcaatagaatgatgttcatgctgatattgttgaaaatttctcttttgctaacattttatttggggtttagggtaaggcgttcattgttacttactttttatttggggaaaattattctggtcagttttcttttacagatcaataacaatttcttgttctcttctccaactgttttaaagtgtgcattttatttatttgcttttccattttagctctgatgattataacttgctaattcaggtgaaaagcatgctgacacccgaaatttgttagacacacgattaaaagttatcctagagagtgttcggttgaattatcttctagaaagggtgggaagcaactgggatgcaaatttaaaatgggaagacattctttctcttggagaacagcaaagattgggcatggtatgtaaatataatctcttgaaattttagacagttttttaaatttcttaaatatttttgttttatacagcatgccccttagaaagtcttcaattccttaaagaaagacatctattataatttaaaatattctcttttatggtttttaatgttgctcactctgttctgtaaggcacgcttgttctttcataagcccaaatttggtatccttgacgagtgcaccaagtatgtatgatttgcctttgtcttttccttttcagagaaattgttgcttgttgttattgttaatcttgtttcatatcctaaaaaaaataatgttggcagtgcaactagtgttgatgttgaagaacacctatacgggcttgcaaaagatatgggaatcacggttgttacttcctcacaagtaagttgattatacaagtatattggaaaaaaaaaaaaatactgtcatggtaaatttagtgaattaagagtagttcactaattagttgttttgatgttgcctcatttccttcctagtgtacacttattttatttctttagctctagataaaccagttatagcttgtctaacattaaacctgcatgttagccataataatgtgtgatcaaactaaatttctctgctgctgcccccagcgtcctgctttaataccatttcattccatggaactgcggctgattgatggtgaaggtaattggaagcttcgattgatcaagcagtgagtttactaaaacagtgttgctgcatggactcagtataccatttgagatgttttcgagtcgagtctatcacaagctggctgtttccgagcataaattaggtttgccaacaaaggtcaatcctatatgcttttattttgagtttccatattctcctagattcaatgtttactaggggactaacaaacaaacagctgaaacagccaaaattgttgataataagttcttcgagcacacaaccattgcataatctctgcagtgtataggtggtgatcaatcatgtatagtttcccccctttcttcttaggtagttgatattggttcatatgttgtagccattggatgtaatgattgatatttaaattgtttaatcaataaaacagccggaaagaagggttcgtcgagctaatttgttgccttcaaaaactcccatgctgttgtgtaagattttttcttatgttcttttttcttcttgtgccacctgaactgctttcatctcatcccttggcgttgccttcattgttcctatgtggccatgttatgaatcatgatgaaatgtttagtactttgataagttttttcgttatatttaattatatacttgatggtttgtttaacatgtaatttttttattaaaaaaaagaagcaaaagaaaaacggaacaatctatttacttattagattaaattgatattgaatttaaactgatttacattgaataccaatatattttacttaagaggggatacaatattgttataattcacattaattctaacaagcttctcaaacctccatacatgaaggaaaagggggatcgaaggttatttttcttatatttaggctctttctttgttttaatctttcgaaatccaccctgaactattgcatgtattaatgtgagttatcaatatatatatatatatatatggtggaacaccgaaatgcaacaacttttgccaactttggcgtccacatcccttgaattgtttaacaaagactctatcaatttatgagggtatctatctgttatctataataactcacgactctaataatttctgtcttagcacttagatctaccaactagaaattgaaaaaacctttttcttccgttattaacaattaattaataaacgaaattgattagtcgatagacaattaaaagtagaagggtcattgccgttattgttgtaggcgtatccaaaccacaaatgttaattagggtgatcactgatgaattgcaacacgttatacatggctcttcttcataagttcatgttgatggagggagctatggccacaatttttttgaatacttcgtgtgtaagtttgaaaatcgcacatacaccactttcaaataccaaagtactgtattaccacctgaaatgttttagataagatcatttgtcattaataaatttgtgagtctttgttacacagttgtgttaaacactcaagaaaaatttcataaagtctaacaaaaacgtaaccttaaattggggaaaatgattctctaagatagtttttcttttccccaaggataccttttttcgcaaaatttgttcccgtataaaatctcaacttcttttgtaagtttaagtacgatataattgcatttttttttcttttcaaattgtacatgtgatttttcttggttaaattattttgcagtcctttataattttgataatattttaaataagtttttataattttttaacaagatctttatggatattaaggttttaggttaagatatgacttcaaatttatttttgagtcttaaatttaacaccacactttaatctaaaaccttagagcttagatttatgaatcttattttcatttatagagcgttcaatcttcacattcttatccgcttatatttcaataaatataaatgtcacaaaaacaaaattaccaaacacaaattaaagtacctttaaagtcaacttctatttacttaaactaattgtttttttttgttctctcattgtttgaactaaaagttacttgagtataactttccttaagatgaaataagaagccacaaaaaatggaagtaaaaaatcgtcatgaagatgttgtggcgttttgcagccgtgactgaaagagttagaaggagataagtagtttttacttgcccaaaaacgataatgttaaattgctagaagcagataattaagaaacacggaataattaattgttagctacgtttataaacaaaactttcggaattctggaaagagaaattgccgtaagtgttgagaggggaacgtctaagctacttatttagggatataccattacccaccaattattaagtgttgataaagtggtcaaatatcacaattaacagctgatcgattattaatctctctctccttaaataacgttgtcttaattaagcataattctgatagtggatctataattatattttgaaaatagaaatagttaaattgtcatccttttctaggctaagatggaaagagatataaaaaattgaagataaaatatatctttagtccctcaaaatattttgaaatgagtttaataattatacattgaaaatataaataattttatattgttattcaattataaataataattgatataattttttagatagttgtgttttggtgacctgttggttatgagtttgcattcggaaacagtctctttgcatatgcaagggtaagattgagtacaatatctctcctccttacctgcacatagcgtggagcctccggataatgggattacgtggttttcttttttactataaaaattaataaattttacaatttgttaaggaaacaaatatattttacatgtaacaatcttacttacatttgataaaattattatagattaaaaaaaatattttttaacatttaaactataataatgtaatgttaactttttttactaacatttaaaatcatatttaatatgacttagacttattagaatcagtcttgacacaagtgtcacatcattaagttttgattatttaaaaattattgacttagcatttatgttatttccttgactgctacctttttatatgtaccaaaagttatttaatcttaaggtttgatatcagaaccaaaacatccttattttatatgtaccaaaaggttatttaatcttaaaacaaagaaaagttaattatcatcatcatttcatcacattaattctctgctcctctcttttttatctttctcggcatgatgttccttaactaaaaaaaaaaagttaattatcatcatattgtcatatgatatgcacaacaactctcgccccacctaatgtcttcatatgttgtatccattcattttaattcatgcaaatttctatcccccctcccctcctcttacttttattgttaacaaattttccattcaagcatagcctgaagtctatttgtctccctctactatgacgtcattttcaatttgcttgccataaatcataatcgaatgttttcagctgctcagccatgagatttcgttacagctcgacagtgggtggtcgccaaaatcttttgtgtgttgcaaagaagccatgtttcaagaagtatcccattgaaaaaaaaggaaaaggaagggagtgaaaaatttgtgtgatacaatgatgataataattaatttttttaattttaggtttaaataactttttgatacttctaaaatagggatgttttggtatctaatttttgtttgtactttaacatttttttttaaaaaaaggtaccttaatggatgatttgaccgataagatttaaatggcttgtatttgatgcgaacttttctttaaccacaccatcaattaacaaaaattcattaataacaactacctatgtcaaaaataacaataagagcttaggtactaaaatcaaaataaataattcttttatgttgtttacatatcatcgaccaacaaaatcttcaatattaatggaaatcaaaaacccatatatttttaaaatatgagtatgttatgtaccaactaaaccaccatttgtcaataaaaatactcctactttgaagatactaaaaaattatttaagaagtaaaaatattttcacttataactactactcaaagtagttatatataagggagtggaatgacacacgttgagcatgtagtgcgagtatccatttctaggtgccatcataataactgataactcaaacctctcgagagtttgtcataatattattcgtaaattgtaggtgggggtggcatagttgcagttggaaatcgaaagaagagaaaagaatttggatagtgattatttgggttcgttatcgttgaaacgttttttcaaatctggtgtggtgaataacatcacccctcacaaactaaacaaaatgcagagccagagaaccacgccgctaaggaaccctcacacctccacctccgatctcctaacgtggtccgaacaacctccgccggagtcctccgcctccggctaccgctctcgccaggttactacttctatttactgtctctgttttatattttatttaagcatcggtttagttggttcaattgaatctctcgtgaagatatataatgagcttgttcctcgaatcgcttatctattcacagccttctgataaaatcggtgaggttctccgcggaagcaagctcaccgcggaagaagcacagagtctaacaaaaaagtaatgctatcatcttttcttttcaattctatcgcagtgttggatctgttattgtttgttttttttccaactttttaattgtttcgttctgtgatccgattcagcgtttgtttctttatcttgtaaaccctatgcggtttttcaacttctagtttgtgtcgacttttttccctctatttattattgggaacgttttgagaagccaatcattggcatcctgcattcagttgttgaaacttgaaactctaagaattgcgttatgatgaacaatcaacacgaaattattttttggaaaattgctaattggtacgaatttgtgtatacagctgatcattcatgatgctgtacaaaaaaaaaataaataaaaactgatctcatgatttcggctaattaccaaaattcttttgtttcttaatttacatttgaaccaattatattaaaacatcttttgtaaaaaaaaaaatacatcaatttttttttacaaataaaatgttttaatattaataatgttataatattttcataatattatacaagataattcataatattttcattctaattaaattattgctttaaaattcatatttactatttaaagtgtttttttatttagctgtcagagtaaaaaacttcaacgtgataaaaattaaactgaaataacgaatttatactatagtatgtttgctactagttaagttaaaaagtgcatgctgttatataatcttgttgtcaaacatatcttttcatgtgttttactgttaaaggattaattttaatatgtttattttcggttattagccgtcatggctagttgtttctgttattttgctgttctgttgtgattgtaactaccttgctttatttttcttcttatagctttgtggcattttatataaataggcttccagcccaatgaatgaagtcaaattccaccttgtgcatccaatcatttttttttttcgtttttctcttctgacatggtctcagagtaatcctgtcccttcttcttgttattttctttttcttcttcttgatactcaggaaaccctgctcaggatataaattgaaagagatgactggaagtggtatattttcgggtaattctgaagataccacatcagaagaaaattctgcaaattcaaaaaacagaacaagcatacgcgtatataaggtatgctagatggttaccttattccaacttccaaggcaatttgaggtttgaccatatgaatgcgagtgtttcttaaataccaacttcattgtgataatagtattcttgttttatttccctgcaattgcatctcagcaagcaatgaatggaatcagtcagatatcattcagcactgaaggaaacatttctcctaaaaaaccaacctctcttcccgagatagcaaagcaacgtgaacttggtggaacatatcaaagcgaaacagtcacgaagatcaacaagcaaacgtcaagtgccaagaccaaggagctcagcggaagtgatatatttgcccctccttctgaaattgtgcctcgttcattggctgctgcacacactttggaatcaaaagaaagtaaagacaccagaatatctgttccacaaaaattgagcacatctgcgcaagtttctaatgtaagtatcttcttggcatgaagaccaatcacgagtcatataaatcatttatattggataaatgtctacagaaatttttaattgctctaatcctgtcttatggctattcatagtgatgaactttttacctttggtggtgcaaaaatgtagcctaatggtttcctgaaaggcaaaatttaaatgcagaacaatttgtctaattttatgtagttataacccaagggttgtaatagaaatacggttgcagctctggaagaataccatttatttggggatgttaaattttctatcattaatgtttcttccctcgccaagatatgagcctgttatcttgagttagagccaaactgcacattcattatgttgaagaggtccatcagtttgtctacatgtttttgtagtttccgtgtcagatttcttcttaaatttcatttttctccttttagaattttttgttgaaacaaaagacatgtttttcttaggttttcaataatgaaacattaatttttcctctaaattaagctgtaaattcatccatttctaatccatgtgcttccccctttagctcatgtgccttctccctcctctttatgattacattttgaccctagttttgttattgttgcagcgagccgatggccaaagtaatttctcattcagtgaacaaccagttaagatattgaggaaaaaaatgcatgaccagaagtttacagagatgacaggtaataatattttcaagggagatgttcctgcaggatcaccggaaaagccttcgagcagagctaaacttagagaaatggctgggagtgacatatttgctgatggaaaggcagagagcagagaccatatactaagtgcccgcagaccccccggtggagggagtgacatatttgctgatggaaaggcagaaagcagagaccatatactaggtgcccgcagaccccccggtggagggagtgacatatttgctgatggaaaggcggagagcagcgaccatatactaggtgccctcagaaaccccggtggagggagttacatatttgctgatggaaaggcagagagcagagaccatgtactaggtgcccgcagacccctgggtggagggagtgacatatttgctgatggaaaggcagagagcagagaccatatactaggtgcccgcagacccccaggtggagggagtgacatatttgctgatggaaaggcagagagcagagaccatatactaggtgcccgcagaccccccggtggagggagtgacatatttgccgatggaacggcagagagcagagaccacatactaggtgcccgcagaccccccggtggagggagtgacatatttgctgatggaaaggcagagagcagagaccatatactaggtgcccacagacctcccggtggagggagtgacatatttgctgatggaaaggcagaaagcagagaccatatactactaggtgcccgcagatcccccggtggaggaagcagcattgcgctcgtttaaatttgatcatctaaattcgtccaattaactgtgtactttctataaattcctctgaagttccgtgttttgactggaaggatcagtgtgttggattgtcaacatcgtatatttatggtataacccccgacacagaataatttggtttgccataatgggtgcaaatgtttattattcatttatgttgagatttttttggccatgattggataaataaaattgttgagatttttttgtaataagaaattatttactctatctggtttatgctttttatgcgataattgttgagaagtatatttgctgatattgttgagaagttaacaattatagttgcctttaagctatctagactgactttttgtgaaatgtgatggtatgctggtaggaataattgtgactttataaaagtagaaaaaatacgcagcaaatattctatgatttaatagtaataaagaggtgaagcgctgtgtcttgaattttcgacattcaaaacattattctaaaacagcagggatggtttatactttatccccctcataagcagctttaccggcaagccactgaattcctctgtccagagatccacagcaacatcacattcatgataataggaaaagcaaatagcctaagcatcaattccatgagacaactgaagagagaaagaaagaacacttaatcctcatgtccaaccagtgcaaggagaatgctctgatagtctccagaagtgtcattggctattgcgcggtccagaggaatgctatttcttctttggtattcctcagcaattcgctgcaaatcaacctcagctctggtggtcaccactctagtaagggccccttcatcagttcccagcttgtttatagccatcctcaagacttttgcaaaatatttctcagggtaagtcaagcacttaatggctgccctcaataattgcagatagtcatcttttggatcggttttcagatcctgcagccataagatgaattgtcagttcaactaccagtcactgattaatctaaaatcactaaatcacaatttctatcttgtcttcatatttatttttttgttttgaagtaagcccagaatataatcctttaaaatgtagcaattgattcatctaaaacaagattatcagtggaaatcacgtttcttaaagtgaacaaaacatggtcataaattcagcactatatcagcataagtgctgcagtaggtactcaaacaaaaagcagatgttaggctaaaatcatagaaatgagtcataaacagtcaaaaggtctataccttgtttatggcattcccgaactcattgttgtactgattcagtgttgctgttaactgtgctttactccttgttgacaaaatcctgatcagctcctcatcattgtaggccttctctgcaatcttctcgtgaagcagtttagcctcagattttgccaatgtcatgttcacctcatccccctcataacggaatatgctcataagaggaactaatagctgttattgacgtatttcatcagaaaatagggggaaaaatgtgtgaaaaaaattgccagatcaaatgcatgattggaatcgcttctttttttttttttttctttttttttaaagttctctcaggaacctaaaaaaataatttaactaaccatgcatctagacatagcaaaataatataaaaaaaatgttaatattaataagcttttaaatctagcaattcaaatgacatcaagcaaaggttctcttgaatataaatctaggacacacttctaaacaaaggttctcttttaagttgaaaaggtttatatacattggaaaattttgatcgaagaagaaatgacatcaagcagaggcatcagcctttgaatattatgtaagaatatgcaacttttctttatcaaggtgtaagcaagtacattagaaagttaaggttttaccttgcggatgtcccctttagtatgataggcaacgtcttcttcaagggactttttgaaacgggcttgatatgcttgctttgccttaaggagatcaagtgaagatctagtggaagcaatttccaaaatgacccaattgtttgaagtcaacatcttagtggcttcattagctaaaaaggcatcacgctcagcaggatccaatgtccaaactaacacagcccgcttttatattcaaaacattaaacattagataagaaactaactttataactgcaactatccgtttcctttaatcaaggttatccgtatagaacacagaaatggagtattatcaaaattgaaaattcaataactgatagtgtcattgaaaattctaacttctgaaaactgaaatgggcgtcaaattgagatttacataaagaagccagatattaaaagatttaaactgacctcaaagtcacttgaaagttctttgtctaaatctttaagaagatcttctccatgagttgcactataagcttcacgaatcaacttacgctgagctgcatttctatgacccaggattgatattatcaatccttcattcgttccccaccctgcaaagatatgtcacagtgacaaaattggatgaacaatcaaagcaactcttgcaatgagagaataaaaaatggctcatgccatgataaaacaaaggaacaaagtaaattcccttatttgaaaacttctgaattattcaaagatccaatttcactatgtattaattttctgtaatagttatctatatcttcacttgtttgagcacttctgaacacacacatactaatattaactattagtattactgaattaacgctgggccaaacatcgtttgcatttagttcttaaaaacacaagatctacatactaatttagtttattttatttcttttcttttcattttttttctcctgtgagtacatatgggaagtttatccaaccaaaatgtaagaatgaaacttaaattatatatatatatatatatatatatatatatatatatatatataaagaaaagaaaccaaatctcaacgataatgattccgtcagtcgaattttcaacgtgtctacgcagttagcaaattgtaaccgttggatgaagataaaaacaatcaaaaggcttgtattcgatcttgtagattgaacttaggaggcatttggtaagagacacattttttgtttatggggaatcataggttggtctctcatgtttgatatgtatttttaaaagattatattcatgaaaaatgatgttttctgaaatgttttttattattttcttactaaaattttcttatagcagagatgtgaattttattttttgagtttaatttttcttttattattataaaaaatatcatattattttttattaaattatataatataataaataaataaaataatcagtaaaaatttatttgtaactctttgattcctaaaaaatttatctaaagattttcaattgtgaaccaaacaaattttattctttctcctaaatgtaaaaaaaattctgccctaccaaaagttatcataaagcacttattgtaggcatgagttgtctgatattcatccaacggtctcagtttagtaactgaatgaacgtatgaaaagtatgactgcatcgaatgcggttccagcactcatcaagcagaaataactaacaatgactgcataaaccaaacacaacaatctattccaggatctctaagtaagagttgatatataataaaaccccatcagatcatggacacaccaaaagacttaaatccaaacgagatagatcgagaaaatgataagcagatcgatgatctaacaacaaaataaaagccaacaaattcaaatcaaagaaatgaatgagtggtggtaaggtaaccttgaaaagcttttcgcaattgctcactgtcttccactggggaaggaagttgagcaggaaccttcaacgtcgccattttcgatcacgatctctgtgcgcaatgtgatgtgatgcagaaaattgaggagttgttgccagcttaaccatttatttatatacaaggaatggtacaaacctattatcgaccacaaaggaaaaaaaattaaaaagaaaattaactttaatcataactataattggctacctatgtatgataagacattgttgacttttgtaacaaaattaattattaataaatactcaaaggacaaaagttagataaattttcttaagtgttgtttatgctattaaacaattagaactgatctaaagaagaagaaaaaatagaactggagtttcactttgatagttttcctaacaaaggtttgcataaaaaaggttacacaaattatcaagatgaaatctaattctcattggataatagcaccaaagagagtggtttgtcaaaaaaaaattataagcaagtggtttgtcatttactattttttaaattcagttttattacattttttgtgtatttacataattaaaatgcatccagagtataatttttttatatagtcatccaattataaatcgttagtatgtatcataaatttattaactctcataataattaccctaagaattatttaaaagataatattttattatgaaattcattatttttaaaaaaacttggtagatttatattacacagtcacctgttatatttagaatatggttacagtgaaaataatttcagattatttgatattgtaatattgcataaagattaaattttatgcattaatttaatttatttctaattataacctttttccatggaattacgaaaaacgtgacataggtttcaaataaataaaacgtgaaattgggttcaaacgaataaaacgtgacattggttgttccgggaatctatatgttcaaaattcaaacgacgtgttctaatttgcatacaaaaatgagtacgttactattttttcggtgtcttgatctccatgcacatggaacaggaccacatggaacaaaaataagtacgttactattacatctcatcgctaaaggaagttaggaattgtgattgtatgtttcaattgactttttgtttatggatttggaagttcatggaggagttagtaacttgtaaaattcttaattttgttggtcaaggaatgaactttcatggttataatcctcttcctcataaagtctctgcttttttgtgcaaaacataacttattcttagttgaaatagtctcaacctaatcttctaatttaggatacgtggcactggctgcaatttaccactgtcctttcatgttcttgcaacatttaaggtcatttgtaacttttagttaggatgatttagaggattgaattgtatagttgattgccaattatataagttttctttaggattttgttgttggaaatataagagtgctacttacaaattgttgagtaatgtgtggactaaaattggttattttgcatattggatgtttgaatgataagaaaatgtttggtctttattttaattttggggtgttagagctgaaaactttatggtaaccatacccgtttcacctggttttgtttgcctttccaatatgccaagcaaatatggtagtgcagttgcttcttctaataatggctgctaattattgcatcattttccaggctactcacatatgacaaggaaagaacgcaaaaaggttgaaaataggaatgttgtttgtcttggtgggaaggtgaggactattgttgatgttctattttgtttgccatgtgccaatgcaaatactagttcaagggtgctcaggaaacaatttttttgctgtttatcattttccaaaatgtagccccccaagaatcagatattaccttataagtgtggcacgcccaaatgatgaagaaacaaaaggagagggagcagaaaatgctccaaaagaggtaattaatttctatcattccccacttttatccccctggccctgttatttttctgtttgtatgttactgacattattcatatataaatttgtacctattacattgtggcttttagcgtttgattcttggacaatttgggggaaagcttggtggtagcagtaaaaaatctgctgggaagcacaagccagagaacaggggtctgaaattaagtgaaggtcattttagaaatggcacactcaatgtgaaaaaattcaacaccatcaagagatcgtgaaactggaaccaatatgtccaatacagggaaaggtggtatgaagaaaagtggtaaaaagggtgccagtaagaagcaccgttgagcatatccttgtgaacaacgtgttttaggaatattgagtcgtcattttttaatatgtatgagtatgacctttataaatctagtgtatgacctttgggtaagcttttgacaaagtaaaatggaatagaatataaaacaggataataatgtcttgtgttttctggtaattataaaactgaacaaggccttcaaccttgtgtcttgttttgcgtttttgtgcttatcaaaccgactaagacatttgacgtaatacaatggaatggtatatatattcctgtgttgtttgaagtgaagtatatatatatatatatatatatatatatatatatatatattaatgtcctatagttaaaaaatgattaaccttttgataaaataaatcttttgtcgttgagttgttttgagtttattaatctttttccacaatatttatcgtaatatagcttgcgattcaaataatgatagctttggtaagtagttctttgcaataaatttttaaattaccatacattttacttttactttacaaatagaagtaagtaataatttagtaaaaaatgtgtaaagcacgaaagcataaactgatgtttaattacgagaataaaaattaattaaaaacctgtaaaagactaaattgcatgaaaccatatttatatggattaataacatatttcacgcatatttgtaattgcaggtagcagtattgtctaacattaattcagcagaaaaaaaaagtctaacataggatacatcaattaataaatagataaaattcaaaataattcattattacattttgatcgaacataattccaagtactcctatccttccgttgttttttaattgtcagatttttaataaaaaattattcttatttatctgtcgttttcaaagtcaaagatagcattatttcttttttgtcaattataccattattccaattaattatttacatattttttttatataaattaaattataagtagttgaaaacttcaacaacaaaaaattaaatgcagtggaatacatacacgttctccagcttctccacttttccacaaatgacttattcccaacaaaagagaattaaagataatacatgctttgaatctaaatttaaaaatgaagaggggtaagatgcaagtatagagtaacaaaaatgggaaagatcttaatgtttactcaaatcaaaacttttggtggtaagcattttaagaataaaattatagagggaagtttagttcagtttcaaaagtgtcaattgaacaaaggaagagaaatgcttcaacagatatcaaaaggttggctgacagaagaaacattagcttacatctacgaaattggatgctttgtttcagaaaaaaaaaacgttagagataattaatgaaatcttgaccaataggaaattaggaatatgtgttagttatggagagagagagagagagaaataggagtatacaatagttatgggtattgagaaaaacgtggagtaagagaagggacttaataggaaaagtgtctacaattttattaagaaaagagtggagacggagtaattacatttgttgattacaatgaagatctccttaacgactattatataaaaatacagggagtaataaagaaaataagccatttatttttttaacatatcaaacttctaatagttacttgattctactattctaattacacggacacatgagttttgacaagaaatccttttccgtttgaatatcaatcttgcatcaacaaggaataataactttatatggcattggcagtgaaaactgaaaagtgagaaaaatgcaaggaaaaaaaaatcgaattcacttgggatctaacccagaatctctggttattggaaaaagctggctatcttaaaacacatagctttatatggatccctcctaccttgaagtgtgaccaaatgtaataacactacgactttatatatacacaataagtttgagaggctttccttagaagcactctttatggatttatatcaagcatttgaacatacacaagagtgtttgacacagttagcacaacagagttgcctctgaaaactaaataaatggaaactgaagtccatctagtatttgtattgcatcatttaattatttctctgacgtgtccaagacacatttggaccaatattattctaatttaattaccaagcacagaaaagtaattgaagggggaagaggaatgagggttcaacagatcatacaattataaaaacagataataatgtgcgtatacatagtgaaagatgatgatctctgtttttcgagctcaaattctaactgaacccaaaaagcaatgagaatattaatgttaaagcacaagtttatattccgtgcggtgatgaatatattaatcattaaatgtagaaacaattaaaaaccattttgaatgtgctacataactaatattaataatttgtaattttgcaaagtcaaggcttaaatattttttcttgtcacctacagtgagcctgatattttaagtaaaaagctacttaatcacaatttaaagataaaattgtaaaaatattttattaactctccattttcttctcttaatatatttttaacttttaaacaagcacgtagaaacttctctcatttttctctctgtccttccccttcattttccttaaatttctttcattcccttcccctcctaactctaaaaaaaagtctaaaaaaatgaaattcatggaaaacaccaatcagaacaatactgaatactgcaatcaaaattttaataaaagttgtttttgaagcaatttttgtaaaggattgtaatcaagacaatattctcctagaatttgaatcataagtgattaaagaatctgttagaatttaataccacataaacatatgtctcataatccaagaaaatcctagagtcctcactcttttttatttctctatatgtgttttctcctgatttaaccaatttactgttgatatgatacatgtttagaacaatacattgtttgatgtatttgaggactaattaccttttttattttattttttatatgaagactaattattactttttaagtacaactaattgaataagtcatggaatgatttttaaaataaaaaagctattacgcacctggctttattatgattttggttcttcaaattagggagtgttttttttttagtcttttaaataaaaaattattttttaatccctcaaatttaaaaaatattatttttaattcctactttcaaatgatagtttgaatctttcaatccctcaaattcaccatacaatttggtactacacttgatgtatattatttttttagaatcaatttaatatgattgaaattcataacaaattcgttacttgatgtataaaataaatatttttttagtataatgtgattgaaattcataacaaagaattttccgtaccaaatttactttgaacacaaattcataaaaaatatattttgttcaaattcataatgaagaatttgaacaaaatatatttaactcgttatttagtattgagaggatttgtaagaacgaaatgcaagtggatttataattacttttaaaataggatttggatccttcccatttcttttatcactaagcttttagcttttgaaaaaataaaagttattctctataaagtgtatcgtcttcattttattattttctaaacacttataaaaatggaagaaatggaaaaaaaaaaaacggagaggatcgatttcctttaaaataagctataggtgtaacaatatgcgggtctcgagtgattatgatgttgctagtgtcttgtttgtttgctagtttgtagcttctccctgtacaaaatgagccactgtccccccatcacccaaaaagaagggaaaatatttcagggatcagtcaaggcatacatgatgcaattgcacaaatgtgccagcaaatagaaagtgatgatgggaaaaacgaataggcatgccccattagtggatgcacgcacttttggtgtatatatcgatacatcatcaaatgcatgcgcaagcaccacttatatatagttttcaatatcatgccttgtctgcccaatttgacacacttcatgtggctgagaaaaaaagtcaagaagaataagaactcaattattattattttttgagaaaaaaccacttttgtttgaaaatacgctttaatttttttttttcataacaattcaagtaaaaaaaagaataaatatcaaattttatccctgaaaatataattcaatgacatatcaattactgaaagataaaaaaataaaatttaatctccaaatggataaaaatgatgacatattgatcttgtcattagtttttttggttggtctttatgtgtcaagtagaaactcaaatgtaattggaaatattaaatgaaatagtgacttaacaggaccaatttatcatcaaattatcgatggattgatttatcaatttttattatatattttttacaacatcaaccgatattattcactttaaaattaacggataatattatttttttttaattttactctcatcttccttatccatgtcgtcaaatacaacgacactataacatgaagaatattattttattagtgtcctgaaaataattgaaaactaaacatataactaattctcatctttacctacacgcttgttggtgatcccatggtgatgaagctcatggactccgcctccctgcagggtgagcatgagttctagaacgagctcttcgcatctcaactttggtccccatcgtcaatgtctactttaacccaaacaacgttgtttcccccttgtgtactgccatataagtgactatgagaaatgaacaatcatataaatgaatttgacaccacattttaacccaaaatcttaaaactcatgtttatgggtcttctcctcacatatataatgttcaacttttgcatttatattcgatgtggtgtaacaccctgattgaattacaccaaaatgaaagagatatagaggttgtgcaggtatgagactgtacaactaatgatgacttaaaataattaattgacactacctatatcaacaagatgcatatacttttcagtagtccatcaattaataacttcatggttgagcgtattttacttggaatagttattggataagtgactttctggaaagttttttggaacgcgtatgagtgaggacaaaacacgccaaaaaatcttgtgttggtttgtgttgtaagtcattaatcttggaagcaaacaaagttgatttttgaggtctcaaaaaggactacttatgaagatttatgaccaacaaaaatgttgagtgaaatgtcattgcgtgaagtgttgtaatgtaagagccaccaagatgtcgaaaatcagggacgttatatgtgagacttcacctcacacttgtactcaaataatttccccctcaagtgtaagtacttctcttctacatggtaacttttccctcaagcggaagtcatttttattcacaagtattttcatggtggccattagagcacacatgctttagatacttgcatcgtcgtttcacccacgggacacgctgcttggactcggcacgaggaagactttcgatataagggatccctaggccaaggatccatcgtcgccatcttactcatccaagccaattaccaagttgaaccatcgactttgataccaattgttatgcaattgaggggtaaacaccggagagatttacaccaatgagtcatgaacaaccatgtaagtgaacttgataccacactttaccccaaaacttttaaggttttgagttataagttttatcatcacttatatggtgttcaacctataaagcgtatgaaggtttgtggtggatgcaaagaataaagaaggaggggagaaatgagaaagatagaacgagaaagagaaaaaaaaataaagaaaaaatttgagccatgaattaaaaaaaaattataatggtgattttttccataatatgttagtatgtctggaatctgatttctcacttgcaaatgacaaattagttcattaacaatttaatgataaattgattgagtcagatctcatgagacatttattttcatgacaattaaatttcaagttgccatgtaagcatcaacattaacacataatggaataaactaacaataggattgatatgtaattatttttgtatatttaaggactaatttttatttttattctatgaagacccatatgtcactcgattatatttttagggacaaaattagatgtttatccaaaaaaatattacaactttataatatctttatctttataatattacaatattgctcaagacaaatattatagatactatatgtaaataagaataattaataattaaaatgttttcaaatgttgacaattctaataatgtagaatgtttgttcacacttattataatagataaacaattataagtattatatatatatattagattaattaatcattattatttagagaaataataaatgctttatcacttaatagaatttatacaatcataaataaatggataaatattaatattatagcaatatacttctttgatatgatgcacataattcaaatttgattcaccatcaactctaatatataagaaaaaataaataaatttcctaattatattattcacaatgtagatatgttatcttgaaggaatatttagtagataaaaagtttttactttcttaagaatcttaaaagaaaattatgactcttgagaatatattttagttcacttttttgataaaaaacattctaaaaaaggggttagacatttaactttttcgagtgaagaaaaaaaaattaattatcaaattttatattagtatcaaattctcaagaaacacgctaaaacgaatcaaacatatttatacatatttcaaagaatcgactttttcagaaattatgtttctttggtatcaaaaaactttttttcataccaaacgtaccatgatggtaattaaatctgtaaagctgtttttttttttttttttgttttaattcatggtttttcagattgcacaccaaaaagcaaaaatattaaatatcaaacatgctcaatttgttcctctcctgaaaaaggcaacgatgtcgtttcatagcacgcgtggcaagtacgtatgacttatgagtcgtcgttttctttgcggccgttacatggagtgggtatcttgttgtgttctatattcattcaccgtcaaatcggagaatcgaaatcggaggaatcagaatcaaagccctgaatggcgccaccgcgaccatctcagggtcaggggatgaataatgcaaggattcgcttcttttccattctcctcgctctccaatacggagctcaacctttgatctcccaacgcttcatcaggttttcatttttcaaccttcacggtttcagttctatacttttcttctcgattcacgatacggttgtaaattttaattgtagttaccgttggttactgcccaaccattttttatatttttttagagtaaaataaaaagtcctggacctgggatttatcattttttttattaagcatagaaaatattcgctattttaattatcgttagcaggattaattattttccgtttgatctatgctgtgattgttgcagtaagattggttagtagtattacttggtggtttaggatcacgagattgacataattgaacaagctacgctaaatattttaactatatcaaagatggcaatggtggcactgtggatggtatgcaatcccacaagaaaaaaaaattaaaacaaaggaaaagaacaagagtctctaagcagtagaagaaatccacttgatcaaatataaagtataaaggaataagtcatttgtattgattcttagacatatggaatttgaaggcctacttaggaatggtgcatggctttgtcaggaagcagggattctagaaattcatttagatttagctgcattattttcaccttgttttgcatgtcacacacacacacacacaattcaagatacacatgctcggaaagtgggaattcagatcaagatcagtttaagtgactggtgtccttgttggataaaatgcagctacaatccttgatatgaaaataaatggttgagattgtgatgaaataaatacacatatatagcattatgaagttgttaaaattcttaactgctgttttctacgtaacggctataactgcacttatcctctaaagtgcactttcctcacattagaggagctaaatccatccttattcattattttagtttctgataatgttacaaatatctgtaggattatccatgcagttattcttactctaaatagcacaacctgtacatggtgatgttttgagcatagccctttcctattttggtcatatgcatttagcttagaattgattttatgagaactaagttgactgttttgccatctatttgttaagatttcgatttacttctttgtccttgtgcatggttccagtaccagcaagtgttccttcagttttccaaagtagagattcaggaaaaaagtgtgtgtgtatataacatgcaaaattgacaattaacactaaaacatatactataacacaagcacttcaatttaaaatgtaagcatttatgcatagttattcttattgaaggacaaaatcaaaattaaaaaggcacaaatgtttcaaaagtcagcattattgattaactcattatccactatcttgtatcctattcttattacatcccatttcatccatattggcacaaaaatttgaaatgaaaaaagaaattgcatatccaggctgacatatctgactgtgtatccaacatggatatgatgttaactccaatattgtattgtatgataatcattatgaaacatttgcttcctcttttaactaaggttaaagtaaatatgttcatgtgattagtggattttaaattgtaacatcttttaagtctttcatttccttgtgcattaaaccataaattgatataataattgtaaatgaccatgtgaagcgtgtcttataatctatttccccctcttcctgcagacgtgaagttattgtgacttcatctgttttgacatgtgaacttgcaaaggtaaatcttgaactgttttggcatgcctaattataaaacctgtactatagtgtacttttcttattctttattgggatctttcatctatctctgtaatctgccttttaggttatttgtgcagtgtttttcatggctaaagatggtagtctgaggaaagtgtataaagagtggactttggttggtgcgttgactgcatcaggacttcctgcagctatatatgcattgcaaaatagtttgctgcaaatttctttcaagaatcttgattcactcacattctcaatgctgaatcagacaaaaatatttttcactgcattctttacatatttcatattgaggtatgttgctacaatgacaacaattagtatttctgctatttttgacaaacccattcgttaacgtttgtgaaagaggatatgccaaattgttatctatgttaagcaaatggtttcactcaagagctgttgtttctgtttaaaaaaactcaaaactaaaagtaatctattctgaggagcaggaattgtcccagtttcttgtgattttggctggccaagttataattttggggttgagtaggttgttttctttgaacctacttatattcttgcagtttgtgatttgggggtaggtcattgacatgcacttggtgttttccggaatcttcaaactatattttgttgggtttggtgtagttcactcactgtttttacttttaggtgttttggataatgttgatttcttgttctgttgtttgggtgcttctgcaacagtttcagagggtgattattgggagactcttctgagaggcttttcttctcttcttctcttactggatagatttctgattaattctttatgctttgtttgggttcagctttttttcttttctttcctgtgtttggatggttcaacgtcttttattttgctgggtttctttttgttcttggtggtagctttggttaaaatggattgtgtttatatgtgttttgttctgctactttaacaaactaaagcttagtgttataaggctagcttgagggggagtgataataaattattgttataaggttattagtcttatactagtactaatagtacttgacctaattattagcataaataggaatattgggttaggggtttgtaacagattacatccataatcatattttcataaactgttagccaccagtattggttttccttctctaacctataatgctaacactgtacactaggcatctgataatggtttgtgcaggcaaaaacaatcgattgagcaaattggagccttgttcttgttaatagttgcggcagttcttttaagtgttggcgaaggctctagcaaaggttctgctagtgccaatgctgatcaaattttattctatggaattattcctgtattagttgcttcagtgctctctggactggcttcatccttgtgtcagtgggcctcacaggttaccagaactttcaattttctcttcaatattataattccttgattgattgatattattatttatctattgattccttctatcacaggttaagaaacactcatcatacttgatgactatagaaatgtctattgttggaagtctatgtttgcttgccagtactttgaaatccccagatggagaagctatgagacaacatgggcttttctatggttggactcctcttactttggtaatgttcttactgctgtttgacttgtgtgatacaattcttagaactgttagatatgttgtcatgcagccaacacatagatatataaaagggtaaactatatttttagtccctaaactttttagaatttatatttttaatccctgaactttttgttatgttttttgtccttggactttctttcaatccttactattagttcctaaactttttttttctgccttacttttaatccttttaggctttgtttgggagagggattttggaggggaagggagggaagggaaaggtttatgtagagacatctccttgtttgggagttttaatatttgagggaaaagatttgaggatttttaaaactcctctgaaatcttccaaagcctaaaaattgttgtcccccctatttggaggtttttagaaggaaaagtaactaaaattactattttaccccaatcaatgttaataaaattattatcctaccctagtcagtgtaagatatagagtgtattaatttttgaaataaggacaaaattgtaaaaatatcttattaactctctattttcctctcttaatatatttttaactctcaaacaaggagtaaggaacttccctcattttcctctctttccttcccctcccttccccttgaatgtctttccttcccttccactcctaactcccaaacaaagccttaagggactaaaagtaaggaggaggaaaaagttaaggaacttaaagtaaagatgataaaaaagttgaaggactaaaaacagataaaaaaagttcggggactataaacaaaaattataaaaagtttaaggactaaaaagatagtaaactctataaaattgaaaggttcaaattttgatattctgacctctgtgtcaagcacaagtaaatttggacctatactttttcatgtcaggaatcaggattgttaacatttatttatttattttgttgggaatgggggtttgattaattccgtacattctagttgatgctaaatttgtaattaactgcaatagagagttgtgagtataattacttgcaaattcataatatgaactttttagtgccttgttctggccgtttttatccatatgcaagagtgattttgccgttaatgaatagatattgatgtacattaaattttaatttcaaatcttttttttttttttattcaattcagatcccagtaattttcaatgcccttggtggaattcttgttggtttagttacaagccatgctggtggtgttcgaaaggtaagtttaactttgtgaaccattactgaattacttttagaatgccctttcctcagatgacagataaaatggtgaatggtgatcagatgttagtctgtccttattgctagtttacaatttccctacctcacgtaataatctggaggttaatgggatgaaacatattacatgcattgttttttcatggtttttgggggatttaatctaaattctaacatgcattattaatgttgattaagagaaaattattattgcaccttatcagtgctcagtagagacagtaactgcacaaacttttggtacttttgagtaactttggagttgctggacatgatgaaaattctttcatagggaatattaggattaaaaattcttcacattttctgttttgtacgaatgtacttacagtgtcattcattctatgtgtttgcaggggtttgtcaatgtttctgctttactcattacagcattgctacagtttattttcgatggaaaaccaccttcattgtattgccttgtggctcttccactagtggtcactagcatttcaatataccagaaatacccctaccaggttaagaagaaggagtcatagaatctgaccatggggaatttatttcattcgttccccctgaaactactttgttttcttatccaaaatatattagcatattgtaaatgatagaacatagaaggcaagcattcttttcgatgtcttctggatctcaatagaattaggttgttatacagagcttcttctttttattttttttttaatactctggaatctttaaatgatcaattgttgtgtggattacaggttttcaatttgaaatttatatcgtagaagacaatgatcaccaatgaaattcactcagaaaaatatttatttattgtcgtttaatcctttatctctgatgaactgaagcattatgataatttttttcttttactgaataggaccatatgttgttattcaagaacatgagaaaggccataactgtaacatcattggatacacacgacatcaattcaattctcatcacattaaagagagacactgcattccgattactaatgactaatgagctgaaaaatagcttttgcatctttagggacctcacgttttgaataacttgacatcaaaacattgcaaacaaactgaaacatgtcttccatatcccaccttcagggtcaatcactacaaaaattaaaaaaggaatgaaaagaaagaaaattaatacacatctatttattaccaataaaaatttataaaaaataaaagtcatttttatctaatttctaaaatcaattataaaaagatactactaaattatatgtaagtgaataatattttttggtacaatatgtaagtgaataatataagtgatgttttttttcccacttatttcaactttctatataaattttgtagaattaaataattttcattaattaacaaaattattatgagggcttttcttatctttgtattcattaatgttagtcttttttatggaaatattttttttaaaaataataattacaaaatataatctatttatttttttcattatgaacatctcttattaaaattatgcatatatctagttatatacaaaatatgaatgtatttataaagatttttttttaaaacaaatgaatttaaaatgatatatatagttttttcatatttatatatatatatatatccttacttatatttagataaaaactaaaaaaactgaaaaaatacattgaaaaatacaataatataaaaaattgtaaagtctaaatttaatatatattcatggcacgtgttatttcactcgtaatttttttaaaagtcatgttaactttgatttttaattggttgatagtataaatctttttatattaacagcatttctttgtactaattttactctttccatcatttatgaattatcctaaagatagtaaattagctttcaaccaaaaacagtaatagaaaaagttggtaaacacatagcaaacctataaattagaaattatcctataattgacttttaaatgtttgatgagagtgcggatttaatttttaaaaaatagaaatatattatccaaataaagtaagcttataaaaatagttttttgcggtaatacaaatatttttattctttaatttcttctctatactctatacaaatttaagaaaaacaaaacaaaacaaagagagagacaaaaacaggtggcggcattgataggtacagggcagaggaagagggttttggtcgttggtagggtttaaggaagcgcggacggagaggagaaaagttgtcttcaaagaagtgttcactgttcaaatcaaaatcaatggcacacatcacaaaccttcccatgatgccactgatgcccagcacttcctcaaacgtcatcaaagaaatcgcgtttaagacgtctccttcagcttccaaagtcgaaatcaagctcttcatagaaaccttctacggcttggaggtcgaaaaggtgcgaactttgaacatgaagggcaagaagaagcgttacgcgggatcgttggtcgcaaaacccgattacaagaaggcttacgtcaccctcaagaaaccactttcgttctctcaggacccttagcactttcgttccaccgtagaagacaagaagaaagagaagatgttgaccactcactgctaggtgtgtagttttggggggttgagtattctcttgtcaattgttatgttcactcttttttttttttttggttccatttgggcataaaaaacattggatgttaaagtggtttattggagtttatcgattgatggcgattgtgctgtataaggattaaaaaagggtctgtaattttggctgcaatatcaaggtttgcaatgaaatcacaacagtgaccacaattcaaaatcaaatgatgattttttttttttgaacttttgatatattgggactaacttgatggtgaaacacacacaacagaatcaaataaaaccatgctcagtttgagaaagaaatagttctactgtttggaaatgctcatagggaatgatattttagctaaattgactgttgacataaatttatctcagtagttctgcagcactctgtgcttgttctaggaagtgagaccatttgctcttcgattataaactcttctctatgcattgtgtcaagtctcaaccctttatattcgaaatgataaattaacttatttatcttaaaaaattaatttgaattaatataattcattttacccatgtatgaatagtaataataatgtaaaacccagaatttgagtttggaagtttgtaggctaggtgcagttttgttatttagtgcttaccataaacataaaaatcttgtcactataaacagtatgactatgattccaagaatctttatcttgaaatgaccaagtaattcgctgatagaaggaacatgttaatcgccaaaccagcataagcaaacatcctaaagtaaaatttgattgtgaattctataaattagcagcatatttcctttaatttgaactcagatattgtttcctctcaagttgcatttttctgcaatgctagagcattttgttttcccctcatgtgcatcttttatgcttcattgctaaacttataagttattagttgatgtcctatcaactgtacgttcttaggggccatgagcttgtatcagtaatctagtcacattttcgttttcttttcaggtatgtatacagtatacttgtattgctttatttcagagtctttgtctctataggaagctacagcctactagaaacttttctctttgaagtcaacaatatcttaagatacaaaatttagtctatatgcttcatataaagaatggctagctaggtgtttttactacaggactttttatgttgaaacttgaaaaataaaatacttttaagacatggagagccttcttctagggtttagtctacgtagaatggtgtttggtgacttgggtgcatcctgtccgtctccaatttcaactcctgctggttttgtatgtaaggagttcttaatcttccgccaatttaaactccagcctgatgaattctttggcttgttgcttaccttgcttaccttttcatactcctgttgtaattcacaatagtctttctgcagttctaccatttgggactttacattctcaagttcttctttgagtgccttaatgtccatagttgcagatgtatggtttccttcttgttcagattggattccaatttgtgctggctctttctcatgcattgctgtcctcatctttacttgctctgaaaatagaacctgcatgttgtgtatactttcattcaggatttcagttggcagcttttatgccaaatcatcactctagtcgttaactctaaaaatgctatgtaattttaactataatttcttgtgctacctcactatcttacatggggtgtatattatgtgaaccagttcctcgacactgttctgtagaattcaattttcatattaaaagtggacttggaaaatacttgattctttctgttgaatctcctcacatgatgattgtcatatctcaacatttctggtctttaaacttctctcttctaaccaattatgttttactgcaattttaagagaatttttttttcaatcactataggttagtaaaacacaatctttgtcataaaaaaaaaatcctttgtgtatagaggaaataatttgtagagtttactgtcaactattttccattgggataggattgtttttctggcctctcctttagcatgtggcttcagggagggattgatttggggagtatttctgttttgttttcatttttctgcttatgaggaggattattattatcctacttatgttaaaaaatttccattcaactttagattctgttagtatttaaggttttcctattgaatgtaaaagtaaaaagtttgtgaagttacaattattaatagaataaattacactcacacctcctgtgtttttctcaaattgcacccaatatccctccctttttatacattacttttactccattttgttaacgtccttaactaacgtcaattgaaatatctgagtagacgaaattgtccgttatagtaaattacactcgcatcccttgtgtttttctcatattgcacccgatatccttccttttatacattacttttacctgacggcaccaatgtccagggaaccagatgcagcggtgatagtggccgaaattacaacaggggacgtgaaggtggaggtagatatgacggtagcagcggcgactacggtggtgacggttgctatggtggaggaggtgactacagtagtggttgttgctccggcgggagtgggtgcgcgcctggacgtcgtgttggtgggcgagaacgacgatgagaaggaagagatgatgctgctgtgggagaaggaggtggtggtggactggtggtggtaagtgaagatgggttgttgaagaagaagagagtttgtaaaactcaagatgtgattttgaggaagataagagtattttagacataaattttcattaaaagtcatgtgactaacatgtatctactttctgttaaattattaaacggtatttaggaaaaaggaggtctgggtgtaatgtgagttaaacaattaaggattttttgtaaggtgggtgagagtgtaatttactcttattaatataatgaataatataatttatcctaaattggttctaatatttaacatgactactgtgtttgtagaacagatgctgctaaatctgaattgtgaattctgctatataaccatcacatcaagttttgcttttttgttggtggaatccgaaattctcaaaactgttgttcatggtcatttgttaatttatcatgtatgaagcttaaaaagtttgattccagagattgcaaactttacctggacaacagctcttaggggcaatctctcattttgtgcagcatgcaggcatgcatcaagtgagagtttttcacagttcatgattttgcacagtcttttacggtcatgctcggtcagtgaagcatgggtctggagagatgtcaatatcagaatgtcaaaactttgttttatttgcctttagttaaaacgggaaactgaatcacaagaaaataagactttaaatgatgaccttgaggtaggtgtcaatggctctatataggccatcatcatatgatcgagtattttctggtagcaattcagcaaaaacttggaacttggttattgaaagatttggatctcttgcaatttcagctaagtaattgtccaagagtctactaatattgaatttcctagtcttctgttgctgttgaatctgctgttgttcgtgcatcaagaagtattccacaattcgttgcactacatctacgtctagcatggtgcattcttcagatgaattagtcatgctactaatgagggaaaagaatagaaaaagacaaaagatagatattagtgtcattagtcgttttcataactcttgggttcttttaaaaaaaaatggtttagagggctgtggagttaaatttgacctttggcattaatgccaattccaatgtgtgaaaaaaaaggagaattgtcacatactcacatgaccgtttttccttgatctccattttgatatcttggaattagaagatcactcacctcagcatcttccaacaccaaactcactctcttttcaaggtctgttgtgagagctggtgatactgaatacatcatggccaactttaacatctgcaacatgaacttacatgagactgcatcttgctgaggaggaataatgcttattaggctttcaataattgtcttttgctccttgctgtgtccactgctttctttcttcttcccactaaaaatactgaactgtaggttacacttttcatgcccatatcctctaaacccttctaactccacctccattcctggcagccatctcttggcatattgcatgatacatttaccaatgatctctggtttggttccctttgaacttattgcagaaatgatccgcataaaatgatcaatgcggaaggctgccacatcattgaaccaccagctttcttgattaggtgtcgcatcctcgcttgtgagctcatctttagaagctttccatgcaatggaatcacagcatcttcttacaatttggaggttttcagcccacggagataggttttcacaagatttcagaacagtgatagtgtctttccacgaagaaagcacaacaaaggtgaggaaagcttcactcttagaaatgagatttccatcttctagttcttcagtcatctctaggaactctgatgcacatcttagtgcagctatgttatctgggctgaagtctatagggaggccataacagaactttagaattgtttcaaatgtttcagatccacctgggaagttttcaagcttgagcacattgccagaatttgagatcaaaggctgaatttccaattgtcctatgtaaccgcactttgatatcaaggggtactgttgttacaaaaaaaaaagtgaccaacgtacgtaatgatgttacagcaaaagcgctatcgtacaaaatgattaagacatgagttgctggtctgttcggtttcttttatttttattacaaaaattaaacgttattttctttatatttcttgtttttagattttgtttaaggaaatagtagaagcaatgctttgtcattttcactatttcccccatgaaatcttaaaaataatgctacatttttttttataattatcagtgaaaacatataaattgaaaatgatattaaaaaaaatgaaataccccgttagtttccccatgttttctgctgttctgttttcaggactcttaaaccttctctaaagttttgtgctttctatctcgagtaattttttttaccctatccaaaaaggtaaaaagtaagtacacacaccacaaagaaaaggaatgtgcggttcttatgctccctgtgataaaactatgttctacaccagtcagtgtcactcattgagataagagtatggtaaaaagacagtgttatgacttatgatgttatcgatttcctgtgctctatatataccccgctgatgattgtttggaaatatgttaataaaccaattcatcgggtgattttctacatttacaaggctttaaatatgtcaaaagagtttgtctataccttgtgaacattataagtggtttcctggacttgaattgaaaagtctgttgggatttgaggagcaatgaacctgcacaggaccaaatcagaaaagaaacaaaaaagaagaaaaagaaaacacatacacataagtggtaggtagaatttagttaaaaatggaaaccaggaagagaaaataagaggggtggggggagtaccattaccatacttggttagacatgcaaattcaaattcatttagacatgtagatattgttattattactgaatttttagctgcctaatctataaaaagatcctattctagaagtaccatgaatgttctcctttgaagctatcagctattgcgatgaatttgttgggaactacgatgcttttgtctgaaaccttctcacttccattggagtcttgttgtgcttgccctacttgaagggacttcatggtgatagtttagctaattacagtaaacttgggatagagtagacactccattttgatgactaaatgatgcaaagggacaatggtataagacccgcgatgttgtctaactttaatgctagaaattgattctgtggtcagtgtagggctgtagttaagacggttggtgacttgtttctttccttattataggttatcaactttaataacattctgttgttgtgtagaaataataagcgtgtgaatgtttgaggccaaatatgcatatatacggtgcatggttttgttaacgtcgctttattttatttgaattttctctttaataaaaaaatctatttcttgtattataaatttgggtacccggagtcttattataatttttttattaggtttacatttcattgtatttttactcccaccatgaccatgtataaagtagattttaattttaagatcaaatattaattttaaaagtattaaaaatagtttatattattgcagaaaaaaaaattataggacatctatctcctttcttctacccccacccttccaatcatttttacctattttatttgggggtcaaaatcattgtcaaatctatctttgattattaagaaggatctgggccattatttgtcccccttcaaccttacatagtgtgaccgatttggcgacttgtggcttataggcattgtacatctatttggcatttatggcaactcgaaaattctttcacatgatttttttttttttggaaaatataacgtacataaaatcgtaatttagtgatgagtataaaattctttacatagtgcacagttgcgaaagtatgttttctgaatcaaaagccatttcgttgaaatgagaaacacaaacatatgagatattcaagcttctggattagagaaaatcagttattacaaaaatagagaggcttatctataaaaaaaaggctacagaatttcatctattttgaaatctgtagatttaaattcgttaataatttattctcacctcctggaaactcgatctctgatcatttataaatacttgcttgtaaagggctttactagctagcaaacaggagggataagaaattaaattaagttgcaccagtgtgttgtcaaactacaatttagttgtccaaaaaccaacgactagtccctcaaagattcatttaaggattgaacttatttttatttatatatgagttagagatcaaattcataatcatatatttaagaaaaaatgttataaactaacaatgtcatatcatattggtacctaaaggttctaatttgcacaattaaaatatggattatcaaagtcatataattacaatactttgagaatcaaaagtgcaattcaatccaagttttattattaatatataatttttcgaagaacttatattttacaaaaaactataaaacactaaactgagttgagatgactcgaagtataatttcaattcttctcaaaatgcatcaagtctaattgtaaaacttgaacctgtataatcagtttcggattagaccagattaatgagatgactgggtcatgttggatatcgtttatgcatgtatagtagaacattattttaaatagtttacacattttcaaaacaactaaaggttgtgttccatctagaccagttactaaaattttcattagcctttaaaaaaaattagacaatatgcaattatataaatattccaaaaaaataaaattaaaccaacgggacccaatcatttcagttatcgaaactcgaaactgaattgagtatagattttatgatttgaaattcagtgacttgttatcaaatcatcaattaagctggtcttcctttatactcacttttaacgtcatgtcttctaagtcgattgtaagaaaatcgacgtgataggtaggtcagtgacaattttataaataattcaattgatttggcatttcgacgtcggttttttgttgaccgtcattgtataagcctctacaaaatcggtttctataataaccgactttgaaagattaacatatttttttataaaaaaaaattaacttgtgtatccattcaacgtcgatttccacgtacgaccgttgtcattttcacgattttcaaagttggttattatagtaaccgactttgtagaggcttctcccttctcagcttctccctcagccattctcgctcagcgccaatttgaaactcacccagattttcaatttgaaattcaaagtcggttatttaaaacaatcaacttagaaaactaagatacaaagtcagttttttcaaataaccgactttgtatctcagctttctaagtcgattttttgaaataactgacttagaaaagatgatttttttaaaaaaaataaaaaataaaaaattttcaaagtcggtccttaaaaaatcgacgttgttcgcttacatatttaaagtcgtcggagacaaggttggttcggaaaccgactttgtatgatccaaataactgaccttgaatgcctatgctgtagtagtgtacacacacaatatgattcaattaagatgcctttggttcagaggataaaattataaagaataaaaatataagataaatttttgaattgaagtaatatatatatatatatatatatatatataaatgtgatgttgatacatgaataatatgtataattagtatcaattaagattatacaaaatatattctacctttaaaaaattaagaaataaatgaacagatatttgaatattaatttagtctttatttcctttttatatctttctctagtttttggttaatttctttagctctagttttagctttgtaacgtttgctgcttttcattgagggatcattagcactcaagaaaaagtgaccaaattgctttcctcaaggttcaatcacagtatcacactattctcttcttcactcattcacgtttcctatttttaaaagttttaccactttaaaactgcacaataacttttcaggttttatatttctttgttcaatagtgtaaaatctctcgaaattttctgtgggtggaagaataaaagaatccattttcaacattccattctttacatttttgttttttccttttcttttatgctttgaacatagtgcttctcttgtcttccttttatcgtcgttgcctgtcttatatatgttccattgatcacttgggagtattgtttcatgacaaaaactttcgtccaatgagaaattaactcattatccaaaagggtgtgcttcaatgcttcattttcttcccctgaaaacccacaagtattccactttctcgctttatatctcaaaagttctcatgaaaaattattctatggtccagaaccacatttccatgatcccaaccaattttcatgtaaccaaattttattagctatttcttgtgtaaattgaattgaaaaccttggttaagtgttaggtagaagttgatcaagaccatagaccacaataattcgttgtgttctcattccattcattcacggttttgttggttctgcatgcagaattttgcaaagatgaatgatttgatgaaaatcgttccaaagctacgctgaactgaagtaacaggctgagaaggacgatcttgaagactctcgtgacattgaagcagggaaactcgacaaccccacggattaccataacctctcacagttcttccaagaagttgaagcaatcaaggttgaaatggaagagatcgccaacctcttattcgaccttttgcaactgcatgaagagacaaagtgcactcacagtgcaaaagtcctacgtggcctaagagaccgcatggtgtctgacatggttgccttggtttgcaaggcaaggatcatcaatttaaggctcgaggtttttgaccaatccaacataaccaatcgcactttatcagaatcctacaaagaaggaacccaaattgatatgaccagaatgtctatcataaatggttttgttggcaaggatcgtgtggccagtgttggtaactaggccaaccaaatgaagaggaagaacatatatacaccaccacataatggttctgttgggttcttgttgtggtgatgctgttgattgtgtttctttactggtggagaaatttggagggggtggtttagagtttggaggttgtgaagccactttcatttcccctttaacgtttcaatggttattggattgttgggaacagtttaattgattcaaatttattcacgagaactagaattcactgatgaatataagtgttgattgtgacttttgcctaatggttatgggaacagtttaattgattcaaatttgtcttagttaacattatttgactatttttaatcttatgatgtgattttgacatgactgtatctcacattttttagttctttgaactccgaagctttctttgttggattggggtcattctataatttaaattttgtgtaacaaaaaataaaatgtttatataaaatattagtattataaaaataatgctcttctatctaaacatgagggttttttatgagaaagaaaggtatgtactaatattacactattattcaattaaaaattataatttatgataagttttataaaattattttaaaattatattaataatgattttataattaaagaataatacaaaattattttatattatcaatttatcatcattaaactcttttcaattgaatcaacttttgttaaatagagtattctcgaatacaattagactaattcgtcttggttttggagggaggatacatatatgatatatatgacaattaattgacataacagaggagtgggagaaaattaaaataaataggtgcatggtacaaattagaaagttggcatgacgcggtatcgtggtatcccgtatatataaaacgcattgcactcgacattacgttaaatttggtcatcctctctttctgtctctctctctctctctctcttttcttctgaattttgttgcgagaagagaatttgggagattcagatctgcgttgggttgggtgtctgtgagaggagaaaaaagtgagaaatggcgacggtgtcccctctcgccaaatacaagctcgttttcttgggcgatcaatccgttggcaaaaccagcatcatcacccgcttcatgtacgacaaattcgacaccacctaccaggtcacattcattctcaatctcaatctcattttcaatttcgttttcatttgccgttggtctctctatttacgacatgcgttttatttatgcatgtgctttccctcacgtgaatcaatctgtgatgacggcatgatatatatatatatatatatatatatatatcattttaattggtgactttatttgggaaatgagttccacgataagttttgatgtaatttgaatttgttaagacgttttgatcaacgataattaggacttgggaggatcaagaggagtagaaaaatgtgctatgtcatatacttttgctctgaattttgtgtctatcggataaaaaaattgagggatgagttttttcttgtgttgaaacttatccctcaattttttaggggaatgctaaagtggtagctagaaataaaaccgcttgtttgaaaactctttgtgacattatcaattatgggatcagcattcatggtttgagttggtgaaatgctagaatgggaagaattttagtcattgagaagggcttcactcaagatccacattgtgttggtttttaagaggcttgttttattagatttctgagtgcttgtaatgcttcttgtttagggaaatgattggtatgtatacactccatgggtgtatacacctagtaaaagtttggaaattgaagagagaaaagaaatatgtgacctgaaagaaagagagaaatagagagaaaaatgaagcggaagcactttgtaggtgtgtgtatgaaggtctatgaatatcattattgtcttgtttatattagccatcatataaaattacttaaaatggacatggaatcttgttttcttggtttatttttttattccatcaacgattcacaatttttattcttgctgctgctagactgcttacaaaaaaaaatttatgtaaatttcaggcaactattggtattgactttttgtcaaaaacaatgtaccttgaagatagaactgttcgcctgcagctttggtaggatgactcctcttcaaatcatatatacaagctcagtctatttatatttatttatttttcaacaattatattagagtgcacattgctggtacgccttataggcactctttatccttacaatttctgagcttggtatatgttaacttcacagggatactgcagggcaagaaagatttagaagtctcattccaagctacataagagattcttctgttgcagttatagtatatgatgttgctagtgagttttataagttcttttatataccactttcattatctaattaacatgatttatctggatctttatcaattttctcatgaccaaattatttgaccatgtaactcaaaaaagggttttgtagtgcatgaatgtgttctttaatacttatgtgtgagtgactgttctgatcttattttctaagacacattatgttattacattcatctccctccctatttgtgtgtgtgtgcttgcttgcattcgtgcctgttctcttatgttttatttttatcttaactgtttttgcatgtgtatttggaagtgctttagttctcatttttcacaactaatcaaaattaactgaaatttataattatttaacctgggtaagctgttcttatgcagacaggcaatcatttctgaacactaacaagtgggttgaggaggttcgtacagaacgtggcagtgatgttatcattgtgttggttggaaacaaaactgatcttgtagataagaggtaagtactaatttggtttatatgattgtttaatatacagaaaagttaaattcttaactgttaagcggatgttttagtgttttttattatcataatggggtttccatattatgttttgatccttctattttagtgtttacatgttctgtttcatccgaaaactgtaaaattctggtagactaaatatagttttaagatggcttaaaattcatctcaaggcattagctttgcatgcattagtagttacaaagagcagaaattcgtttaccaagcggcttgccctttgtgtttgttattcgcatattgtgattttactctgtgaagcttttcttacaaggccattttgatacttaaacaggcaagtttctatagaggaaggagatgcaaagtcccgtgagttcggaatcatgttcatagaaaccagtgcaaaagcaggcttcaatatcaaggtgaaaattagtgaattctgcattcatctcaatatttttagtttattagagcaatctcctgaactatgatgcacgtgaccatgatatatcatattttcaaattgatgatctactattgtggtttctcaacttcatcttccttcacatgttggctcttgtgtacttaatgctttctgtcaatccaaattgcagcctttgtttcgtaagattgctgctgccttaccagggatggaaactctttcttctacaaagcaggaagacatggtcgatgtaaatttaaaacccacggtgaattcatcccagacagagcaacaaggaggaggttgctcatgctagagaagactattctcgaaacagacaataatttgttcactgataaaattctgggattggctgcttaaatggaatgatggagctgaaggaaaagtgctttcgtatccatgacccttcagtttttgggtgagggggacaaattgcagtaatggttttgatgtacgacacaaatattgatagttatttcttttatttgtaatacaattagtcccttgatgtaagaatacaggtaataaacaagctctacaaattgttcctcttaggtttatgttataccaccctccatctagcccttttctcttggtggcacccatcgtcctatccaaagcagaattgcctggtttttagggatcttgtttgactcaaaggcccgaccaacttgactactgaccgaaccattctataaaatatggtctgtccagcattgaaaattgatttttatttaacctaaactaactcaatctcgatgtataaggatcttaggttttgattttctcaacttgattggacctgagctgatgatataatcactcataaaacttaactttttaagtatattaatataaaatattattgtatgttttaagaaattaatataggatcatgttattttggtaaaattcctttttaaaaaaataagattattcttaaaattaacaacttttttctaaaatgcttaaattaacaactagaaactaatctatttgagatgtaaagattattaattgagtggagcttttaatagtacaacacttttctttaatgacaagtctactattattatgtttggatggattaaaagaaaggtttgttgatttaaaagaaaaactaaaacagtatcctgaaaaagtgatcctaaaccaagaaaaaggcttgataaagaaattgaaaaaatagtaatttgttttccgtttcggctagtgagatgaaatttaaggtcacttatagtatgtttagtgataaattcatagtcaacatagatccatgttttaactttaattattgggagttggaagatatatgtagacatcatgtgttgacaacaatatgcatgaggggataatccaaaggaatatatgttcatcagtattatattattatttggtggacacatcagccttgaagtctttgtaagtgtcactgcctttttaattgcattcctttatattctatggcgattgcgattagagtaacaactcacctaaagaaccacccaattttagatgtggaccaattttctcataactatatcagatatcatgatttttcattaatcataagttatgtcttattggtgaatacttgtggatctcattataaaaataaaataaaatggaacagtataaaaggaatgaaaaacgttcataaaagttgtcaaaatatacgtttatgcttagataaacgacttaggcatttccaacacttgtttggtctatagttagattgttcgaaagatttgtctttttacgaacaaacgttaatttgttagttagaatgttaatttagttatattattcgaaagattaaaaacaaaaattttcaacaagaggcatttgtctttttagatacaaaagattaatgtgtttttgtatatataataagataggcaaagaggtacgggtgtcatttaaatataactaaaagttgtttaccaccaaaataacttgttttaaaatatgtaccccaaaaaaacttgtttaaaattgaattgagatttatattacatatcttcttaattaaatattttgtgccttggttacgtgaaggggcactatacccaataaaaaaagaaagctacgtgacaaccgtatgaaggaaagagacaccaacaaactatattctgaatgagagcaccacgagtcacgaccaggaggtggctattccagcaggtgaaagcctaattatgtgcgtgtcgtgagaaagataagccaagtatttcacaactaaaaaaaaaaaacatattgaaaaatgccaagatgtcaaacgccttggataagaatacgacaatacttttccagaatagaaactaaaattatatatgtttgtttgatcgaacatgttaaaactttattttagactttagacaacagaaaatcgtatttttttccaattaataaacagaaaacatataatacgtcgtgtgttttgtttcaggtttcgttttcttcgatgtgaataatacatgccttatatatatatatatatatatatatatatatatattacttttctcggttctttttatccattaataaagttcatttttgtttatttatttagatattttttaattataccattatcaatatctagctaattcttaaatacttttacactcatcataaatgagaaagaaataatactcttaagcagctacaaataattttaacatcaaagaaaattactaatttatatatatctttgaccaacagatcaggctattcaatgcgcacgaggaagttcaaactaaatgttaaacaagaacactgaaaataacaagacagatgagtcggagtgccgcgtacacaacacaacccacaaagcccacaacaaacaaacagagtgggtttttgctacttttaggcccaccgcccaaaacacaagaatgtgacgctgtcactgtacgcgtgagagaaaccgacattgccacgctcgcaccatcaaaattatactaccatgctaggctattgagctctgataataaaggagagttgcaaaatcctattacccaaaatttaaagaagaaaaattatcactctaaaaaaaaaaaaaaaaaaaccatcaatgaagaatttttaaaaaaatcctgttgtgctctcaaatattccttcttcacgttgtttttgtcttgagtgagagccaccttgatccttttcaaacactcctactacatcgtaccaacgacgacaacgaaacctacaatgccccacttaatcacacaaccggaatcctcctccgattcgttcttccccggtggcctcttcctctacgctcacacacttccttcttccttcgcttccttcattccttcagacccggttacagtatcttgtttttgttggagacccaaaagaaggttgaatgtcgaagagagactttgtggcatagctggtggccccggtgccttcttgtcgttgagtttctccttaaacggaaccgctgcggatcagatatatcgcccagaatcgggtgaaattctggggcagcatcacaacaaggtgtgtgaagaagaagagaaagacaaggtggggctcaatggatcgggtgctatgaatatgaccaaacatctttgggctggtgctgttgctgccatggtttcaaggtcttcataattattccttttctttttacagaacaattactactcttactcttcacaatttttctacactcaagttccctcctctatcactgcacctattcttttcttagttggtatggcctttaaggtggttattgcacgagtcaataagattcgtgattgactgatagtcaataaacttagctgtgcactctcattgtaaaatctacattgtcaactaatctaaaatcattattggtatgacttatcaagtagttattataaaaattaataaacttactatacattacatttgtgactatgattcgacaacagtattcaagacttttacattgtcagtgtatgtaatatttattacttttacactgccaatttgctgaagtttatctttggacctattcttgttttttgttctcaagtttttttaccaaatttagaaggagaatgtggtataaatttgtcatgtggctttattctgtttggtgtatcaggacttttgttgcgcctctagagagacttaagctggagtacatagttcgtggtgagcagaagaatctttatgaacttattcaggcaattgcagcttctcaagggttgaaaggtttttggaaagggaattttgtgaatattcttcggacagcaccctttaaggctataaatttttatgcatatgatacgtataggaataagctgacaaggatgctggggaatgaagaatctactaattttgagagatttgttgcgggtgctgcggctgggattacagccaccttgctctgcttgcccatggacactgtgagtggaaattcaggatcatgttacctgcatctgttgtctctagtgtttacgttttgaaatgtgatgctctgaggggcaatacaataggataggacttgtgtaactttattgttaatgttcaagtatagataaactttctttggactgtgatgctctgagaagtatgatatgatgggtatgaattaatacaggtttgtctagtgtggtgtttgtagacagatttgatgtgatcgcataggtcctacttacccaaggagttttaatttgcaagaagctgtagcttgctacatttcaaattcaatgtcttttaactggtgtactttatgctagctagttggcaaaactaaagaggattgattgctgctcttcttatctacccatctttctaaagtgattctatgagttcactggatgcttagtcccactcttatctggtgaccaactatggttgtttagagctcttaacatttgcttaataaactttggaagttgtaagcatatctttggtcataattcctgcattcttacctttgatgaatatgttcctccatgatgcttcttgtttatggtgtaatcattgttaaataacaaaaacttaaacttgaatcatattaagggggaaaaaacatgctcaaggttgtatttgaataccagtgttcatggtctattgcacaaaaaagtccttgtcaagaatatcgtgtagcctactcaagcaaactatttgagtgtagtgcatttttttattgaattttgttgtacttgcattctaagattgatttctttcagatcaggacggtaatggtagcacctggtggtgaagcgttgggaggtgtgattggtgccttctgccacatgatcaaaacagagggcttcttttctctttacaagggtttagtaccttctattatcagcatggcaccttcaggtgctgtctactatggtatttatgatattttaaagtcagcatatctgcattcacctgaaggaatgaaaagaatccaacacatgaaagaagagggtgaagagctgaatgcattagaacaactggaattgggtcctgtcagaaccttattatatggtgctattgcgggttgttgttctgaagccgctacttacccctttgaagtcgtaaggagacagcttcaaatgcaagttcgggcaacaagattgaatgcactggcaacttgtgtcaagattgttgagcaaggaggtgtgcccgccctctatgttggattaattcctagtttattgcaggtattgcttctgttcttaataatatgctttgatcaataaaagctgttctttaaatttcagtaaacaggtaaaacagtggatgatagttgataaagtgaaacttatatttcataaaatttgagttttatgccccatagtcaatgattttttttttttttaaatcaatgcatttagcaaaattgcaaggcacatacaatggttggtttcgatgaagtttcttacttgaacataaaattcttatgaagatgtgtatttatgtcatgcacagaagctgctttacaaccatggctgtaaaatagttaccaacaatttttaagaaaataactgtttttctccttgctatggaggataacctatgaaattttcagagctatccatggcatccaaagtagtgcatatttgcaagggaggattgacgaattactaatttactatatatgtattaaccatgtgtagattggatgaattgttccaaagcatcccaaagtccatatgatggacttgtatgaaacttctttattctttttgtttcacgaagtttggagagttgcttttcatcttagtccatttaatatgatattttcaatttttgacttttcaggtgttgccgtcagctgctattagttattttgtttacgagttcatgaagatagttctcaaagtagaatcaacatagatgatttgcaggcaatactaacgccacatgtatatatttgatctttgaagatggggatttctcctcatttccttaatcatggccacccttatgcggggggagtcgagggtgtctcacacaaacaatttaatggtgtctttctgttgtattttactgactttatgtttacttaataataatccgaacaaaggaaaaggaatggggcataaaaaaaaattatgcttggctaattagatttgaattttccttcatgaagcaaatcctaaaaaccattataatagttttttttatctttctctttccgacatgatattgtgtcaaatcttgtacctaattggatatagaacctattattttataacaaactttttaaattaaaaaaattgacaaattgatttttaagttatgcaaataaaatatatttattattatgtgtgtttgaacaagtatcgataagatgtgtgtttgctttgctatttgaattgtttacctttaattttcacgccaaagggaagaaaaaaaaatgacacaaaagttataatatgtgtggatccattggcttcaaacgtatctaagaaaataattttgaattaaattgattttattaaaattgattttgaaatgatataagttatgtttcattataaaaaatatgattcatatttaaatattttattataaaaaatttaataataatacttagtatacaatatttttaagtaatgcaaaaattatttagaattattttaattcaaaattaattatggtcataaaattattccctaacaagtgtaaaagtttacataaaatcacaagaattagtatattaacgtgattttagaaaatccagcatgaatcaaaaaaacattaaatttagaatattcatctctaaacaatttcttttttggtacatatgtccacctctaaacaattgaccctatatttattttcttagcacatatcaaaatgacgtcatataatcccgggtttaggccaaaaaaatctgagaagctgcgacgaaaaaggaaggataagccaaatatcagtcaaactggaatcacacaatgctctttgacttggacaaccctttcaatgtctttttcttctctttgatagtacaacacaacacaacaatgctatcacagacaagttcccgcgttgaaaacttttctttgttcgttcattggtatttggtacatcctattcatctccctcttagcacccattacactctctctccgcgttaaaaaatactatctgacacacaacccatctctctttttagtttcgcttagatttagaaacacagacttttccaaagtgctcgtttacctcaaacctcagaaaaataaatatcgagttatacttgttttcttttgtcgggagacaaaaacattgatcagttcagcttctcacttccatggctgaggccagacactacgttcccccctctcaattgggtcagctttccttcactttaattcctctctatatttcatttctcatcatttgacattcacaaaattcaaattctgaaaaaagaaaccttttttcaaaagcaaccatgatagtgaagcattgaaatgccatctctttatgttttaacatttccttcgacgtatttattgtttttgactttgttttcaatttctatgctttgatggacacagatattaagcaaattattttagaagcacagcatagatggctacgtccggctgaaatttgtgcaatcctcagtaatcacaagaagtttctaattgcttcagaacctgcacatatgccaccaagtatgttgtttctcttctgccaaaaagataacactagttatcttaagttctcaatagcttcatttggagaaaaggatttaaatattgttattttcttttatttgaagggaggacggggaggattaggattttaatctattcgaaaaatctgtatcttatgaggactgggacctgcatgaaaacttgacacaattatgcccaatatctaattgcaaaatggtcattctcaggggtcttagtgagtggttgtaaaattgattttggttaaaattaattctaagtgaagtgatttatatttggataattttattctaaaagcaagttaacaagagaactcagtttatgatcttttatcccatgcaaaagttacctgaggttgattttactcttaatcaaaactgggctgaaaatcagtttctcaatgtgagaccaaatatatgagcatttacctaaaattactttagctgatatttcaacgtgactttagaagatccttccaaacatgcacttatcatatttttccttgacattaggtggttcacttttcttatttgatcggaaggtgctgagatacttcagaaaggatggccataactggaggaagaaaaaagatggaaaaacagtcagagaagcccacgagagactaaaggtaaatatgctgcatgtaaggttataagtcttaagcactggtacaatcacatctaccataaaatgagaagcaaaggtcgctgtaagctttatttactatcattaatgttaattctgctttgggaagtaaaatgtattgagagaatctttcttctttataaactgttgcattgaatgattcatgatatgatgctctcaggctggaagcgtggatgtgttgcattgctactatgcccatggagaagaaaatgaaaattttcaaagacgcacatattggttgcttgaagagtaagtgtttctgcttaatattttcacagttcagtataaaaaatcccctatttatttaatgttctatcttcatttgcctgattctgctctatcttcttctctcacctcctcctaactttctgccttccctcattatcggtctcacagacatatagtaatatccagaaaggaatgaagaaaacctgggctcttcttcttatgtgtttgttcttgcttgaggatggtgtgctttaaactagaactactgagatatatctgtaaatgttgatcacattctattggtttaaactaattataataaccttctagaaattgctaatttgtttctatggttcttatctgtggaatgggctcctcttctcaccttttttattcaacattgttgcagggaactctctcacattgttctcgtccattatcgacaagtgaaggtaacatgttacgattttattagtattttttgcctaattgttatttgacaaaagctcaagaagaattgcttacttttacattcccagtaaaattaagagaacaatgaactagtaatatgtaattgtgttgtagaattatatatttagtaggaaagtaaaacatggaaattccatcctaacttgagtatggtattcccccaaatcatgtaactagactttccatgctaataatatatactgcctaaaaataacaaaactggcactgcttccttaatcaatacttggtctgataagtttcaaaaccagacgttttcttgaatgatgctataaattggtgacatattcctttctatgactatgcagtatgcacaattctccttccccctttctcagattttgactctgtactgtgatccttaaaaagtaaaaaaaggctaacattctcatcaggagtgaactttttgaactatgtaataaatataatcatgagttgctatatcttcccatctatgaataatttcatttgggccttcattcctttctctcatctgtcttgttcaaaataatcagggaaccaaggcaaattttgcaagtgctaaagaaaatgaagcatctcttccttatgctcaacaaactgataaatttatgcccaaaacagagatggacacttctttatcatctactcttcatccacatagttaccaggttccttcacaaactattgatacaagcatgaacagtgcccaaacatcagaatatgaagaagctgaatctggtatttcttttgtgcgcattaataatttaaaatgttctgttttcaatttttcatatctagaggacattctgagtagcctttttgttgacttcgttctttgtatcactttcttgtgtgtatttaaattttttaattgtaattttacagcattcaataaccatgcaagttctgagttttattctttcctcgagttacaacgccctgttgagaagatttcacctcaacctgctgattgttattctcctcagccgctcataagtaaatttcttcattttaaattgttcttatcagtttaactttgatgcattgtcagtttgtcactgtaaatttacattatcactcattttttgaactaattttaagaatcaaacctctttaaatgatgtgactgtgcatgattgcatgatagtgtaaaaaactttacactaatattgcatcaaaatcaaataccttgttataaatctttcatacatactggccttcttatcaggaaagtctgtacctaacatgaattgtgttattgaaactgagacagatgatcaagagaagttacatgtcattcctggggtgaattatatctcactcactcaagacaataaaatcgaagacattcttaatgctggattgacatacaaatcctcaaaaccccttggcttttcctcatgggaaggtatcttagaaaataatgctggaagtcaacatgtgccttttcagcctttatttcctggaacacagcctgataacatgggaatcaatggaaatttttctcaaggagatgagataatggtgccatatttgaccaccagtattgctaagcagcatgagaatggaagtctcattaaagctgaaggaaaccggcaggtattatgtactagtaaaatcggtacttcatctgctagtggtacttatgttatataagaatatttagttctaaacaaatatccaggctctgcagtatgttctgtaggagctttgacaaggtattatatatttatgtcaaaagtcaaaaactcgaaaataatgccactaaaaagtgttgttggtatgatgctgcaaatatttttgacatctttattgtttcgtgtttctgcaaatatataatcaagcaatggattttgctttatgtgtgactattgtgtaaacatgttacatgtttctttccttcaaactcatttaattgattaaagcttaatcatccttgttaacaggcttatgatgttgattctttacgcatgtccagttggcctatggatagtccttattcaggctcaacacgtgaggtaagttgtagcaaccgtgagcaggaagttaatgatgttgattttcagaaatccttggaacagtgtcttctacattcacacaaacaaaacaaggttctcatgcaaaatgatcttcaagaaaaacttttgaatgaaaaagaaaagataaaatcaaatctagaggccaatggaatagaagacacatatttctcttttaaaaggactctgttagatggacctccagctgaagagggtctgaagaagcttgacagtttcaaccagtggatgagtaaagagcttggagatgtggaagaatcaaataaaccatccacttctggtggttattgggatacagttgaaaccgaaaatgaggttggcaacacaactattccttcccaagggcacctggacacctatgtattggatccatctgtttctcatgatcagctttttagcatcattgactattccccaaactgggcatttgaagggtcagaaattaaggtattttcttttgatattctgcacttgccatcagttttgatcacaagttcattgaattgttgtagttgcttttttgcttatttttcagttatattctgattatttatttcttcatttatgaaaaaaaatttataggttatcatttctggagaattcttaagaagtcaacatgaagcagaacaatgtaaatggtcatgcatgtttggcgaggtagaagtgccagcagcgatcattgcaaaaggtgttctttgttgtcatactccgccacacaaggttgggagggtacctttctatgtaacttgttccaatagattagcatgtagtgaagtgagagaatttgatttccaagtcaactatactccagaagttaacactacaggtgagaatagtggaagcacttttgatacttttagtattcgatttggagaacttttgtccctggggcatgcctttcctcagaattcagatccaattagtgtaagtgagaaatctcaactgagaagtaaaatcaattctttaatgagggaggaggatgatgattgggacaagctactgaaacttactcaagagaaagatttttctccagaaaatttacaggagcagctgcttcaaaatcttctgaaagataagttacatgcatggctccttcagaaaataactgaagaagggaaaggccctaatgtattagatgagggtggccaaggtgtgcttcattttgcagctgctcttggttatgattgggccctagaacccacaatagttgctggtgtgaatgtgaactttcgtgatgtaaatggatggacttctcttcattgggcagcattttgtggcaggtgagtacctcagtgcttgtgaatgaaacacatttcatcagaattgaatttatatgtaacatccttgacatttcattaacttaataggatgggtcactgatattaattgcaatttttcaagagcattagtatgtgaggaagaatagattagtgccgagagaaaatgtgaaatgtgcctaaaagaagttagaatgctcttacttgttgatactcgatatacttcattatgtttgaaggatggaatgccatttatgatgggatgcacctgagtcttttgttatgatgagttccttttttcattttcttgcatactcttgtcatctttcattaagttcttgcatcttacttaatcagggagcgcacggttgctttcctcatatctctcagcgcagcacctggagcactgactgatccatgtccagaacatccttctggtagaacaccagctgacctagcttctgcaaatggacacaaaggaattgcagggtatcttgctgagtcttcactaagcgcacacctcacaactctcgatttgaacaggaacgcaggagaaaattccggagcaaaagtagtccaaagactccaaaacattgctcaagttaatgatcttgatggtttatcatatgaactgtcattgaaagattcactggctgcagtgtgtaacgccacccaagccgcagctcgtattcatcaagttttcagaatgcaatcatttcagagaaaacaactgaaggaatatgatgatgacaaacttggattatctgatgaacgtgctctttcacttgtaaaaatgaatgtgaaatcacacaagtctggaccacgtgatgagcctgtccatgctgctgcagtacgaatccaaaacaaattccgcagttggaagggaagaagagaatttttaatgattcgacaacgcatagtaaaaattcaggtacatttgtctctaacatgtgatatgtgcaaatggcattattatttatgtctatacctttctaagccttttggctaagagcatttgtagtatttattgtttgtgttgaatgtttaatcttattctccctttaattggatccaatttataacgtgtctatttccatggtataggctcacgtgagaggtcaccaggtcaggaaaagctgtgggaagataatttggtccgttggaatcttggagaaggttattttacgttggcgtcgaaaaggtagtggtttgcgtggatttaaaccggaggccaattctgagggaactatgatacaagatgtatcttcaacagatgatgactatgatgtcttaaaagaaggcaggaagcaaacagagcaaaggttgcagaaagccctggctagggtgaagtcaatggttcagtatccagaggcaagagaccaataccataggctgttgaatgttgtaactgagatccaggaaaatcaggtattttacctatttgtgtatatttttaaaaaagtttctcactcgcggaaaaaaggggggaaaaaaagtttctcaattatcctgctttaaatcattttctcttctagacagtatataacagcagtagttttcattctgtacaaagatttggctcttttaaagttaataaagatacagtaatttcagtttgcattttgaaaattaatgattaatattataacacattcatgattttatgatgcatgtgtatgtaatatatgacttgatttttccgtcacaactcaaattacttattttatttttttaaatgagttacttcagaggagttgaattctctgaaaaagagtgtaaaaaaaatgcctgaatatggtttttctccctttagttatttacataaagctcaatttgcttctagtaaagccaaagagccttaaatggcactggcttgatccccggattgaatcccctcatttgaaaccaaaaaataagttgcttctatcgaatgaagctgttaaaggtgtatattggatgggctaccttaaaaagcttgttaagaaattatatgtatatttgtttaaactacctgaatatagtatcttcttgtgactgccagtagagcttagacttctgtatatgtcttttgcaggtaaagcatgagagcagttctaacaattcagaagaaccgagagaattcggtgacctcaatgatcttgaagcattgttggacgaagatattttcatgcctacagcaacttagaagttagctttcgttgttaattgtatgacttggaatttcccagcagagttaggtgatcaactgtctcactttgattgttatagtaaattagtaatcttaattctcattcttttgtgttaaggggtgatttgctaacatatcacataaatttaaaaaaaatgcatagctattaaaacaattcttacaatgcaaaataaacatgtcaggttccctatcaaatgcagaaatgagccgtgcacatttttcttacacaagccaaaattttcaattcatgctcagtcagctgtaaggaggaaccaaggttcttcccagttagatattgctggatatcccctggttgagtgttaaaaagttgaaccaaacttaactgtggaagaactgaactaaatttttttgcctaaaccaaactgaattgtattttttatctgacgaattgttttctcaaatccaaaccgaactgttcattgaaccgaatttaaatgaactgaatttaaatggaccgaattatgttgtgtactgatacaaaaaaaatggaagggaaattttatgattcagttcagttctgctttgttctcaaacgattcggttcaaatttttagatttataacctaatcgaaataagtgacaatggtaggagttttgcagtcccgacgaagacagggttgttaactcaccaaagaatgcccaactattagtctattaccaaagtattcgtcaatctataaaatataaaataatctaacatgagttaggaccaatttccatttcattgtgtttctaatgttggttgaacgcttgcaaccatgaatacacatcgttggtgaaattttcacccgatatatatactgttcttattgtgagaaagtggaaaaagaaaaaaggacggtgcctagcactatccactgtacatgccaaccacctaagtataccttttcacaacccgtatcctctagaggatgtaacagctcctccaacaggttgaataaagggaaaacggtagaaaggaaaataaatatggaaaccatgcaaaaaagaagtccaaatgatttaagagagttatagaaatcctccgcctaattcctgttaccagagccaaggctctcatagaacaaaatgtacccatggtctgtattacttgaatactcctgtgatgatccaaagaaagtctgcacagcagactcgtcaatcatctctacattttcgtcatcaaagaataaccagtggttatggcttttcacaagactgacataatgcccgtggttgggcccactcccaacatggacaactactgcaaatagagaatactcgatatccgcatcttcaactgtgttactcaacttcagctcaagggggaaaacaacccggtaggacagcttcttgtagcggcctagttgttccatgtacttaaaccgcttaagatggatgaccaagatgtgaggtggtttctttatcttcatcctcttctgagcttcttgcaaactaataccacaagaaagttggcatcttggtcatcagaatggtgaatgaacatgaaaaacaagagaacagagcacatatatttttacacactaaattgacatggctaccaaatcccactcagataacaggtagaagaaaatgtcaatcaatggaaaaatgaacgtatcatagtttgcttcttttaaattgtagtattagtcaataaacatgaatagcagcgcattctaatttttattaaaaggagataaaattttctataaaccatagatgatattcaagctatttgccatgtgttagatcacaaacaatttattcctccagttaaaaggggtagaagatgtacctaagaactttacgagacactattaaagatgatcttgatccaaatatgattttctgaatatttggttttcaataaagtcaatgacatcaattaatccatgcagtcaattcaatctagtagtacaaggctttattgctattgttcttagataaagaagcagaagattagttcagccaagcacgtgattcaaaatggttaaacaagctctttaaattttccagaacactcaagaaaccaagtaaagtaacaactgatgccaaagaagtagtatttcggatttcagataattatagaaacataatttgtacctaaaagccatatatatacctgcagcatttgtcgcaaaaaaatttgtcttcagcattcagtgtctcggtggaactgaaatttttcaaacagcttgtaattgaactgttttgctcaatatcaagactcaagtccaaaaatgtttcatctctagctgtcactgtttcacattgcaagcaccttgtctcattggtgagtattccctgatcagagcaagttacaacagtaaaaatcctaaaaataaaagtaaatcttattcttctgattactacagagtacaaagagcaacaaaaacaccccttcccccacaagaaaaatacataaaaattgacagtgaaattactgtgttttacattgtttaataataaagttcatctataataaattagtactataaccgtatgccaaattccattataattcacataaaagccaatatgaatgaattacccttaaatgtaacaatacatgcccacttaaagagataacactaattgactggatccgatagaaagtttgctaattatggtcccttcaaattttgttgcaggcaaaatgcaaaatgaaaacattgaattgacaaagcaaggccacctgaaaatttttgtgtacccaagtaactaaaggctctttgtgaacaccattagcgtgaccattcttgggcccattaacagccttttcagaaggtggagatgtctcctgatcagtttttgcagcctgagcctctttctccagaatgtcaacaagttcattcagcaaaaagttcaagaactcgtgggcatcctaccaagagaagattcacaataacaatgttgtctctaatgaaaaactttgacaaaataagagacattatgcaaccaatgaaacattgaatttaacagataataacaatcaatgataaataacgagtacactttacagcacactgagttcagtaacattatggtaaacaacctcactgaaaagcaacaaattgtcattatacaaactcgaataaatcatttccagagatggacactcatcatgagtcacaattatttactcacaaaagaggggaggggggactggggaactaacaagccaaagcaccgtttatatatcagtgatatacagtcaaagcatgactagacaaagtgaaaagggttgttgccaaatggaaaactgatataaaaaagattatgcttcccacaggacatataataatataatagaaatacaatttaaagtgtatatgctccagttcaagtaaacagacttatttgcatataaaaagactgaaaagtgtacaaccaacatgagcatttcaacttaatattataacaaatagttcaaaagtatttccagtttattaaaagatgttcacaccaagttcaagtgtacaaattgcaaatctgaaaatttggtccaacctactacacagaagcattacaaaagaaatacttatctaataattgatctaccaagaggacaactagtaatttgcctcaaaacatagccagctggaaatctttaatacatatgatagaatctctagttatttaaataagctgctacttgggagcaagggcaattgtgtatggtgaacgatgcccacaagcaaagaatcctttcataagcagggagaaacgcatacatggcaacatttgcatgtgtgactatgataaaactaatctcttgattataatataaacattacagtcaaaagaaatttacaggttttctagaataatcacctttctgctcaggaagttcatttttgacagtttaagcacatacctggtgcatatagctacggaagagttcattctgttttttcaacctctgtacaaatcgtttgggagcaatgacacctgtttttttcttctgggaacttatctacaccaaaagaaataattatattacattcatgaccaagaaagaaataaataggcatgaaaatgccattaaatggacatttgattagcaataataaatggaaggtattatttggcatatacaaaatgaagatacttacaaaaggcacactacaaatatcttgaagcaagttctcaggcataagagatagccgtgtaagtgcccattaaatagacatgtgtttattaattagacatttgaaacaatgaattgagcaaaaattctatagatatacaaaatggaaatacttgcaaaagcacgatgaaatagcgcagagccattttcaggcacacaaaaatatactcgaacatactataaagaagatttagggaagcataaaattgcctaaaccaatttcacataacttgaaggcaaacagaaagggggaaaacaaataaaataaatgggccaaaccaacataaaacacactggataaatgaagaaatttctcaaggagaaataatagcatccatacaacaggcaaaaaaaaataatagcatttatacccgagcatattacaacacgaaatttagataaacatggaatcccctttgtcaattccttgtctctcagacaaagagcaactaaaaatatagaacagctaacaaaaatgtcagctagctgggcatatatattttaggcattataagtagctagtcatgttttgataaacttcaactgatcaatagaataaaacccacagtatgctttgctgggaagtactgaagcactaaataaattggcatgcagatttctctgttacaggagcatctttcatcaacattctaaaaatccttccataaaacggttagaaaaaggaagtctatgaggaaaagcaagtgcttaattgcgatcacgagagcgagattttggattaaatggaggcaatgtatttgtccgagttttttcagagctgtctatttaatggccaatgttattaaagaaaacatggttacagattcaacaataaagataacaagaaccacagtgaagcatgcaaagaacaaaaaggtacttgtttcatattattattaaataaatgaagaataaaaaaaaaagctaggaaatcaacaatttatttcatgagagtcctaggcaagcaaaatagccacaaccagtgaagacagtataactttcaaatagtgaatcatgcttgacccaatcaaatatgaacaagcttagaggcattaagcatgtaaagttgagaaatttccaaactaaagactgatttacctgcgaaaataagtccgctaagcaagttaagagattttcttccccgtccaatatgcttttgttatttccataatactctagtaattgttcacgaaacggaacacaaaagtatagtgcctgtacaatttggcaaaatgagacagttgttagcaaagaaccctaaaagcctttacaaaaaataacaaactgaccgtcttcaagtattatcaccagacatatctagtgccctcattgatattttagagatggtaaacatattgagtgcaacaagacaacaactacttttaaattgacgtatgcatctaaagagacgcatataatactattgaatgaaacatataaaacattgaagagcaaatccaacttcaaagtttaataaaactaagaatcagcgcttaaaagaatctgctaaacaggtcaacagaatgtccaaaacaataatatacatttaagtactaaactctctcctgaagatacatatgaaactgcaacaaactttgcatagaagaatcaataaaccatcaacacaacagattagagtctctatagaacgcgaaaaatagaatggaaaagtaaaaaacgtaaatcggaataaagacctgcaagacgctgttgcagtaacaagtgttgccgaaattctcgaggccaaagtaacgttctccttcggggaattggtctccgagagccttctcaagcttggagcctgcagcacccatgaccgcgttaaacgatcacaaactcagattcctatccgattcaactcagtgactcgcaccatgaaatgctcaatgaccgtttggatcgttggggttttgtctcagaacgaaccttttcttgtgtctggttttctctacagatacgtgagcagggaacgaaacaagggtttcgcgtgcgagagagtgaggacgaaaatgctgatgaaaatttaaagaaaaattgaggaaaaataaaggcttaattaatttttcatatataaaaaatatgtcatttttagattattacttaacattcatttgtttttcaactaaatatatgaaaaaaaatcatatttcaacttaatatatgtggttaattctctttcgttaaatgatgacatgatagacgaaatgtcacttcatcaatccttatcattaaacacgtcattctctacttctatttcttcccttcttctccttttccaatgaaaaccatcacaaacatgccaccaccgtcgtccaatccagtgccaccaccaccgaccgcgtcattgcgccaccactgcgctgtcaataaaaaacaaccctttccccttttccttcgtgacaatggtcaaactgttgctcatgaacttcatagagttcctcatcgcggttttgatctcgcataatctctagagaactcttgggcacaacccttttctctctcttgacatcgtattcccctaaagaagtaccattacccttcttcttcacactcgattcaacttcactctcactcttgctctcactagacgtagaataatcactaccatttctccaaaacctatatttgtgggcctcagcacgattgttcccaacctcaggaacagaatggtaacccctagtgtgcttggggcaaaaattaaggtttagtgttgtcgggtttagagttagaggaccgtcgtggttgttctagaggtctttggcattgtctttgatgaagtagtcgactagggctttgacgtggtcgttgggggagagagggcggtgggtggcgggcgcggtggagtggtggttgggggaaagggtggagcggatgtgggagcgaatgcaagcttggtagagctgcttctcttattggatgagtctgttatgtttgtctctggcgagcttctcgtgcatgcgcttccacttccacttgttcacactgtcgagaaaggttttaggaccattacacatgcttcggagcaaaacccagttccagttgcacgctgccctacacgctttggctcgattggctgtggtgatgttgggtcggatggcgatgatggcacggtggtagtggtttccgttgggaaaagggaagaaggaaatgacatggcaatgacgtgttagtgataaggcttaatgacatgacactatgtctgccacgtcacacttaacaaaaggggactaacgacaggtactacattgaaacataatttttttaggtacttagttggaaaaaatgaatgtttggtagtaatctaaaaacggcctatttccagatatgaaaaacttatttaagcgaaaaataataaagaaataatggatttattttaagttaaatagcctatttagtctatacattcgctcacatttgtttttttcgcaatattgataaacttatgaattaaaattattcattttaaaagtataggaactaaattatcagcaaatacacataaactatttgtccatatttttttatcatttgttgcatgggtgtatctatgacattttattttttttattttgaaactaaattattgtttgtgtacaataaacttcaaatttatttgaagcatttcaactcaatgaaaattcaataaatttcaactaaaatttatgaattatcaacctcacttagttcattattactatatttgctaacttgatatatattgagaaagacctaatatatcttgaggatatgtgcattatgcggataagtctttaaggatacatgcatctcaacttttcatctttatttgtgttggattgtcaatggtcttcggctacaaaaactacaatatcaataacttatggatgaagatgcaatcgtcgaaccctacattccatagcatgttgcttttgtcattgttggccatgtatgccaaattgttcccaaatgtgtcaaagatcaaactctttgttggcaagaactttctaggatatgaaatattaatttagagaaagttggacatgcatgggttgcatctacttttatagacccaaagtcaaacctctatacaaatcataaaaaatcaatgagttcacatatgccaataagatttgttgacaaaccataattagtattttgatttaacaatctcttcgacgtctactattcatataaggaaatgaaatggatttatgactttatgatcttgaagtacattgttgaggatgttgacaaatggaggctcatgataaaaacatcattatgattggaagatgacgaaagacaatgacatcaaactctagaccaacacatatcacaaaaaacttgaagagttaaaggtaggaaaatatttttctcctctataagtttatatcaagagagcgagcgctgcacaacgataaagttgtgtcttaatgactcattggtcatgggttcaaatctggaaacaagcttctgaacaatgaggtaagtaattttagtttttttatataagtttatatcaaagttactaatcaataagtttccataaccatggataaactacagacaacaactgaaatacaaccatacaaacacaaataaatgtcattactaggcttaattgcacatatcataattaaggatacaaacaaaaaaaaatgccaagtgatcgatgaaaaaaaatattggcaagaaatgacaatcctcttaagcctagggtcaacttggttaaaggaggagatgttatcgttgcggttgatttttaggtgaatattgtgaccaatgtgaaaaaaattacagtagactataggggctacccgacatatgtgcacaaacagaaatgtgtttacctactattctcttatagggcatggaaaataacatgtttttatcttagtgattataagattaatctagtttttgggaaaagcaaaagtttttctaaaggggtgaactgatggttgaactagtgatttactaactaaattgtattaactgattgaaagattaaaatcaaaatatgaatatatgtattagtttttgcaattatatcacaaatgattgttatgacgctatggtaagcaagtttgttgatgtatacatggacataggtttgatccctagtatgttcatttttgtatttgtaatatcaaagccatcaataacaacacatgtacacctatgagcaagaccgacaattcggatgcacaacatcgtgacttgggccacacatttataacaaagggagtaaaaaccttgggccatgcacatttagctaagcatatgacataccttgggccatatatggtccactcaagattgaatttcacgagttgaacccaatttcatgatggttttgatgtcgtcgcactggtccaataacatacatgatacaatagttaactcaacccacttattggttcttgaatgactaattggtttgtgtcgtgtttaaaatatatggataaatactctttgtttaatgacttttatgaaaatggaggtactacatggtgtaactttgccttattcttctaaatctaatggaatggatacaagaataatttgaaaccttaaaaaatgatgaatgcgatattaattagttcttattcctttcacaaactttaaggacaaactattatgactacattttttttttacacaaactgggtcaatttttgaaacaactatcatttttttaagaatactattttgaatttttatcaacatgttaaaaatgagatgaaaattgaattatacttacaatcaaaaaattgaataatttaatataattttctttataatcattagtgttattcatcttgcacattttttcatcatgtttattatattttttagtttgaaagttccttatgatttataattttcacgtaagtaaatttattggaactaattttacgtcttgaattagtatattttaaaattatgttaaaaaattgatattaaaaaataaaaaaaatatatatttaaaaaagtaaagtaccaaaacgaattttaataaaataactagaataaaatatagttatgatttatcatttctttccccgaaaaagaggaataaaagggagatttcgggtagcgcagggaagccgataaaagaagaagaagttgcttcttatctgcaacactctgaatccacttcgctggtaataagaggagagagagagagagagcgtggagaatgttaagtctctcagttgcttcaccctcttcttcaaccatttcctttctcccgaagccattcaatggcattcagctccgtcgctctgccacatgctccattccacccacgaaacgcagcgcttcggtgccggtggtgatgatgtctaagaggacggaggaattgaaggaaattagacaaatgaccaccgaacaaattaacgaagaggttgtcgaccttaagggcgagcttgtcatgcttcgccttcagaaatcggctcgcaacgagttcaagtccagcgaattcggtcgcatgcgcaagagggtgcttcatttttgcttcactctttgttcttctttaagttcccttgtcatgattttgattataaactcttttgaactgaaaataagataatctaatcacgttaatagtttttgttgttctgggtaacaagctagccttgggagtttgtgagagaatttagtttgcttttctctgcttttataatgaaattagctagtgtgattagcttgagaatgttttaaactgcggttgcggacatggttttgtcccaatccttgatattgtggacaaatttggccaatgtggccacaattgtggttgtgtagacccaaaaaacccttgacgttgcgggtgcgattttgttgcaatccttgatattgcagatcaatgcagccgatgcagctacaattgcagtttaaaacttactcgagtgttaggtgaaaggctccaatttggtagtatttttagggggtgtttcgctgagcttatgatgagcttacttgagcttctagaaatagcttataactctaataagttgctttgagcttttttcaataaatttcttagagtaacttgttaaaataagctctttttatctttaataagttttatgattaaatttatgacacaagtcctcatatgataagagcttattgagtaaacaactaaacacaattaaattgtttatccaaatgcacccttaagcaatatagctcatgtactcagctaatcatatgttttacttcatgaagtggtaaagggtgagcttggcgtgctctgtgcacaaattatgcatagacaaattaatccactaccttctgcttccttttttttcatgcttcaatatatgtttatatttatgtaaactatttccctccctttatggatttcttttcccattccagccactgtatatgatggcttgataactcagttttgtttggttagattcacatagatcaatccaatctatggtcataaatttgaatctcctactccatactgtctgaactctctgggtctcccaagtgagagggctcacttagaaacaaattgtcatttgttgccgacaactaacctgatcagactaagaccagcaactaatttcatggtaatctgggcttggcacacccacctgctactaatccagaaatgacagctctatgcttggtgattggccaagtaaagaggcctagagatcaacgccctttgatgaattgaatggtccttcaacccctacatttgattccaatttctggtatagatctaaataatgagacctgccaaacttttacttcaaaaataaaattcaagtatgagcatcacatctctctatgctatgagcaggaaaatactgtgagaaatagatatgcatgtgcaaagtaattcaacatgcatgtaggaatacttgaactaggtttttcttttgcttgatcaggtgtttctcttatatgcatgttttttgagttctgctagatgcacttcagtttctttatgaagtagtgtgcaatgtctttaacttctgttcccaggtgtgtccaactccaagcaccttctgatgcttatttggccgggttataaacttataattttgactcaattgagctgtaatggataaatatgccaatctttttctgcatgttagtccttgttttgcaatcattttattttgtttttactcttaaagccaccatctaatcaaacagtgcactgggatcatagtgctttgatagcatgttgaatacaagatgtgcctaatggaaagagcgaagagcatttcaatctggcgatactgatctagcctcatctttatattttattagtgtatttcctttacgtataatttcaaatgatgatgaaatgatactagagggctttactaacaaataagttctttctctagagtcggcgtgatgctgtgcatttcttgtccatatgttaatttttttgggtgcatgataatgtgactgcaaatatccgtacagattgctcgcatgcttactgtgaagcgggaaagagaaattgaggagggtatcaataagaggttgtccagaaagcttgataaaaaatggaagaaaagcattgttgtaagaccacctccatctttaaagaagctccgggaggaagaagcagcagcagaagctgcagaagctgaaaaagctgcatgagcttacacataaatatgcaagttacagagttcaatggttaaagttattgttcagtcataattgtctcgtgtataatagatcttaatcgtagtaacttatgtttgttcctgccagaaggttcattcatgccttttattttgtgactaaagatacatgattatcaaaatcatggttcacatccttcaaattaggtaaaagaaaaattaaattaagaattccaattccattaaaaaattgcttttaatttgttttatgaatgactatcaacttttggagtctcaaagtgacaaaatttatcaatcagaatggggatgcatgtctgtttttgaaagggcaagtgattacgcagagttggtatttcttttaacattatttttcaatcaagtgcctaagttagggtatcgatggcaagattttcaatattcccatggatttcttcagccaataatagaagtcgagttcgaattgactttggaagattttgaaaatttattatagtgattaagcatgatgttctaaaactgagttgagaagaattaattttatttggttagtaaaatagaattgcttttgaagtataaataaaataatttatgtttcacacatgaatgagatgttactgtttcgatttatcgtacggactagaattccgaaatgtttactactttgataaaacgagagagtaaattatattaacttatcattgtagttttagatttttatagatcatacataattttcttatttttttttaaacatttatagcaatatcccatgtagagactagtgcaattttaaataatcatgaggattagtatagaaatacaaaaaaaaatggacgaaacctaggaaatgttactaatattgcaatttaatttaaaaatatttcaaaataatatttaatgtacgggaagacacaacaagtgttgtgttctctctctctatagcttctctttctgtttcatgggttgcaacctatcaagcacggacgtgacaaataccagcagaattgcgtcggacacgatccgacacgcgctgatacggtgtcagacacgtggtcaacatctctgacacgttgaccgtagtccacatgtgaatttgatcgtgtctaaaataaaaaaatatatataaaacccttacttattgagctttcagcctttcatgcagtttgtttctcctccttcacaacactcacgccgttcgctcctccgactgccattcgcgcgcccttcacgtcagtgcgtcaccgttcgagctgttggaaatcaacaatcacacacaaatcgaaaaacagaacagagaataggaaagagagatatgacacagtaatttaccctggttcacccaatgtaggctacgtccaacttgtctgttctataatcacctcaccgccactcgttacaagtcacacggtttacaaggggaatataaataggattaaaagaaaccctaacagcagctattcatgggccctagcccaaactactaataaaagtaaaatattacacaacagtacctagcctagttggctttctgctgaccccgccaacaagaagggttgtcatctgactgcaaaagatgagccatatccaacacgagccgccactcgtgtcaccgttcattgcatcaccatcaatcgcgccgccgcttgcgtctcctctctgctcgcacctcgccgctgtgactcatctccttcaacttctcacgaggcaccgctatctcactcctgggggtaaggtaagtgctgcgggtctgggcgactgggcctttgtgggtggctaagtgctttttttaattgattagtttttgtaggttttttttataaaaaaatatcatttatggactacaatattttataataccttgcttgtgtaataccttgtttatgtatgggttgtgttatttgaaacctcatttttatttttttaatacctgatatttttattttttttaatacatggtaaatgataatttgtgcctaacttgtgttatttttatttttttaatatatgataaatgataatttgtgtctagcttgtgctatttttatttttttaatacctgacaaatgataatctgtgcctagcttgaacaagtgaattagtgaatcttgtagcttgacttgtactattttcatttttatttttttaatattgaatattctgttttgtagaatgaaatgcagtctctataaatttttttggattatatttatggatatcattagtttagtttaatattttttaaattattaaattttaaatgaaatatatattatataaattaaaaatattatttaatattaaaatgtgtcctatattaaaatttatatacttttttttttaagatttatcaagtatcgcgtggatgtctgtgctagctgcaacacaaccaacaagtttaaaaaggagatgcaaggagaacatgacacgttctgcgggtcaaaagataatcttgatcggtcaatggtgaaaacagacccaagcctataaactgtaaagtgttttgtaacagtttcactttcatgttgttataaaaaagaccaaatgatgaatgagccgtgagttctgttccgccagggttttgaaagagctatcagtgtaagatggcgatggtgctccctgaggagctgatagtggagattctgtcatgggttccggtgaagcctctgatgcgtttcaggtgcgtttctaagacttggaattcccttatcttccaccccaccttcgtcaaattgcaccttcaaaggttatccacaaacgcccacgtcctgttaacgccggaagaagaagaagaagatcccgaagatgatgaaaaagaaactgacggtcttgaaatactttacgttgtttgcttgaggagaatccacacccgctccttttgatgatcattaccaattcaatgacgtttactctttcatagcttcctgcaatgggtttattggcttgcgttaatttactgttagaggtagaggtaattttgaatactgggtacgattttgaaggatcctgtcccaagagtcgccacacttacgtatacgtcgacgcgattatatacttttagaggattatgtgaagtttgggtttggttacgatgattggcgtgacacttacaggtggtggcactctgtttcaatactaaatcacagaattgggaggtgagacttcactgcatgggcgacacttgctggagaaacattttaacttgccctgcttttcccattagtcggaggttactcaacggacatcttgtcggtggtaacgttaactggttagcatttcgcatgttgggtattgattatgaatggaacactgttactgtcaatcaattagtaattttttcgtatgatctaaataaggagacatataaatatttgtccatgcctgatggtctgtctgaagttcctgattatcctcttaaggttggggctttgaggggttgcctgtgtctttcgtacactcataggagaagaagccatttcgttgtttggctaatgagggaatttggagttgagaaatcctggactcagttgttgaatataagttatcagaatcttcaaatctctccaactcatgaattagatttattgctgaccacgcctttgtgcatctctgaaagtgatgatatgatgatgcttccaaactgcatatatgatgaatttgttctctataatcgaagagataatagaatagacagtattggaaatttcgacggcaaagtgccaatgtgctcctatggttagttccaagcttggttttgccatattgtaagctacctgcacttgcttgtatgaatgtattttaaattatgttaatggtttcagaaccttagccatttaatgtatggacatgacagagagcgtgaatacttttggtgtttccttagtttgattactttgttggatgattctattggcgattgctaattgtgtgtctgctttgtttttggatgcattttctttcctggttgataccttgttaccaatctcctgaactccttcattttctattgtagtagaatcttattttccacggaaaggattagaatatcaaaaaaatttagcaatggcatctcatctcatgtatacatgctttggtttcacctcttttttcagtcctgaccatcaaagttgtacccttccaatatgtaattgtttttttaatcctatgactgttttatttgggaaagtaacttctgctacagtctcattccccaatctaacaagattattttcaaattataaatctgcaacctcagcttcaataactttgtgccttttcaggccatgtggagagatagtggaaagaagaaggtggtgtattgtagctatgatttaagattagttatagcttccttttttgattactacttaacagttatgttgttttaaaacttcactcatagtgtaatggtaagcagaaacacttgcctcttagcaagtaatctaggtgtagttcttgtaatattttctgggtctaggaaatggtaagcagtgacttgccttttaaatgccctggtaggatctgatgatacagataaaaaatccaaattgatgaaaacctggttcaccctacagcagaaaatttaatggaagttatgtttagctttgaggataattggtctgtcggttaagtcatgatgtctacgggaaaaacagtgttaccaaattgaaattttaagctttcaatgataagcatcgagaggcattggaggtgtttggagaaacgatgagaattggtgtggttccaaatgaatcttccttcaccagtgctttgaattcttgttgtggattggaggatcttgagaggaggaaagtgatccattcttcagcggttaagatgggtttagaaagtagtgtatatgtgggatgttcccttgttgtcatgtatagtaaatgtggttatatcagtgatgcagtgtctgtgtttaaggtgattaatgagagaagtgttgtttcctgaaaattggttgtgcacggcatggatatggcatgtgggctgtacactctttaaccaaatgttgcgtgaaagagttgatccggattgaatcacatgaatggtgatacattgtttattcatgcatagtgtctgtgataatttattccaccggtgggcatcataattcttaaaaaactgtggaaggaaaaatactatgaatggaagtgacaatatttgtttgctctgcactgcagatccttgataacaaaggatgaagagaaaacttccgtattacattgattgccgttagtaatttgttcaacaaagagataagattattagttacagtgggttggtacaattttcttgcactaataatctatgatgcgatgtttaatctcatttttatttgaagttaagttagacagcccaatcttcctttgttacattttaattctctactttttaattaattccttaattcttttctaattaatgcactatatattactgtttacaaatccatccacacattctcattttgttgcctacattctcaaccccgttggttggaacagagaacttgcctaaaatcatttagccatcatcttaacgctttgaaatgaaattgatgtatcacctgaggtatattcaagagaatcaaagttccatgaaagttactttttttagctatgtttatgataacattcttgcgaatcttttaaatataccagacacatttgtaacattctcagaaattatgatttttaagaaacatgattcttgataaacaatttttagaaatgaaaaaaggttctaattatcagaggctccattgaaaaccaataatgagacaaagagtacaagcaaaggtggaccttatcgtactaccatgataatcaagtactaaataaaaacatgatggaaatgtaagaataaacaaggactaaaatataaataattttgtactaagtgatttttttttaataaaaaaaacattggaacgaaagtaatccgtacttataatttcacgaaataactaaaattactcactgtttgcctataaagctaaatttaaaatctatttttttaaataaaaaaaaaacacattcgtctttatttttttggaagggacacaatttatcaaattttaaatattctttgttttttgttgtcaccatgacattgatgcagagttttcacccattttgctaatgattaaaatttaataaatttttccttttaatcattttttttccatttacaaaattcaaatatgagatcttgtttaagagagtcgagtccataatgaacaacttattattggttaaatattcttctatcaattattatcaaacttaaaaaaagttagttttttaaatttttacttaaaaaatgttaaaacaagttaatatttttaaaatttagctaattattatctaaattaaattgtgtaacagcccaaagcagcccagcaagaaaagttggcacacttgtccgcctccaaaaacaaaaagacgcacaactacacacagtccacactctacagtacccttgaacgccacatgcgcgagcgcgaatgtgtgagctacctggttggttagcttctttattgcctattcatccacaccgaaggaacccagatcttaaataactcaaatctctattcatccatcactttgatgattgatcaatccatttccttccaattaggtcaactcaaccagtaaaagaccaatggaggaggtggagaaacagaagaagcacttagcaatgcttgaacgcctttccaaacgcacccaaatccgttcacaaaaccccgaatcttcatcacaatcctccacttcctccatactttcacgcttctcccatctaaaaacctccatagagtcccaactcgcccaatcccaatccatttcctcagacccttccaacctcaaactccacttcaatcaaatctcccaatcaatctccgatttagaaaaacttgtcgctgaaaactcctactccctaccctcctacgacgtcagaacctccctcaaaaccgtctccgacttaaaacactccctcgacgacctcacttcccaacttctccccaaaaagaaattctcattcaaaaataaacccaccaccaccatcaagaaggacgacaatgacaaggattgcgctattccaatacctaaacaaccccctcaactctccacgggccttgcgccgcgtgactcgccggggtttcgaaacaaaaccggtgagcttttgattgccgacttcagggattccgaagttggggaattcaccgtttcggatctcgattcctgccaagtgaggataataggttctgtgagggcgcttttcgttcacaggttgaagaattctagggtttacgtgggccccgtgaccgggtccgttctcattgaggaagcggagggttgcgtgtttgcgttggcgtcgcatcagattcggattcacggtgccaaaagaagcgatttctaccttagggttaggagcaggcccataattgaggactgtaacggcgtcaggtttgcgccgtattgcttgagatatgaagggattgaggaggatcttcgtggtgccggtcttgacgccgagaccggaaattggagcaatgtggatgatttccggtggctgcgcgcggtgcagtctccgaattggtcggttttgccggagaatgagagggttgggactgttgagatatccaatttgaaaaatggggacgaggagatttgatttgagtctcaacattgtttccttctttgtttcttttatgtgtgattgggctgttactagtctaggtatgttctgcttcaggaaaatgatgttgagaacttgagattaatgcgattttggtaatacaaatggttttggatatgttcattttcagtgtaggaatgagttttccgtgtgttgcttccatgagaacttgagcaatatgttatcttttctattgttgcatggattttgatggtctgcatttaccctggttcgggaatcgtttggttattgatttaattgtttgcttttcgaattcattggtcataaacatttggaatgtttcatctagggagctactatattgctgaagtcatttctcttataattatggaatgccacattgtttgtggatgtgttatgtttgttttaggcatggcaatggcttgtcttttagattacataaatttgttgatccttgaattgcaaggtgcatgttcttattgtgcttcaaatgatttatcagttactcgagccagttgatccattgtttccatttttatttatccccttgaaccagttgggtaattgcaatttaagaaatatgggaagtgaagttctactgggaatgcctccaaaactgacatatttattaatttcttttaataactagcttgcataaaactacatgctggacatgcaccaaaaaaattacatgctggaatttctgtgctattaattcgtgacgtggatacaggtaatttaaaaaattctgtaaggagtgttcttcactggatatcagtgaagcgtttgaaacattctgtgcctagtgcctactgatttcaacatgtcatgtgggagaagcttctatgcatcattagatatgaactgcttgattgacctgttaaaattagaataagtagttctccctatggcaaaaaaatatcccgattcatgagaaagcctcagatatgtgctgcatcaaataaccccagttcaatcggctgcaatcatcaagacatcaacaattgcgagagggaaaaaagaaaagaaaagaaaagatccgattagtattagaagcgaaagacgatcttttgaattttgatcaaggtacaaaacaacactttgaatcaagaggaggggatctcaggggggttttattgcacaggatttataggactgtgtgatcacaccctaatctagagtaccataggctcaacgaatcatcatgtgcaccacttgtttaaaaatgaatagtatcaattgcgaaaattgtaaagctagagtctttttgattgaggcattgtgccatcacgtctcaaggagatagaggcttctgatataattcaaccgtaacaatcttcctcaaaagttagtttaacagatagattagaatctgacagtaaataaagctgaaattagattgactcgttaaaaaaagggatatagtgatatacaacacacgtaagattttatgttaattgaacattgtcaatagttgaaaccttaactgaaaaattatcaagcagagtaacagacttatttatttaagaacaaaaactattgaaaatatctaatggggaagagatatgagaggtaataccagaatcttaaacaccatctgtgaggattgtggtggaaattatacgtagtaggatgaaaagaatgcttatacccatcgatagataatgggaattccatttaatattggaaagatattgaggttcgagccgcttgaaactgcagcgcagcttgttaagccttacggaatatatagatcctggccaattttatctaaggtgaaaaggcttgagctacacttgcaatttaaggttataactattaaattatttaattgtaaaacatataagccgtcttagctcagtggtagagcgcgtggcttttaaccacgtggtcgtgggttcgatccccacagacggcgatttttattctttttactattaagttttcaccataactttatccagcattttaaatttattttcatatggatttccaaataaatttttatttcataaatattaaaataaattgaccaaatgtaaaatataataaattgagtcataatcaatcgttcaaaatgaaattacataattatatagaacaacaaaaaatcacgtatgtatttcaaaaaacaaatcacgtatgcaccataacaattaaattagacacctctaataaaaaatacagtacattacatagtacaaaccatgcatagttaaattagtcatgcaccatcaatattgaaaacttataatctaacataactaaaaaataaccaaaacgaaaattatgaagatttgaacaatgtcttagaagtgatggatgtcacaatagcaggttgcaacaccagagtagatggcctaactggtttttgaacctctaaaaatagagaaatcgaatgtagatacggtactcaacaaagtagcattagcctccatgtccatgttacacgcgtttttggttgcctgttgaagacatgcgttttttttttttgtgtgtgtttttctttttcttttcattttcacgtcaaacagatgaattttttttgcagaggttgttcctccgtttatagaaagagagaccaaatgtatcctccattaagatcattctgtgcaaattgaggaaaatcacactaagcgtgataaaaacacaataattactattaatttttaatatcctattaaaacaattgatttttggatcactatctattagtgtaaagtatttacttacttttgctaatgattaatcattattgaagaattaaacttattaattttatagttgttaatgattattatttttttggataacatacaagaatcattttattctaccaaaatcatgatgagatcatgaaaaaaattaaatattatttgttgctttacaattaacatggaaatttaattaattattttcattgttaatctaatccaaacacattattaatgcaagttttctttccaatcactcaaaacaattgataaaaaatatactttacgttatcttttaactttttttttgtctgatcagatgtatttaaaaaaaatatttgacatccaactaatcatgtttaattgggtcaacctaattttaggataaaatgttatctctagttgtaattttatattcaaaccgatgattaaatcccagactttaattaaaaaattaaaatatcaaaccagttatgacaaggattatcttgtaaccttttacaattgtatagtattcctaatttgacttatttacgttctcaaaatctctaagttgttacacagacgtgatgttcttccattgatattactaatggattaattcttaaattacattaacaatgttttgtcacctgaaatggtaatattgaattattgatagtattagcttttttaaaaaaatatatacacaaaagtagtcttcgaaaaagtattatttaataattcagataactatattgattaaaaaagtataaaaattataatatgccttttatcaaaatattttttcaattttcaaaatataaatacttcgcataccaaatatatatatgttatgacgtcaggcattctcaaatctcaagtagtacaccaaaaagaaaaagaaaaagaaattccgaagtaaagtcctaaagggcggacagtggaagcccacgaccgccaatttaatataattggctgtttgatgcttttgattttcaaatttcaggtcgtgatttcattcagaagttagaaagttgaaactagaaaaggaatcaagctcgtataggaaaataattagacttcaaaattgacaaagtaaaataaaaatacaaaatactaccattgatatattatgtatgtagtacgtgtttggatttctgtccgtgaaaataagacgagctccatcaatgcaacaaataatttgttttagtgcgttttaacatagaaaatagttcagaagtttatcacaaataaaaattcaaaaacacattaacattaacattgtgtttgataaagatgaatgaaaaaaataaaagtgtgagtgagacatgaaaaaagataaaagtgagattgttcggtataaatgaaaaagagagttgaaaattgaaaagggattaaaatttcgatttaaagtggttaggtagaaaataaaagaaaacaaatttaaaattaaacaagtgtgaaattcatatttgtaaaactttggatatggttatttgactggtcgaggtaataggttaatgagtaagtggttcaatcggactggtagatcaatagttgatttggtttgatccaatatatattaaaaatttaaaattatatatttattatatataaatatataactaacattatttgagtaagaaaaatttatccatatccaaaataacaattaataataatccaaaattcaaattttatttaaaaaaattccaaaattatttatttatttttaaattaaatcatggtaaggttgaactggtccaattgggattcgataagttgcccagtcaggtttgaccaagtcaattacatgatcgatccaatagtgaaactaacccagttaagtcaccatgttccggtccgacaggttcgatcggtcatgctagattaggttcaacaacccagatgaaatttcctttttagttggtcctaattatttgataattttttaaaattaaaaggaatataattgattatgcctcattttttttatataaattgaatggacataatcgattatgttaaccataaccatatcgattatgtgcttgttaatttaaaaaaaaaagttttaagttgcatttgaaatgtgcttccgaaagttttcacaggtctcagtgactatcactagtctcacaagcatgtaatgaagggcaatgttagaatgttaatatttacaatacattacagttttccaattgctttcacctcattttaaagatgaaaatattttgagtggaccccatatctcttggcctactttctgctgagctttcagcttcatcatccaaacgacacaattgaaaagctttcaactcatttcactgatgatcagcttttagttgctagctttcatacgtctcaacacaagctgtaaatgagtgaaactgaattgagtatttaaagtttaggtttgatttgtaaaaaaatgaattatttaatattttatttaaatgagtctatctaaagtttgagtttataacttaatcatcagttgtctatgttttatcaatgaaatgccttatacattgtgaatcaattaaaattcatttcaagtataatttttaaaactcaacaatcatatcatatataataatttgtgaatggatgattataattttttatgctaattttatattctaattaaattcttaaaaatataaatatataaaaatacttgccacttaactaacacataagtatattaaaaaataccaacaatatactcatttaccgtgttaagtgttaacagttccatcttcatttagaaaaagaaaaagaaaacagttccatcttaaaaatatatccgcctttgtatacgcattatgcatacatgcagcacttccattaatttacttttattggacatttaatatttatttaagaaaaaagcaagtgtttttagcatttctattttggattacatctatctatagagagtttaattcaattgattgaataaagtgtatgaattatgggaaactttatgatattctttgattcttactaataaaaaatgtaaatgaatacatgcacctaatatttgtttaaatgaagaaaaaaatacatcgtaaaggagtaagaaacatacctaataaggcaaaagttggccgtcagttatgaccaaatctcctcgaagaagtaagggagtaagagagtcttcaacttgattttgatcattgaggtttcgttcataatataatattgcagaaatctgggtgcacattgtcgagcttaagcttaattttaatcaaattatacgttaccattaactttttaaaatgtaaccactttacaattattggttttttgatggtggtttggatacttttttctaaatttgaaatttcattgcacgattcatgcatcaaattaacataggagtgacagtaatcatttctacgtactattgtttattttttactctgtcaaaaaaatcgttttaatttaataataatatttatatatattattgatgtaaaaaaaattatattaccaatgaacaaaatttatgataatattatagaatttaataaatttactataaataatttaataaccatttactatagtgtgtcagactataatttagttgtcatatcattgatacactatcatatcgtgtgacgctaatgaaggagtgccaaagtgaagacaatcgcctaattgatacatctgactggaagatcaaacttgcacaattagaatttaaaaaaccaaaattttagaattatgatataactgagagatcaaatacatatacaatgaagcctaaaattaaaataaaatactaaagtcattttacttaacagaatccatataaatttcatacaataatacaaaaaatatattaaaaacatatactccatttttattcatttggatttggatttggattataagaaaaaatgatttgctatacgaaatataacataaaagaccgcgtgtgttcctgatgggcgatggcatggataagatccaactagaaagacaaatatatattagcgaatgcgctacgaaaaatttgatgcacagaatttattgatgaatgtgctacgagaacatgttgaattccaagcttgaattcttaacgcgttccagggcatgaaggatattttggtacacagcttagaaaatatacattatattatcttgtattagcaaaaagtctgaaaaatactgtaaaaacaaattaaagtctggagaattgaactaatcaggaaaagaaaaaatagaattcacggttaagaattaataattcagatatggttgcgggcgctggcagaataggattgaattgaaaggtcgattgtcttttaaggatacgttctattatgaaaacattttattaattaaattcgaataaaaaatattcgtgtgcatataaaatttaattagaatatattagtaatatacattttttaatgttatttagtcataaattattatataatcaaggaaatattgatttaatatttactttaaaagttataattagaatgaggtgtaattaattatttaattaataatgtaaaaatctttacagtaacgcaatatatcaaaactaaactctattttctctctctctatatatttaaacaaaaaaaatctctctctgtatgtaatacacgtagattttttataataaacttataaatgaataacttatatttttttttatcagagtatcctcctataaattattattaatacaaaatcaatcctactaccaattcccaaaactaacttgcaaatgaattagttgacacacacatatggagagaagaaggaccaattcagttcaagctgattaacaaagaatactgtataattgtttaataatacaaaatcgttactactactaaaagtctaaaactaacttgcaaaaatttattttttatatttattttacttatttaacatagatttattgacgtgtgcctgtatagacacatacacgaagaaagatcaacttatatactttataaaaattgatattatttgtcttctgtataaatgttgtagactattttcttgttctcactgaaaaacaaaaattggatccaccactgtatatcgcgttgtaatttgcaagcatgaataaaaagatatagatgaagtcatgaacaaaataatattgtaaatttttaatgaagtaacgagccatctatatttgtatctcaacatgatcgatagcactatgtatatagtttaccaacagaaattgggtttcgcggaaagaattggtctcctacaatataattgaatcaagatttccaattctcactaaaaaaaatctctacttttctaatgataatcttaactactttttttaataatgtatatctttttaatttggtgtatttaaatatgacgtgttaaatttatgtctgtggaataattgctacatgtaccgattcagaaatttgaataatattttgtgtatactcatgcatatttacacttaaagtatggaagacatgaaaagtgagaggaagcaagtggatggagtaatgtaatcaatatttccttctatcgtttggcttctataattaaaagatcaagttattcttatatatctttacatatttcgcgtttttcttaggaatatttatgtcactttatacacattttaactttctttccttccatcttttatactaaacaatttacaaagttaaatcatttttcacactttttctttatttttctttttttccccttctaatttactttattttctttcctacaccaaacaatatcagagataaagaaataaaaaaagagaaaataataatataataagtaatacgataagaaaaagagagataaaaaagttattttataatattagaattgaaaattcagaaacatccattcccattttgggatgattttttttttcttgacagtggagaatgatactaaggggatggtgtcctgtccgaggtacatttacttcactctaaggatataagtagagatttgaacttgagacctaacagatacgagctaattaaaccttattttgctccactaaatccatcaatctcataagttttcttttgagttaaatgtgattttgatctttttatttttttaaatctataaatttttttcttttattttaaactatagatatttgtttacatgtttttaaaattttcaattttgattatcctattttaaaaggagacatttaatctcccaaattagtaatatctattattttagtgtttatgtcaaacttaaagtgttgatggtaaagaaattagtgttgattatgatgtgaaataaacaaataatcttatgttattttattaaatttggaccatattggttaattttttattactcaatattttgaatttgatgaaaagattaaaatcatgaattttacaaaattgaaagactaagtctctaatttaaaataagggactaaaattataatttttgaaaaatatgaggagtaaatgttttatgttcaaataaaagaaaaataaaaatttatatttaaaaataaaagactaaattatggggtgtactgaggaaaaagagaaagatatgaggtaagaaaaaaagatacatagaaaaagtgatatatatgacaaaaacagtaaagaaatacgaattaaaagagttacaagagtggaatatttattttagtatacaataattgtacaatgattaaaatttataatcttatacatactatccaaatatttcacctcaagaccaaatctcgtggattagagagtaaaatgtttatctataaaaaatgattattgtataataaaatgtacaattcaggagtttaaaatgtaataaatgataaattgtagggggtgagataaatacttagtgttgtataatttttatttataatgattctgatatcttgcaatcctgtatgtttttccttcaaaatttccaacgacactcacataaaatttattaaataaaaatacaaaaaaaaaatgacattaccatgacttttcgtgtaacaactaataataataaaatactagtagtaattaaaatgaagtcaaaaaagttgcaagactggtgctgttttgttttgtgtcaattgacataaggtaatcaacacgtgctgcatgtatcgacaaaagcaactttcccttatattttcaagtttgtacaacaattacgattcacagtttttttttaacttatttgttaaaataaatatttgtttttatttttaatgtatttatctaaattatttttgtttaaaaaagaattgtttaatttttctttaaaaaatacttatataaaaaatatttattttaaaattattaagctcaccccatatcatagcatatataagtagtatatatttgctggatcatcttactcatgaaatcaacaagaagaacttagctaaatacatacagaatacagattaataacccgctctaattcaaccacatgccaaacaccactgaagaattccataacaataacagcttcgagtccttccatgtttcccttcgcaacctctcccaacttaccacccgaatggattcccttcaaagcttcctctcccattccatccaatcccacactctcctcactcaccaccaaatgaacatagtctccaacgagatcctaaccgccattcgccacgttatcaccaacggcgccgccctcgtcgccgcctcggtaaacgtgcttcctctctcggagactccaacgttggactctccgaacctcaacaacaacaacgacaacgacaacgtggtggagctcgacgcgatggagctgctggcgaagcaccttcacttctgcgaggtgtgcgggaaaggcttcacgcgcgaagcgaatctgagaatgcacatgcgcgcgcacggggacgagttcaagaccccggaggcactcgcgaacaaggcaagtggggagacacgcctcaaggggtcgcggttttcgtgcccgttcgagggatgcaaccgtaacaagacgcacaagaagttcaggcctttgaagtcggtgttctgtctgaggaatcacttcaagaggagccactgtcccaaaacgctgtcgtgccagcggtgtcggaagaagagcttcgcggtgcggtcggacttgaggagccacgtcaagcagtgtcggggagaggccacgtggaagtgctcgtgcgggaccacgttttcgaggaaggacaagctgttcggacacgtgtcgctgttcgaggggcattcaccgatgcttgaagaggagagcccagtggcggtggcggtgaaggaaagtgagggtggtttggatgggttacctgaagggttctttgatggtttggatgaatttggatttggatccattcaaaacaactgttcacatgcaggaggaagcttggccttcgggcttccctcaaattgtttagatgcatgggaactctctttttctaatttaatctaaaacctaaataatcaaattcatcgttcaaagtgtgattaattgattcttaaaaatgaaaatataaatttaatttttaaattattaaatttgtgataaaattagtttgtgttaaatttatgagataattttattattaaattataatgtttaagaattaatttaataataaattatagtttttaaagatcaatttaatattaagatcaattaatttgacaattttctatatatttaaaaattaaatttaaattttttattattaaaaaactaacttattagtgtctttcactttttatgttatactaggaaaaacatttaattgttaacttttaatacaagagtttaatttcatgcaaatatttgaagtatgacttttaaataaatattaaaaaatgagcgctaactatgcaacacaaagacataacctttttaacatatatactttctacaattgattaattttttcagaaattataaaatagtaacaatctgatcaactcatatctgcaagggtgaattcaaaatttcattactaagaattttgtagattatttgtaagtattttttattcttgaagtcggtcttaattatgacgaatcaagatttaattcattttaatttttaacacctgaatagaatatattagattgttagcattttacttattggggaagtcaacaatatatataaccatacttaagtacatgatgtatttatattagatctaaaatgacttaaatatggttgacaaaaaagacaacaagattttatactttttgagattaaattttcgaatcttataatataattagaaaactaataagtattttgtggacaaattatcataagttattttcataaatttttcaaattggttgttaaaaggtccacctaatattgttttgtttaaaaaataaatgaattaatcacacttaaaataatataaatgaataagaacataacacttaatcttaatatgtttaaaacactcattacacgatttttatttttttttaagaagatcttctttatttctgtacaaacaactccataactatggaatggattaactaatgatgaattacttgaataatttattatttatagactttgataagctgtatcataatcaagtaaatttgtaaaaaaggaaataattgataggaaccttctatatgtatttgaattaatttgtgaaacttttgcatatattaggagataatttaggagctaaataatataataaaattatatatatttcagtgcagcatatgaataaaaggtagaaatttatcttaattatactcttattagttcacatattttaccttagaagttatttcaatctttctaactttacttactcatatttaattttttaactatttaattaagctctccccttaaaagttttaatcaacaattagtataaatataacaaaaatgtggatatcactaatttatataaagtgacaaagagaaaatatataaataaataaataatgttatgaaaacaatatgtgaggtgcagaatacattaattatagtctgggttttattcacaacttcataaacgccacttgttctatcctacatatttcaatttacatttacatattacatatgttaaactttgaaacatggcagcgtccgaaaggcacacatcaatggtccagttttctatttttcttgttcagaggaacttagtcctcatcctgcaacacaccagtatcactatcaataatgcatgtgaaatccattaaaaaaaaaaaaaaacaatttcatttgttatcgcagcactcttgattttggagtgcgttttgttgcccctgctgccatatctcaaaccccggtgtcatgtcagctttcaaaattgaataagagcatctttgaaaatcatatggaaaataacttacgtaaaaggactttttgcataaaaggattagaatttttatttttgcttttattcattaaaattgcattggaatatacatagtaacaatttcaagtataaacaaatcatatattaacgcttttggaggctatgccaccttcaatccaattttaacccttttatttcgaatatttgtatttggatacctataaatttcaaacattttatcatcactttttatttttttattacattcttcttatcacactatatcattaattaaatcaattatttatcttttgatctctttcaaagtgtaaacttctaagagagttttcaagaatatttttcttttatttcagaagtgtagtgtatgggtagctagcccctagttattatattatatgggatagagatgcataaaaatattatatgggacactttatgagttgaagactgaattaacagctctatctatatcataaaataagttcaaactcatcatatataatatataaattttaggtgtcaaataaaacgtgagtcttgatgcatcattattgttgactaatgccagaaaagtgatggtaacaaaaggatgtgatggtgtgctgacggccacgaaacggagggtatagaacgcgctaatatatgatggtgtgctgacgcggattggaatttggaaggtacagaacgctgtcgtaacttttgcacgaaatagagtgagagaattcataacaaaaataacatttagacacgcaaaatcataattgacacctagtggaaaataaaagaaatatatatatatatatatatatattattgtgtatatatatatataatcaagaatatgatataataaaaaaataaaagaaaaataataaatgttacttagatgtttgaaaaaatagaatatttcaaaaccattgttgaattcacaaactaaataaccaatttatttttttatcaataaatattaattattaaaatattaattttattagtagaaaaaatctaacatgtgaatcttttcttccttctctttccccttaatcattcaattcatattatatcttactctcataatccacttgtgtagtttgggaattgaaaaatgtttttgaaatattttgagatatctaatttcttcaactacttcattaacactcatcaattatttatagatattttttctatcgtattatatcacttataatacttatatttttgtttcttttatctcttttaattgtcaaaggttgttgagtgttaaaaatcattttgctttcaaaaacattgtcatatatacggcctcactattcccatttccaacacgaggttatctgatttaggaaacgatatagttgtgagcttgtagtgtatatatcactaacgcacacaaacgaaaataagtttagacattaattcagagttccgtattataaattattcccaatggcaatagtgttacactctcgagacattcatgataggtacttatccctcaaactcgacgttcagatgtcaaattcacctttgaagaatagtctcgagatgtaaaattgaggtcaggaatggagctaattaatttgcaccgctacctgcctcaattatccatatatgtcatgtgactcatcagcataatcaaacttgaagcttgatctccaagcaatattccgcacccgattgcattttatacaaccacgtgaaatgtattgagggcacaaagtgctctacctatatctttataaattgttgtgcacaaacttcacatcacatcactacatatgcttagtaaacaacaacaaattgtttctaggtacgttgtgttgtgcagtgaaaatgttgatttctttaaggctttgacgatgacagtcgcaagtaatgtccaatttgccatggatattgaagaatgggaacctagagattcggagcagaatccaccacccgatttgctaactcaagaatattacaacgaagaatactttgtcacttcacaaatcatcaagaaaaggtagataggactggggaaacgaggaaacgaaaatgcatgagactagaactcaggaaagaaaatagatttataaataaaataaaatatgcagtatttacatacaaaagtattagttattggagaaaaatcaatatacttttaatgtcgaattggaattaactaggatagaaacacttgtaacatcatgcgtgatcatgagtgatatgcgtaggtgtttcacgtcctagtaggcagaagcattaatgttaataatttgaggtataatatatttattgggagacaaggatggcaatggcacttagggacaaggccaattatggggacccaaaatattctggtactggttagacgagctatatatccctgttgagaaatggaaacgaatggcaggcttttctttctttcattggcaacattaagtattgaattcttgtattcaaaataatgattttgatacccacaaattgtgacacaagtagtcagtggcttgggtccttttagcaatggtctgcagattgattcctgatcttgtgaatagaatacttactattttgctattcccatctcagggtaggcagctgtgaaaattcgagtgaagataggtttaatcaattgtggtagctaggtttgtgtcttcacgagccattaagaaaaatggtaagaaaaatcaaatgaaaaccactcagaaaaatggtagattcacttaaaatatataggatatggagccaattattttaccatcttctttgctttagctaaggtacctagctgaccttgaactagattccaagaacacagtttatgtttcagaaaggccaactaaaatttacaccactttgcacatcttgtccagcgtcccaggttttattattcctgatacagcaatactttaatatttgagttttagcaaatatacgctgaaaaaagttttatgcccacctactagaaaaatctactaccgcatcaggaatattttgggattcagacagcatccaaccttaaagtgccaaatcattgtttgacaagtcgcaagtgttgtaaattctaattgataggtaccccgtaatgggatcagatcacagctgaaatctcaacaaacagatttttaaaataaattcctgatttatccacacaaaaaagagaagaaaaaaacacgttggaacatcaaaattttacaactatttcccccttttttacagtttttacagttggaaaacaaggaaaattacatttctagatcctctcataatttaataatttatagatcctctcatctcccaccagacaactcaatggcatcttgattatagaccgaatcttctccccaatcaaatcttctttgtaatctctcgtattcttgcctccgattgacctccacatgctgccattcctcccacctttcagccaacccttctccttctagcattcttacaacctcggacattggtggacggtcctctggtgttgcttgcgtacagagtaatgcaacttgtatcatcatttctacctcttgtatgttgtaatttttatttaggttgcggtcaacaattgcatctagtcttttctcccgttctaatttcttaacctgtagagcacaaaaatacaggcaaaaacagtaaccaataattataaaccgataaatcacgtcaaacaaaaaaaaaaagtataaaccgataaatggtagattttggattttgaataataacacaagtaccattaacgcagaggcagaactctataaaacactgcagttcacctttttctttatcaatattatcatataaacaacacacgtcaacttatttccagcttaataaaaatgcagaggtacaggtataactacatgaacttccttggctcactgcaaccattgctcctgtcaagaggggttaggatactctttaggtggagcaactatgacgggctgatccttattttatgtgatgaaataccaaaagtgaaaagtgatatcaccattcaccaaaccacccaagagggacacacaagttctaagcatgctatacaaacaagaaacagaccaaaaaacacaatcaaacaaagaggctatgatgttagaaagagatcttacatggtcaagtaacagcacatcatcttcctcttctaaacgtgaaaagtcaattgctcgttgacctgtaacaagctccaaaagcataatcccataaccaaaaacatcagtcctttctgaagactttccagtggacaaatattctggagctatgtggcccattgtcccacgaacttgagttgtcacattagtttttcgaacatcgactaactttgccaagccaaaatcaccaaccaccgcttcaaaatcttcatctagtaatacattagctgccttcacatcccgatgaataatcttaggattgcaatgctcatgaagatattctaagccacgggctgttcccagcgccactcgttttcttgtaggccagtccagaacaggttcaccaggtttgagttctgcatcagtattagtaaaacatcactggaaagatgccagattttacatgcaaataagatatggaagtccaacctacccaaacatgttaaacaaagtatacaaaaatcatatctataatgttagtcatttaatatccatgttaatttaggcttatgatattatgatggcggtgttggtgatgaaacacttctgactcaacattcacaagtaatttaaaacaaaagaattttcttttgaacagatcaccctgacaggttgaaccactaaaagcaccccatacattagaaggttgaacagtcaaactaccctggcattcacaaaacaagtgaaaagcagcaaaaaaaagagagaactagattggtttacaaaaccagttctgcaaaactaaaatttggacttggttggaccagaagtcaagtcaggataaggttttggttctcaacgttttctcaatggtttgtggattttcagttgaatttaaaaccatacaaataaatagaggaaaaataaaataaggttatctaattctttgatgttattctttcctgtcattttgaagcttccattagctgataatctacatgcatacatatatgcacttttgtatatattattatatatattatataatttatctaattaagttcaaatgtatttatgaattgcctggttcaaccaccaaaatacccttttatctacttctctagttaaacaattcttcaaatcattgctccaaggtgttgaataaatactaaaaatcgttggcatatatcctaaaatgtgtagtttaaatatgtgaaaactttcttcagccaattaatctctatccagttccggttacaaaataaacaatactttctattttgtagcaaatcaaattgaatacttagcataccagcgatgccaaaatgcattgtaagtttgtaacatattacctcgaagacgataggctacacttaagttttgcataaagggataaactaagaggcgctcagttggggtagtacaaaacccaatcagccgtaacaggttcctatgcacagctacacttatcatctcaacctcacgctggaaagctgcatctcccccaggactttcataatcagttaaccttttgacagcaacttttgtgttatcagaaagaacacctttataaacctttccaaagcctccctgtcctaaaacatttttctcactgaagttgtctgtagctatctgtagttctctccatgcaaatcttcttagttggccaaatgcaattcgccgatcaacttcacctgatgaaacaagaaaaaaagaataatgataaaatagtaatttatagttagcaatgactattttaaaaaggaggaagttcacatttatctcaattttaatgtagctagctattacattatttcaacaagcattcacaattaaaagattacagaatacgttcaaccagtaaattctcttctatcaatccaaaatttgattatatcccacattcattggaaatggaaggtttagagtaatagagatacacagatttattccaatgtttagttttaagcaccagttatccaaaattcaaatgcataagaggggcaccaagattggtattaaatccctaacatctagcaattaggtcctggaggccacaggaggtaaagacactaaaaagtgggaaaaccatgacaaaaacatatttgcaataaaaggagaaagttacttgaagaagaatgcataggtagagtttataaatcaatattttaaatgctacaactacagtcatattaatgtctatatccacatttcacttaagagaaacctaatacaataacattgcaatctaaaaaagaaactcaaacctgcaacatctacaaaaacttcacgtctgtagctcttgtgtctacccttgcaccaaaagaacagcagaccaccaaggaaaaggataacaactaaccctatcacaatgccaactatgaggccagtttttggtttatgtgatgaacctgccaatagtaggaaaattagtattcagcttgtagcaaggaagtgggaaatagataacagcaaatgaaaaggatggaataaatattccgatcaagtaaccttgatctgcattatcagtttcacaaggttgatgataactcgcaccacaattcaaattatttccagtgaaactgcaataaggagcacagttaaaatagtgaaatgtaatggtataaaatatatgttaaagtttgaaaaatatctcattcacctaaattcaaataatattctatccaaggactccatagacaacatggcatatggtcatgccagataatagaggaaatgtaaaggtaaaagctctgtattttaaccaccaccaaacaatataatgaagcatttttttttatcattattgctccaatttatttcacttatgatgttgagttccctaacatggtattggatccacattgaacaagcggttgagagttcaatcctcagtacccctttatttcatttcaaaacaacttgtggcagaaaatatcagttggcaaaggcttggtccatgcttcaggatcaaaaggtttacagatgataaagcctgttaaaagatacaagtaacaccagttctaggcttttaagcaaaaccctaagctcttttagggtgactgattccttatttcttcccatttctttttacacttcatttataatgggaatatacaactccactccgacacccatgattcaacagcattaatcatataatataaaggagtttgtgtccaataaatcctatttcctagatgttggaaacatggaaagtagtcaagctacaagaactaaattaagtttgttgaaacacaatatgtgacaaccaccaatctttcaaatgcaaataaagaagtcgaagtgtggaaccagaaatgaccattagaatcatctactaccggttgattggaataagttagtaattgttagatgaaattctatatctggactctttggatgtatgtcaccactatttaagtgtttcatgggaatacattgtccttgtaatcagggttagagagacaagtttaattggtgctttaaatgcatcatatactaattttatggttttaccatccatacttgtatttaggaaccttaaataactgctctgggatttggccactcagattatttgaatctagcagactgcaaaagagaagtttgaataatcaatcagatactaaattaatgaaatatactttaaaaaaaatgcaaagttctagaaaccattattttacatacacattgattaagattggaagactggcaagtgattcaggaatagtcccactgagattgttttgactcaatgttctggtagcaggacaagaaacagacacttttaagcattgcacaaaaaatacatgctaaggcctaagactcattatatatgtagaacctagcaaacaaaatgtcatacttacaagaattgaagctttttaagattaccaagggaagatggtatttctccagttaatttgttgctttccaaatccaacctgctcaagcttgtcaggtttcctaactcttttggtatgtttccagtgattccattaccttgcaaagaactaatacaagtataatatgcatcaatttactttcccatcatcaaaatttgagtgagtagaatgacaaaaataatttttagtattatggagttgaccaagattgtgtggattttttgtgatagaatccttacagagctgtaacatattttagaactcctattcttggggtcaagtatcctgtgaatcccaaatatgctagtgatctgcaatgaagcaatttatatattacacagcaagcacaaaatcaagatttaaaaatgtgaaatataacactttctacaataagtaatgacagccaacatcttcagcaaatcaaataaattaaagaaaacaacagcataaaatattaaaatatcttacacttgcatgacattgttgtttgagtcacagtaaacacgtgaccaagtacaaggattcacttgattttgattccagtcagtaagctggtgagctgaagcattcaatgatatcttcaatgcaaatagtgcatctcctgaaatgaacaagaacatttacacacctactagaaccaacagcaaaagtccaaaaccctagcagttttggaaaatatgaggcatccatttaattctgttaataaacagttgtatgtatctatgtattcctcagaaatgaattggaaattaaagtttgaaaagctgtgttttatgcccataaaaagataatcaatgtatgtgcatttagcagttaaattttacaaagcttatatgatttactaatgggttgagtgccataagaacaaaagaatgtaccttgcgtatcaggcaacacaaaagaacataagcaacccaatagcaatagcacaaatctgaagtccatttctactggcatcaaccactgacacaatgtccatgaaaatcaattaaaatacaagcaacttccatctctgcagcacagaatcatcaaaaccattaagctgtgaaaattgaaaaaatgtggtaaatgccatacaaagacaaacaatgcagaacaaattcctagaatgatgaaaacaatcttattgcagaacagggtattttatgatcaaacatgaagctatgcctgatcgaggaaataggaagagtacttttcatagccattattagaatgtgggtcacaagatatggagttctattttatgtctagttccaaggtaaaaagaacaaaacctttttgtttcattctgttctgtacatacactaagtcttattgcaatacaaagcgtacttcaaaaactaactgtgcagacatagacagccgcagctaaactatctgcttcacccactccccagtctaaccccataaaaaggaaagacggtctataaaaaccaatcactctgaatgtaacaaccaatctagacagtagctaattgacacttttcaattctcttctcaccaccctgtaaaagggaaggtcaatcgcaagttttttcaattacttatttggattaattgccaactactgacacctcatctaatcctagcaataaaaaaaaaataaaaaacaaattacagaaaatcaccaaaggtgaagaaataagcagtctaaattctcaagacaaccaattcagtgaacttctaattttatctggaagtaaataaaaaaataaccaaagaaataattgaaaatcacaatactccatccactacactgcacactcataaataagagtcttaacataaaacactgatgtgatcggaaccataccaaacaaaactaatcgaaaaaaaaatgagaagacaaattccataaacttaaataagattccggaaaaataagcgaagaggagggagaaaatcaaatcgagtaggcaccaaatcgcgcgcacaaagggacaaaggaatgcatatatgcccaaagatgggtcaaaaacaaaaggcatgggcagaagcagaacagtgaacagtgaacaccaacactaacaaacacgattgaaataacagacaaaatcataataataataacaataattaaaaaagaaagaactgaactgaaaatcggaatcgggtacgcgaaaagccggtagtaggtgagggatggtgaagagaaggaaggttggttcagttggtgaaaaggaaagaaagaaagggaaagctgagtactgacgaagaaggatgagagtgagagacaccaaatctggaaccgaaccttctatccctcctttctctttctctttggttagttaaatgcaatactaataggcttttgtaatagtaattcgtttttgcgttttcctacttcctttactagatttgactatctgcctcacaagtttctcttccctgcactgatgagagtagtttgcatttaaatttaaatatgactgaaaatgaaaagcaagttgcgataattattgcctctctctctcacactcccattggactgctctgtctctcgctggctcctttccaatggatttttatttccttcaaaatctcacccatcatttaatgtcgacatgtcttcgccccacgtttcattccatacaaataaataaaggctctaacggcgactaagagattggttaagaaattattaaaaaacaaatgtttttatacgagaaaccataatgagcagtgtaattttttcatcttttaattaaaatatttttattttaaagttcttaattaatgattaacatttgctataaataaaatattaactattgtctttggacatttattaaaaaattaaaatatttttttattaggaataataaaattatggtgccatgaatttttattaatgttcttatatcatctcaataatattttttttaaacccatatcattagtttacaagacccataaataaattactataatcaaatttttgtgtgtctggtatattttaccttaaagattttaaaaagattatgacagtagtatgttcttgtcagaaaatactactgtattagtagtataaatattaaaagtatgcttgaattaatcacaaatgaaaaggaataaaatgaatttcgtgtaggatttagtcaaactatttattctagtcttaaaagagactatttataatcttatccagacagtcataactcgtactaacaattaaaagctagtcaaatttaaagtaatcgtattcaatgagctataatgattaatgaccaaattatataaacaaactgttcttatacttcaattttattttgtgaaccagtctgtcataaccaattggggcgggttacccactccaaagacgtgggcaaaaatatgcagtctaccccatctatgggtggactagtaggctagcatatcaaaaatataattacaaaaaatgtgttttatacattaaaaaaacaaattaaaatataattaaaacagtttgtctctgtatagatagacttttgaaatatctgtaaaacttagttttttatgtacataaggtgaaaagcctaaagaaaaaagtatgagagagaatataaaatgaattatgataaaattgagtcgaataaagtaagaaaaagatactactgcctaacaaaagtatcaggtgctgaaaatccaaaggagaattcttccactcaatgtagggagatgcacaagcacaatcctgcatgcgctgtgttccaattgttattttcagcaaagtgggcaaattattaaaaataatgtttttttaataaatattttgaaattttgagctattttgaaactattcggaaatttgagacaattaaacacattcaatttgaacttgtttcagtcattcgctaattcgatttttaacacttctttacataatattgatttttattttaaaaatctatccctaattcaatttttaaaaaataacaatatttttgttaaagtattaaagatcgaattagtgacagactgaaaaacaccaatttagacgtgattaattattccaaattttgaaataatttcaaaacagtcttgcaaatttcaaaatacttattaaaaaacattatttttaataatttgcccagcaaagtgaccaaaccacgtgataattgaataattgacaaaggtgaatataaagaaaaacattaatattccgccaaaaacacgtgcgtgcacacacaacacagtccctcacaattttttctttcaaagaatagtattttgttttaaggccaattgcacaaccacttggcgaaataattttacagattagttactttaatgttgagagaaattaaccacctttacattgctagtttgcaatttggatccaagaaatcacagttattatagcatgtttggattaacattctcaacgtattaatcgctaaatattcttttaaataggaatctatttgtatcttttgctttgggtgctttccaaaaataacccaaagatgctataaatcgttagatcaatatcttaaattatactataaattgtctttcaaaaaaattataatataaatttgcaattagatttaaatgtaatcgtagtgctacatagctgtacaggttttattacagactacgtggcacatgatcgtgttggtttcttcaattaacaaacgttaattataaacaaacaattggacagaaatcatatcaagcaattcatgacgggtttcgtagaatgtctttcataccaattatcgttgctctaaatgtaattatttataaaattaaaattaatcatgttggtttgcgtataatccaaaatacactcccagataaatgatgttttcatgtgagggaatcatgcctttataaaatcgaattctttttatacgttgtccgtgaacaataatcaattactacttgaaattttttacaaaagaagggtcctgcggccatgctttgttacaagttctgtcttctcgtttaaggttcatctaatcgaaactgtgtgtgtctttctatttgacatttggtgattaactagccacggaaatgtatgtaggtgagagctgctttgtctctaatgcctaattgatagaaaaatattattattatgttgtctgagactattatattctttatataacatgtaacttaaatataattagtcccttttatataaattaaaagattaaatactttaagttgatttgataattgaagaaaaaaaaacagatgataagtttgaattattctcattaacaaaaaaattgataaattaataattaaaattgatcgataaaaaatataatatatatatatatatatatcattagttaaaattataaacatatagacatctcatgatctaaatacttaataatttttgcaattgacaagagtatgctatatcacatgattgctgacaagattttgagaaccaaaatatagcatgacaaagggtattccaagatatgattttttttcaaatgataaggagactgacaatgcatgactaagatggaagggtgaatgaattgacttcataacagcaatggccttcaactcaaatcactctgagacctgcattacactagcaaaacaatgaatcaacgtccgtggggtggtgaatggcagacaaacagacaaaatttggcagggttggaattctatgcttattaggctactagtctacatttaattaacgaataaaatagtagtactaccattttcgttcttgaagtttatataaaaaaaatctagtatgtttttttaacatcagtttagtctttgaaactttgaaaagagagtgtgatttttgaaaaaggcaaaggggagtgtacttagaaaaaatgcaagtggatatagaaaatgcctaaaataaaccatgtgcggcaaaacctaattttgtatgattaagaccactcgagcccagattaatttgtaattatccgaagccttaatcaaaaccccaaaacagaacttgggcacattcatgggctgttgtatatataattaaatgaaaacgtatacaaataagaacttaaaggaggaattaaaatttaacgaaataacgtcagtgtgtgagaagtaaaaaaattaaacagagaaattttttaagtattagtaataataagaatgttttttaagagtaataataagaataataaaaatacagaaaattgtatactattaaagaaaattttaattgagccttaaagaataataataacaataatataataattttaataattataaataatgatagtaatcataataagataaattagtttatgcactttttaaattgttatttaatcataaatttttatatatataaaataagtttattgaatctttataataatatcttaaaagttttttaaaattatatttttatttagttgacaatgtaaaatatttcaattcatagaaggtatttttttttcttacagtgttttatagtttagcctgttttcaattctttactcgatatttgtggatttttgtatataatagtaatagtaatactttaaaaatatttagtattttgcaaaaaaaaaaaaaaataacattgacttgaccagtgttactgcatgtgacattaacttatttatttgtttatctattattagtagaaatccaagattaagggtataaaaactttaagtttgagatggttcatatttggcatgggagaggaggagggggttcaagatttaaacatataatttataagtgagaaataatcctcacctaatatacatgtatttttttattggagtgtgtgttgaaaagaaatcatccaatcttgagttttgtaattctaggatgggaatcacaatatatttatttaattgtacgtgtggcaattggaatcacatacaatgcaaggaataattttgaggaaaaaatcattaaaaaaaccttttttaagagtggtatttgaaatcaaagatagattctgtttatatgtagggaagatattaacatcctacaatgcccatgttttaaataacaaataattgttttattaaattttatgatttaaataacattaaagaaagataaaattgctactcacttaatgtcattaaccattacatgagttaaaattattatttttatttgaaaccacaaaataacatagaaagaaatcccttcttttaataactatactatatctaccaaaaaaaaatcctccaatttactatttttattaacaaagtgaaaaatcagaagatactaggaaaacatgtgttcacgtgaaaaacactgttcacgtgcctgtgcaattcataatctttttttataaaaaaaaaaaaaaaaaaaaaaaaaaaaaactaagctttttccatattatgtacattaacattgcataaaaaacaaataacaccgtgagtcatgcacacaacacacacaaaggcacccatatattttcaaccttttttattatcattcctctttcccaattaaaaatcagaatcactttctcatgttttttttttttttaaatcctacacaaaattatctttctacatagagagcaccatcagcgcacacaattaccaattgattcatggaacaaataataataagaaaattaaaagtgaaaggaaattgaaattagtataaacagaagagcattactctcagtgaaaaaaaatacaattctcttgataaagaaataaccgaacaacatatatagatatacacaaaaggtagattacatggttgataaaatacacacttttttaatatctaaaagaaagaaaagtgaaagaaaaaaacttctgaattttgaaataattgttgaagtgtgagccttcaatccctgtatgaaaaatagatgtgtgagaagttttttttttctctctatgatctttttttttcccccttttttcctctgaccccttcttgagtgattgtgaaggctttttataggccaacacaacttgatgtccaagccatcagatattcttcctattttttgcatatatgtgattgttgacaacaacataatcactttgttaagaattttctgttttccaaatccaagattttatccttgataacctccttttgctcactaagtaattgtttctaacatttgtcactctttttcctttgactaagtcttccctatattttccttgatgatatttttctctcatttttcaaaaatgaaattgcacccaaataaatattggtattcacagtatgtcttacctcaacacttcatttattgctcacttctcactgctcaggcaagcgatctatgaagaggtaggtattgcatgcccaacatctcaagtcaacacttcatcttttgctctgttaggcaaacgacctatgaacatgtaggtaccgtccaacattagccttaacagtatctttaatagagagtgattatatgggtttttttaaagtcttttaatcatttttttttagttctcacaatactttcttgtggtctcataataatcatatcacttataaaaaattcctataaaattttgcttcaatgcaaaaaataacaagaaattttaaaagattcacatatttatattatttcaataaaataattaattcatttttttaatttttatgaatacaaataataaatatgaataattgaagaaaatattaaatatcaattaaaaataatgaaaattacataacattgaaaaaaaatgcttaacaataaaaaatacatttttacataataatagataattaaacataatgacattaaaataaaaaacataacgaaggaaataaaaagtattacgtaaaaacattgatccaaaactcaattattagcctaatgatttctttatcgatgttgtcttccaattcctcaactatcattcgatccaaaacttcatctaaatcgatgtttggatccattatatggtaactgaattgtttgaaatcaaagataaatattttgtaatttgtatgagaatatgtgagaatgatgaaacattggacatttacatagcttgactcataacgactagttttataacaactaatttcataacggctagttccaatgattagttttacaacatagaattatgaatttaagatacaacaacgacctacactgctaagattaaatatcacacacaacattagcataacatctgtacataagaattatacatttaatattctagttttttctaatatggtcacgatacttttcgtggtctaagtgttgctgttcggacatgttggatgtatccttcatgagaatttcatactccatacgcctttcttgtgtctcctttaacttaataagttttgatgtgctcacatttttgtccttcgtttcactttctatgtcagataaatcgaaagtgttagaaggttctattccttttctcttcctttttgctgttttttgtctaattgggcaagacattggcgatgacgtatcatattcttcgacttcaatgaatgtctctaggttagaagatgacgagtaattttcaccagcggcaacctttattcttttttaataatttgataaaaatttgattgatctttcaacaacaaccaagcatgctcaacctcaaatttttatcagtatcatgtgagtaaatcatatgagtattagttataacatctttctctgaactttcacttctcctatatttatctgcttatttgtaacacccgttaaacttttgaactgggtgaatcttgttccatcgagatttcaattgaatcaaacttctttcacaaaattgtccgctttgacacatatcatcattgttgtacacattttttttttatctttgcccaatattactttgatgtttagtcaacacctattattgaatcatttaacacattgagtcacaattgaacaagaatcacatcttttgtcactgagaatgttgtatgagtatatttcccactagaattttgtgctctctcatctagtaaaatattgtctacactgattggtgattgaatttcattgcttggggactcaatattggataaataatgcatataacacgtgtttggattggagggattgatggttgactacaaaattatggattttgagaactaccacttgtaggtggctttacattggatgaaggatgcatataccacatgtgtgtgggggggggggggggtgaatacaaaacacattgtgatggattttgaaaattttcactggtaggaggaggtggtggattcacaacacaacatattgcgatggattttgggaattttcactggtagagagtgtttgattttgcaaatgactagagtaatattgcaaattatactggttgcgatcaattttagagagaataaaaaaaatcgaggcttgataggaacaaaaaaaaaattaggagtataaatattgtgtgcaaaatttaatctcattgagccaaatttataataagaaatctataacggtgatttttgttcacaatgatcatcaaaataacgactagtttttttaatgttccctttgctgttttatttttgtccttaatgcttttttcatttgctctttaaccaaatttttacaagaaggctaccaagaaacttccttttcattctttattccattttcttcttttttcattttctttgcttctttctctcttaccatttcacgctcccccttccctgtttctcaatcacccctcacaccacaacacaccagcaccatcacagccccttccttgctcaaccaccatcacctgcagacctccctcacgcaaccaccactataagatggttcattgatctaacattgttgcccttgttcttcttcccattatttttcctcttttttttagatgggtggttgatgttggataatagtaatttttttgttaagaacatggtgcttatatacgatgtacttttttttttcaagaaatcgttatgccaccaagacaatctctagtgcaaagtttcttcaagaaacgatttttttaagtaaaggaaccataaacatataaacatttttcattgaagatgctctaacaaatcaacataccacatagtgggggttccttttctcacccgtagtagttagagtgagtagttagagtgatgtctttttatattataatgaatatttgatccatttttaataaaggaagataaaatagatatattttttttgctattttatattctagtaaatattgtggccatctatggatattctcttgtgatttatatatgtaatttatgctaccaggtgcacaaatttttttcataatctcttattttattacataaattggaaacataaaataaatgttaaaaatgaaatatcaaatataaatttgttaaatgttaggagatgcaagtatagtttattttaaaattattttttttatttttcaattatatttaataattattaaatttattaatgctgggtaagtattgttttaagaaaaaacaatcttttttttttactttcaaaataatataagaaattaataaaattgttataatataattttttatataatccgaaaaaatttcctccaagtttaccatagttactatctaatttataataatagataatagaagtagaaatatataatatataataaatttttaaattttaattttaatctgttataaatttgaatagtatatatgttagtgttataagttaaaatgtgatgataaaaaagatttatttatgataataataaaatgaccatagttgtaaaatcaagatgaatttaagatctaatgatttaattgattgatttaataaaaatagtaattaattatataaaaataattcttacctctctgagtagagtaagaaagcatcttatctgaagactcttgtctctattacatagtcacttgtcctgtgactgtgtcctctagaatctctcatagtctgcagaagactctcctttacttcactccatcatcaaccaatcatcgattgatcacacacaacccccaatcctcttaaccttaacaacatggcggcggggtgcatcagcttcactgccacgcgcgaccgctgcttccgcttctccttctccaacgcgggcctcaaatccgtgacaacagacctcggcgacggcacgatcatgcactgctgggcccccaaggcccacaaggactctaagcccaacctcctcctcatccacggcttcggggccaacgcaatgtggcagtggaacgacttcctctcgcccctcacgcgccgcttcaacgtctacgtcccggacctcctcttcttcggagactcccacacgacccgccccgaccgctccgaggccttccaggcccagtgcgtcgcggccctcctccaggcccatgggctccagagaaccagcgttgtgggtataagctacggcggcttcgtggcgtacagtctcgcggcgcagttcccggagcgcgtggagaaggtggtgctatgctgcgctggggtgtgcttggaagagaaagacttggatgaagggatgttccaggtgaagactgtggatgaggctgcggatattttgctgccgcagacgccggaaaagttgagacagctcgtgcagctcgcgtttgccaagcccgtcaaaaccatgcccacttgcttcctcaatgattacattaacgtgagtatgttaatttgatgcttcaagccttcaatttttttatttattttttgtttctcatatgtgttgatgttttggattcatacaattcgtgtgattttgcttaaaaagcgcaatttctgttttccttcctgatattttttttggtcggcttcttcctgattcaattgtatgatggttgattatatatgtttatgtttatgtttatgtgtcttcttggattttaccaccatggtgctgaatagggtaaaactattgtcaacgaagaaacggaaaaaagttaaaagaacaatagtaggaatcggaacattgggaactggcagggctagtgcgtgtgatctaaacgtttccccgcgatatatattgcatgttttgtttggtttgcagttaaatatgcatgtttgatttgcagttaaatatgttgtggtgtattcctaatcgattggcaaaattatttttgcctaaaagttaattttgcaacggacccttacacactcaattgctgttttcagactaaattttgtcatcaatgtcattattgatgcttggaaggttcaactggttttttgggcaattctctgtgcactggatggttcaagtgtattttccatttgatttttgacatttgtactggagattatctattcagcaataatggttggacacctaacagtgcaaataccccattaactgatattttattctctttttgttacgtcgtgtctatacactgaaaatggcatttggaggtccatgcatcattttcctatctacttctcagttgtccttttacttgaaaattaagttgtgtctgcttgtatgttgtctgattgctggatttggattctctcttctatagtccttttattgagaaaaagacacaaatctaataagcatgatatgaaactctttagtagtatttgttaaaaattgtctttctctctttaattccaactatacatgattactcaaaaataagagaggattcaaacttgtgattggctatcccttgacgtgaatacacaagcacggattgccaatttaccaaatttcattactgaaactggttttacttgcaggtgatgtgtactgaaaaccgccaagagaggaaagaactaattgaaacattgcataaggatagaaaactatctaatcttcctaagataacccaggtttgttattctcttctgacttaacattaatgtgttaatttcaccatgtttgcaatccttcactgaacttctcaaatggcacaacttttcgatgatgcagcctacgttaataatctggggagaaaaggacctggtcttcccaatggaattagctcataggctacaaaggtaatttcaaataattttagcgcattattaattttatcttcaaagcatctctaatgccttcagcaagcttatgtcttgaagttttgggaaagataccaaatggaatagtggcaattcagatatcagtataacatgaaagcataaagcatatatttttattatgttttactaacttaaaatctcattttccccccgatgtttagacatttgggagagaacgcgcaactagtggttattaaggatgcagggcatgctctcaatgtagagaagcccaaggagatgtacaagaatttaaaatccttcctcattgatcccactactccaactccaactgtgcaaaaaaaccacagtaacggcagctaagtggattagcagagaaatgggagagatttatttttcggcattgtttttgaatatgcttgtgtatatatttgtttatacgctgttatcaggcatgcggtatttttcttctcggataggacgagaagggataatcgtgaaactggttctttatagagtaaaagaagagtgtatctgttgccaatttaaagtatgtggatgagcatctgaaaactgtaaactcatatatcaggaaactcggctacggatagaatctgattcagaggaatttgttgccaaggatacaggaattgcatatgaaatatcatgagctggtgtgggtatttcaactcttctatgtctatgcttttcaggtgtgcatatatatatatatatatatttgtctatttgtgtctccctgctttagtgttccattttattttggaaaaataaataagtaaattatattgatattacagtgctggctgccaatgactaatttagtcactgtcctatttggcagtttagaagggagagaaaaggaaaggaaacgtaaccattaataggagaagggagaagaaacaacgaataaagtggagggttaataaagattaaagaaagaacccctttgggcctttgccttcctttatgcaaattcttacccattcaatccaaccactctgacattctccatttttttccgtccttttttcgggcttgagtctggtaagttcaccaaagcgaaaaatagtaaagaatgaaatgaagtcgcaaaagatatatatatatatatatatatatatatatatatatatatgtatacacacacacagtagaacatattttactccaaagtaattgagttcttctagttactgaaaatccacaaacactacggatgaaggtagggttattctcccctgcttctttgatcataaactattttaatagaggaaaacgaatccacaaagactacgatataggaatggatgcggaatgcctttattcttccttttgagtaaatccacttttctaaagcaacttttgctaattaaaaaaagttgatgattgcctcaattgaatggctccactgagtcctgatcaaactaagcagaaaataaaaccagccaaaataggactccaaacatgccaagctgctaaacattcacacagaacagatggttaatgatacaggcatgcataactatatttttttctttgctagagagaagattattataaagcgttgtactttcgcatcctattccttctgcctatacatgaataattttattcattactttcgtcatactagtcttacaccaccatttagttttaattaataaaataaataagtaaataaataaacaaataaaacacatttcctaatacgttttttcttctttgtttccgcccacccaaatgagaatatttaagtgtagaaaagaataatcttcactgaatatatattataacgaatgatttcaagaacttacaaaatgattaaatggttgtttatcttcaataagaacttgaaccaaacaaaacaagtactattagttactattattattattaatatgtatgtgtgtgaagaggtacgtacgtacgtaggaagaagatgattttcataccaaaataacaggaataaatactcgttaaaccttacaatttcatacttatataagaaaatcactgactattaactatacccatctcagagtgacagtcattttccttgcgtatgcgtgtaggaatatatgaaaggtgagaagaatgatgaagaacacgaagaaagcgagacaacattttgacattgtttgcaaaagtaaataaaaggaaggaaaaattgacgtacaggtgaagaagatgtgattcgcagaggaagagtcccaaacgtagtcctggttctggttgaaagtagtggagcaatccaagctggtgttatagcctcctttacaaacacacacaaacccattcccaggcggcgcaaagccgcacaccccgccgctactctcacaaccactgcacttggtagtgccatagttattatccaaagccccaccaaaagagtacttcaaggccactccatagacccagtgagtggggtccgtagggttatccccgagcgacacaacagaagcataggcgccacacttcatggctttcaagtcgagctcccctttgccgtcgaggttggcgggggagtagacgcagcaggtgttgctgggggggaagagaggcaggccgagggcgacgacggcaggacacgtgtagagtgatgcgcagaggtagtcgaaggaagggtcacagataggtgaggatagggaagtggtggggggttggcaggagaggaggaggaaggtggaggaggcgatttggaagggggaggtccagtctatgccgaagttggtggatgaagggtgcatggaggtgcaggtggacatggaaggtgggctgagggtgagggtggaggtgctgtaggagatggagctcaccgggtaggagccggtgtggcttttcaggaagagttgctcgccggtgccgttggagccgcaggttacgtaggggctgaacagaggggagccgcaaccgtggcccgtgccgaaggggtacttaaccttggttgagccgcaggtgtcgcggcatgctgtggttgtgggtggggctgatgcagaagaggagaatagggagagaagggtgaggaggagagtaggaagaggaggtgttggcgccatgctttgagccttgctctctttctctttcgggaatggagtgctggattaaataattaatgaatttcccagcttgctacacactcggcttcacatgcacatgtaataaagataaaaaaaatttcatcaatcaaaaagatactcactaattcgaaattggagttggattgtaatttaagaaaactgtgattaagaatttatttttttaaggatcaaatttttattattagtcgaattattcaacattaacttttctctcaaataacactttttttttagtgtattatgagtatacacaaaaataaatttaatgaataaaatgttttaaaaaaataagtaaatatagtacaaatgtttaatttgtatgataaatgattatgtatattcaattaatattaacacattcaattgtttgattaataatatttaatatatttaaaaattattgaaaagagagtaaattttactaagacatgtagttatttataattcatttagaatatgagaaaataagttgtgtgctgatattataaagtaattttacttatattgccactcaaataatcacggtcaaactcttagattgttcatataaaatttaacccaatttagttgttaaaaaaaatatacttgaaccaagttgagtaatagccagtgtaattaattttttttttcttttaataactaagaccattgtgaatatataatgacttaaagattagataaaatatgaataaataaacttgattttaacgggaaaaaaaataacattttaataaccaaagggtaatttatgaaaaaaataagattagattggtaatttctattcattttttatgcttaacttcttacactcattgtctgtatgaagaaattattaaatgcaaaaaataatttatgaatcacgtacaggttagtgggttatagtgtatcacaacaaatgaaaaaggttaaaagaaagtggaaaaattgttggaaaatgcttagtagtgccttaatggtattgattaagtaacttagaataaaaactccgacctgccggattcgaaccagcgacctaaggatatctgttatcaactacagtcctccgctctaccaactgagctaaggtcggtttatgtaataattagcggtacaatttttttttattttaaatataggtaatttctcatctaaatgaatgataagatatttttgctttaaggatcttacattaactttttaggaaattaaataagtttgtaaaattaaataaaatgataaaacttaaaagtaattgaaaagaaatatgttaagcttgttaaatttcagtctttatagttaggaaaattagaatggagcaaggaaggaaatgagttaggcctttaggggcaaggctggtacatggattttaattttaataaccacaataaatcagacggcgaggaacaagcgaagggagaaaagcaatattagggtgtccaccatcaaagagaacgaacgaaggagcgaggcaaggcaaagcaatagcctcatcctcttcaactcagtgttctgtgttgtgtttcactgcgctctctctgtgttcacactcaggttaataaaaagggaaccacgactaccaccagcttcctctctctctattccaatttcactccaaccaaaatattaactcttcattgctaattgtctgttgcgcttacatattttgattctttcactcactttctcgttgcgtaggctagatttcagtgttatcgtttctactctttattttaatgcacattattgttgtagttcttgtgtttggaattttattttatttcttatggcatgtgattttcggtgttttattggtttctagtgtatgaaatttgaacagttgaatagtttgcaattcattcctaggttcacttggcaattcgatagtgttttgtttttgctggtttgatattctttttttttttttttaatatcttgttccttctttgaacttgccgaactcatacgtttttttttttttttttggtatactctagaggttagattcagtgtttaactttatctggtaattgattttatttagatatcggtttgcatttggtggtaattgattttttcagtgtttgaatatttaggaaataggtttcatttgatttagaaaatgatttccatgttcgagatcattataagaaataggatttgaataggtgttccatagttgtcaatcctggatagtggcgtgtgtctgtcaaccccataataaatgctatagcggtatagtgtatggcatgatgaccggatatttaaaactataaagtataaacaataaatgctggaaaattaaacaaattactcaaaattcatgaaacatacagttagcaataaagtcataggtcttcaaatccgcatggtgtgcaagtctcccaggatgtgatggtctcttaccatgctagcatattaaatttcagtatacattttttttccagctagcagaagttcatcagagaaggttacatattagatggcaataacaccttttggtagtacatctgctgcacaatggggaattcatcctcagctattactagggtccagtatcacaggaaaggttgcaccatccagccacaagtgagttctatgattgaatatttgttttgtagaatgttagtagtataggtgtgccgccattaatagcaatttatgaggcactcattgaatgtaacagcaatacgtctgtggttcacaggtttgcacccctaaaaatccttttcatgattcatgttgatgcacttgtattgcactgtgggaaaggaatatattactttttaagttttgacattgttttctctatcatatcaatcagcagtgatatgtaatcataagttaggtgtaatttgtgattttgttactttaattgtcattgacagtaattttatggtttggatatggtctgaatttctcaaaatctagagaatgctttccatcctatctgtctttgagtattgttcgatttagagggagaggaagaaagagaaagtgagaaaaaaataatatagagagaatttagtgaagggaaatgctttcttattacatagtttatgcaaaatatccatacgtataggattttaatagacttggtggagacttttccctaggttaatatcaatcatagttatcaatctcaaatagcagcacatagtggctagctttgaaaaccggggatggctgttattttaaatattataatacaaactaaatagtttatactatacatataagtactcaaaaacgaaagaaaaacccaaaattaaagaaatgcatgataaataataagagtagcagtttacacaaacaatcaccatcaatctaggagcaagaagaacatagtaatgacatcaaaaaatgaaagatgatggtgaaattaataggaaaacaaataacaagttagataaaaattaatagaatgtgaaatagaaagtttaaggaagaagaaagaatggaacacccggaaaaaatagtcctgtaaagtgtgaaggaacagtggttaaaacaggaatttttttatgtggaatggtcaaggaagaagggtttcaaatcctaccattgaagcaaaaaatgcatagaaaatgggagagaaatcacaatttatcccccccaaaagctaaacaatgttgtttcagggtaaaaaaaagtgtttttgaagcatatatcgtgatagtactgctatttgaatcctgttgcaaccaaggaccacttcattctgctacttcgcgctgctatagcatgatattgactactgtgatatttattgagtgtgacttcgtagacattaataccatgagtattaaatggcagtttatcatgtgatacatgaatctactatttccaacaaatgttaatattctttagcatcctacacagcagctatactcaaaattttcagcctagttcactgtgctggattttgtaatttcttttaactcaccttttttgcattgttaccggcagggtaagctttatggctgcaacaagttcaagctttttttctcgagattctacactgctcagtgtgggtgcgccccaaatttttaatcatcgcaagggatcaaggttgattgttagagcaaatgctgtaagtttaaaatgcactcttcagcagtgatgagttccttttgtgtgtgtgttttaaatatatgattttactttgtgaaaggatgccttgttgtctcttatttcaactgtataaagcccatgtgaattattcaatatattgcactgaatatcctttatttgtcaaaatgcaggattattattctgtccttggggtttcaagaaatgctagtaaatctgaaattaagagcggtattttctatttgtttccttatctgttacatgataatacctccatctctatataagcaaaataattatctcagtaactttagtctgttgattattaatgattacctactttcttgtaactctttctgcttcctttgacctttgagaaattaaaataattttactctaggtgtgaaggtgcatatatatataaagcattatctctaagtgtttattaacacatcaaatagttgacttcaaggtttttgctgttgtttatataacacatcacaattgtatcagtgaactatgtctcagttttctcttttccatctaatagctaaacttgaacaattgtgattgagaaattgtcatccatcagaatctgcatattatttgcttgattgtgcatattcttttattgtgattagtgacctagtgtgtgtgtcatagcaatattaaagctctttacttttgatatttcagcatatcggaagcttgcccggaattatcatccagatgtcaacaagtgagttaaattcttttcctgatttcacatattggactttgtctttttcctgattcattcctttcacttgtcgccaccccccacacccccccggttgtaaaaaaaaaagacattactgctgtagccaacatggtttggctatctcagattatggcgcttgttgcttgtcttgtgagtttcattcacatcatattttgaacattggttgataatgctttctctgtgaattggtttctttgtttattattgtttcgtaatatattatatactaaacaatgatgcttattttgttactgtgatttgcatatatagtaatttactggcaagcaaaatgacaatgtttgttcaaattcaaggggggtggagggaggacttaagttacaaaaaatgcaattccaattgagcttcattttcaaacatttttttaaaatataaaaacagctgaaattaagaaaaataagctgtcttaaacacaattttgttagttgcataattttctggtgtaatctgaatcgttttataactgttgcttattgttaaactattgtctgcattttcttgtgttgcagagaacctggagctgaacaaaaatttaaggaaattagtaacgcatatgaggtaaaactgcagattattaaactcagtttgcccttatgcatatgtttaacaataacttgtcttctgcggataaattccattgcaggtgttatcagatgatgagaaacgatccatatatgacagatttggagaggctgggcttaaaggttctggaatggggatgggggtaagtacctgtgatggtgatgcataattttattttgtttttcttgtttctcaatgaatgatttctttctgtcatgccaggatttcagcaatccatttgatctgtttgaatcactgtttgagggcatgaatcgcggtgcaggttccagaggttcttggaatggagcaattgatggtgaagatgagtattacagtcttgttttgaacttcaaagaagcagtttttggcatagaaaaagagatagagataagccgattagagagctgtggaacttgcaatggttcaggggctaaaccagggactacaccatccagatgtagcacttgtggaggtcaaggccgggttgtctcatcaacaagaactccattaggcatcttccagcagtcaatgacatgctcgtcatgcaatgggactggagaaatttcaacaccttgcaatacatgttctggtgatggtcgggtgaggaaatcaaaacggataagcctgaaggtcccagctggtgtggactctggtagtcgtctgagggtccggaatgaggggaatgctggaaggagaggtggttcccctggtgacctctttgtagttattgaggttatcccagatcctgtccttaaacgtgatgacaccaacattttatacacctgcaaggtttcgtatattgatgcaatcctggggactacaattaaggttcctactgtagacggaacagtcgatttgaaaattcctgccgggacacaaccgaacacaacacttgttatggctaagaaaggtgttcccttcctgaataaagacaatatgaggggtgatcaattggttcgtgtgcaagttgaaatccctaaaagactgagcaatgatgagagaaagcttattgaggaacttgctgatttaagcaaaggcaagactgccacgggtaggagataatattttgttggaagctgtgtatctatataaatatttctacttcaaatattcttctttctcagatgcatcattcttgattacacatttactgaggacagcttaacagctattgtactctgggagggattaaattgtgttggtggaggttgtttatttgtccttggaaacaggagatgaagagcagaagaacttagagatcttttttttcgttggaacttatactctttttgtaatttattttgcggtggggtgatattgaactatgctttaggttcaatgctatctttatttccaaaacaatagatgctctgagaacaaagcaaataataattatttaatcccatatatcgaaagattatatattccttgttaccacacatgcacagttggaagttgaggacagttgcagatattgagggatgtcttattgcccgtagtggcaacgttttttttttcccccttcctctttcttctttgttgggggaacgttgcaatcgtatcataaatggttactactccatcagtgtaagttgcaatcgtatcataaatggttactactggttgcttcagcgtttttgtaataaaatgtgtaatttccacgttcaacgtcggtgaaacgagtatccgaacacaatctaaacggttaaagaactacaccttttgccttttatacctgtacaggaagagcaatgtcaatttcactttcaacattttttctgcttctaagtactgaattttaaaagaatttatcaatattcttagttgcactatgtaattttggtttttattattttaattgcacaaattcggttatcatactttttaggatttttaatttgggtccctttctccattttccatctgataattaacagtaggctaatagatttgctgacactacccgaacaaaagattaaatgtgtcacccaattttattatgattttaatacattaaaaagtatgaagacaaccttcgaattttcccacgaccatattgttaaaacgaggcagaatgaccagacccaactctcatgagaaccatgaacaagatcagaggaaagaacaaaaacgaagtctattatagactgaaaaagattggggtgagagagcctagaactctcaacctcaggataatggaacagtggtcaaagccacgttaaaaaaaaaaaaaaaatcttagaatatcacggatgtcataaaatttgccaaaatgtcatgccaactaattcgttgaccacgtaagcaaagcccatggactgacgtgacattcaattattggaagaccaatttcactacacataataacgaattacatatgatgcgtgacaaaaaattcaaaattatgtataaactttgaacgatcataacttttgattggccaaacgctcgaaattgagaggagaagtcctaggcaaatttccaaaggagatttggtcaaatatttttttttttccaaaaaacacctctaagtatctcaaaattacgatttaagattcaatcatccaaaaatttcaaaattgtctacctttttaattatttaattagttaatttaatgtaattttatattattttaattacttctctcaattacgatcattttgacataaagtacgcctccataaaaaattataatgtaaaattgatagtgcatataaacttcaaataatgattttattctacttttacaaaaataatgacagttttacacataaaatttaaattgattttatttcaaacaataaaaaaggaagcattttaaaagattgttaccaaagactctttatattttaactctattttttttttcaaacttaaaaaaaacacttttgtctgagtggtgcaacaacaattaaccaagactctcaacaataatcttataatcaataaatcaagaagagaaacatacccatcacatgagaagttatctaattttatagcaatatataaagtagaatatattaattaatatgtttataaaatatatgaattagccttttgatttatcgttgtgtgatatatactcagaagaatttaaggggtcctccatatgaaggagagaagaacaaatttggaaaacaattttactctaacacaagtctacgattaaacacgagcaagacatgtcatactgaaggagaaagcaacctatgacttctattaattttacaatgttttaaaaaataagttctattaattttacaatgcttaaaaaaataagtcagctggggccaaggtccccctactcaacacgtccgcccctgccggtggagggtggaggcagaggtgttcggaagatgaaggggaatgtgggattgatagagaaagaagcgaacagagaaggttcaaatcttgacgctttccctttgttcagatcttagcgtttacacattcacagaacactaacgatcataataaaaaatgaaagaaataattaaaaaaagccattcgaaaagaccaagataaaagttttgaaatgcataaaaaaaaattaaaaaataaaaaattaaaggtgatatttagtctttttaattctaataaaatgagtgagtttcaacattattctgtgtaaaatgactattttagcatcatcaagtatagcttttctatttgatttttatccttcaatatatgaaattattacttttgattcccaacattcattttaaagtagacaaataatatttattttagaaatttaaaaaaacttagaggtatcatgtgtcgtatgagtatcacataatattagggataaaaacaatataaattaagatgaaaataattaaaagaatattataatgataaaaatatatataaaggagatgattggtgatgtacttacccttgtttgaaatgccaaccagagagacatgcagcttcttgcaaaactaacctccattttttaagcttgtccttgtcactgattcttgtttcatgcttggctagtgcttctgcatagcttcctttctgatggcgcacatcacatggatccactttatagaaaacaggccaaaccaacctccccccgtgtttgaagcactccatgatcttctcaagttcttgtaaacaaaatgttgatgatgcatatttttctgaaaaaatcacaatagcaatcctggattcttgaattgccttcattagagctggcgtgatttcttctcccatcctcagctcttgatcatccatgaaggtgttgactcccttttggcatagagcatggtaaaggtttcccgtaaaaccaaaacgtgtgtcttcgccccgaaaactgaggaaaacatcataagaccatcgttgatcggcaaaggaagaggaggacgaggatgatggattagccatggtagtcaccaagctgtgattcttgggatgtttgagaaagcaacaattgagttagatagagtcacacaattgcaatttcttcatacttcatacctttttataaaggttcaaatgtaatctatgttttcatttttttttaatttgtgtttttagtttttttttaaaaaaattcagacatttccttttttattttaaaaaggtttatgattttagtttcttattttttaattaaaatattctcacccttttttaaaaatttaattttttttatcaattttaaatgttgatatttatattatgtaaatgttgttcacatgataaatattttttttaaattatttaatcattaacatgtttagtttattaaaaaagtatacagttaataagtttgaattttttaaaaatgataaatgaaatgttttaattaaaaaataagaagattaaaatcacaaaattttcaaatgtaaaagacaaaataattcaattaaaaaataagtaatctaaaatcataaattttaaaaaatagaaggataaaacaatttttattcttttataacatgaaagaaacgggctttatgggcgtgctgtagaaatcagtgaggaatattagggacgagctaggaaaattcaaaaagaatacaatatattaatttagtctcgaggaaagagtttgtcattgccttaacagaatacattaatattaacgagccgaaagtacctcccaatgaagcatctgagaatgcacgatgggacatgattgccccacattataataacccttttacaaaagatgaagaaattttgctcctaatcgacaaaaaaaaataaaaaaaaatgaaatgtgaaacaggaaatgggagaatgaaagatacagagaaaatgaaaggaagtaacttgaaagacgcggaaatacaaatggtaatggtaggatcagacatgaataggagttattttttacttgtctctgttagagaaatttagtatttgttatccgtttaatattcgttggatatctgtttgaaaaatacttacagatattttttatatacttgagtatttatgatatttcaaatttaaaaaacaaaataaaaaagggaagaaaatgggaaataaatggatgagcacctctatatcagtaaatatatcagttaccattattagtatctcagcctcttaataaaaaagtagttacaattaattccaactgcttcaaatataacaaaaatgttcttcttcctcacatttaatttactcagttttcaggcatcacaatcataataacgcaattcaaagtcaataataaaaaaggaaaggctacaaaagaaaactaacctcattagtcattgatatccacttctttccagatgcactaccaatctgaatgaacaaagggcggaataaaacaaaacaaaaaattatattactttgcaaatgataataatagagctgctagtttcacaaaagagaagtataaaaacttctcactaactcttaaaacaacaggcaaattttaaaaattgatgcttaagtttgtattggctcataagaaatttataatttgtaaataattagttgtgcaacaatccttcttcttgagcaattaaaagtataaaataaattagaagaaatactaatagaatggattctacacatacatcacgccttgactttacatctgaattctgctcttgaaattctttacgaaaatcctcccttaagaatgaaaaataacttccagtaaacataataaatttgaagataagattttccatataagaaagaagcagttggcttttaaatatagccactatgaaagattcaatggcagtgctacttataaagtaaataagtatattgaagttaaacagagaacaataaaacaagccaggaagcaaggaaaggaaactatcacaagaaaatcatgtttaaatgtcacaacaattaaagatgaatggccttttttactgttcaacatgatgctgctgtgaatgtcaatgttaaatactggccatggcagtgcatggcagaatggcgtggcagattttttgccaaccacctcaggaaatttatgaagggaagcctgacatggcagcgcaatggcgtgtttatatgggaaattttggccttccaccatgtttcactatttgccattaatgactaaattatataaagaatattattcaataccagtttaaagcacaaggtatgcaataaatgatttccacaatagtacagttttatgatgcaaatgcaaatgagaatagtactcaaaacaaagcaacaaaggggggaaagcctaaagacttcaaagccacataatattctcttccaagaactgataacctggtctccacattctgcagtgatgctccacattaaggaagaccattatttcaccattaaaaaaacattccttcacccaatccaacaaaaagcatataacttctctgcaaccagcttaaggaaacaattttttctgagtcattaacgcacaaacaatttatgcacctttgaattttttccagaggccacctcccaaaatacttatatatccacccggatcccttgcccatcaccccaaatacaaagtagtaaataaattggtcaaaactactgcacaattggtcacatcaacaccacaccagacttcatagccaaatctctgcccgactaaccacaccttgtttgatccaaggcatgataacggatcagacaaccagttaaccagaggataaatataacgtttcttcctagccttcaaccaacaccaagacatcatttctagtcttccaaattccccacatcacagaaaaccaaattacttgaccttcatgtttcctgattcccaaacgctgagtaagccatcaaaattaaaaaaatgcatccatacctgattatgatttatagatataactcttagccagcacaaacaatcgaccacacctgagaaaagaaagagcagttatagaataaatgctcaatggttttcccctcttccctacaccccacacaaaaacattcctcaaccctcaaaatccctctgtgatacagattatttttactggaatacgatcctgcaccacagtccaaataagaataatcacatttaaagggagttttcttcccaaacttaatttttctaaatgcaaaaaaaagagtaggaataggtattcatgttggaaaagcctggatcaatagatttcctaataaaagcataaagaaaaaggaaggcttgttgaaaatggtagtgccattagaatttggtatgacagacattttttaatggacaaatcataatagaactactaaagcaccccagaacttcaaatgcccgactgaagtgcaaaattaggacagcagcaagcagcagcatgaacatgcaacattcatacacgaagaatacaagtttgaggacaattttttattagaagaagcaacataatctagcatttcacataaaccaggttatcagatatcccacagttctggcatttcaaggaaggagtttatatcaaactcgaagaatatacacttccaagaaccagtataataaaagtgaaaggtcctggatacaatttattttgaagttccaatgaaccaagtttatcaaatgtgcactatgtctcgtacctttgccacttctagttattcaagtaataattatttcgagagtccatcataacaaatacaatgaaaatactttcacgaagatgcaccaaattctcaattaacacaaacttggggtaccaggtaaaactgttaaaaccacttgtaaccaaccatgtccaaacaaaacactcgagaactttatatttctacccaaaacggtgtaatttacaattcattgttatttcattatgcagtgactttggcaacagcataacaagatttgacttggttttcattatgcagttcaacttattagttatttctcagttgccattgtaacattttaattttggttaacagaatacttgtggtaaaaaaatgcagaagtctgcgcatataccatcatttacaccatgaataaaaaaaatcaaacccaaattttacaccatgattacaaattccaggctgcacttcaataatcccatctacggtgcaccacgcctactgaatttttacaaaatgatttttaattcatatttaaaatttgttcatggcctaccatccagcatccaggttttccatcatgaatactattgtagctttcattagggttacaaaatcattccgtccagatttaaaatcttggaccaaagatacattcaacttgttgtagggtcattaaagctcaagattaacatctctttaaatgaagaatagagaatccttctcatagggacagctgcacttttccgttttaatggccggggtcatccttatagggttgttgtataccatgaattttcaaatgaataaagaagccatctcatagaagcaacagtacttttccaattcgagtcagggtcatccttataggttcatatacatttaaacgtgcagcttgatttaaaatcattcaacaaagattttaaacatacaacttgatttattagggtcattatggctaaaaattaacatctctttaaatgatgaataaagaatccatcacctagggaaaactgcacttttccaatttcaaggtcaaggtcttcattatagaatccatctcatagaagcaaccacacttttttgtttttagggtcagggtcagggtgaatcttctaggtaccttaatttttcagatgaagaataaagaattcacctcatagtggcaaccacacgtttcattctcagggtcaatcttatagggtttataaaccctaattttgcatatgatgggtaaagaatccaccacataggggcaaaacgtacttctttgttttcatggtcagggtcaaccttatagggtttatataccctattggtcatgagtcagaggctaccacacttttccattaaggaattcttctcatagagggtaccacactcatagaggctaccgcactttccgatttcagagtcagagggtcattcttagatatcaaaattttgcagacaatgaataaataatcatctcatagatgctaccacactttctgatttcaaagtcagagggtcatttttagataccaaaagttggcagatgatgaataaagaattcatttcatagagacaaccaaactttccgattacagggtcaggatcattcttacataccgaaattatgcaaaccatgaataaagatttcatctcatagaggcaaccacacttttccaattacagggtcaggatcaatcttatataccaaaattttgcagatgatgaatagagaattcatctgatagaggcaaccacactttccgattaaattttgcagatgacgaatagagaatatctcatagaggcaaccataattttccaaatacagggtcagggtcattcttatagagtttaaaaacccaaattttgcaaatgatgaataaagaattcatctcatataggcaaccacacttttccgattacagggtcaggatcaatcttatataccaaaattttgcagatgatgaatagagaattcatctcatagaggcaaccacactttccgattacaaggtcaggatcaatcttatataccaaaattttgcaaatgatgaatagagaatatctcatagacgcaaccataattttccgattacagggtcagggtcatttttatagagtttaaaaacccaaattttgcaaatgatgaataaagaattcatctcatataggcaaccgcactttccgattacagagtcaggatcaatcttatataccgaaattatgcagatgatgaatagagaattcatctcatagagacaaccacactttccgattacaggatcaagatcaatcttatataccaaaattttgtagatgatgaatagagaattcatctcatagaggcaaccacaattttccgattacagggtcagggtcaatcttatagggtttaaatacccaaatttgcaaatgatgaataaagaattcatctcatagcaggaactgaacttttccattttcagggacatgggcaacaagattgggctttcttgaataaacaaaaaaatgtatgacccaataggtaaaaatctgcaacagaaattccaaaatccaaaaatcgcggtttaaagaaaccccaatagcccaaataggtaaaaaaaactgcaacaaaaattccaaaatccaaaaaaaatcgcggtgtataaccaaataggtaaaaatcttcaacagaaattccaaaatccaaaaatcgcggtttaaagaaaccccaaaaatgtataacccaataggtaaaaatctgcaacatggtcacctttatagggcttataaaccctaattctgtagcaaacgaaggctttccctcaaaacactaatcatagctttgagacagaatgcgtttgcacgacgaaagacaccggtttcgtcaaataataaaaagaatttaacaagaaaagagaaagaaacgcattaaaaatttgaaaacctagagagagacattgcagtgatgagggccctgaaagatcacaagaaatcaaattccgacaattgagactgcttcatatcgcaagttatgccaaattgaactctacattcatcgatttcaaatcaagaagataacactggtttctattacctctctccctgtattcaacgattcgagtttcatcgaattatacagaacccattgacgaaacctgaaatcgttttagaaccgagaaactaactgttgatcgaatacgactctgtgtgatgcttatataaagacatcacccacgtttttttgcttttttcctcggacatatgggcctgggcccaagcccggattaactgtctatttaaaaactacgaggataacattggtaattgcctttcacggattatgtgaggataacgttgaatttggcctaaaatcggtattaaaaagtatttttaatccaaaatcagttttagaaatggtttctaattattttaaaatagagtaatatatatatatattcataactaaatattatgataattatattttatttcataatatatttttaatacaaataaatttatttttaaaatttatattttaatatacatatattaatattatatttattaaattcaataaatatattatatgtaacaaaaataatatatagtaatattattaaattaattatatattatactcaataaatatactaatttatactatataggacgctaccgatgtatttaaatatttataaaaaatactatattaataaactcaattgaaagctatcttattacttttatttaattttattttactaatacatgtatatatatgcatatatattatttgtaattttattattttagaatacattttatgaaaataaaattttaaaatttatttttaaatatataatgaagtttatgaaaaatataatattttctagcataataattaaaggtagaattaggagttaaattgttattataataataaaatatatgcaattgaataaaatatttaaattaataaaataaatttgatgagttatttttaaataataataataattaaaattgtgtgtatatatatatatatgtgtgtatgtgtgtataataaaatgtaatatattttcaattgttaaggaaggataatgtactgtatttcacataggaagggaatgcagagtagaatttgaatctttaaaggagtgataatatatagcgtaaaagatgctttaggaataatgttttgaacataagttttggtggtcaggtaagtcctcttatttattttgtataaagatgatttggttttatttattttactatttttttaagtcttcttcatttgtttgtgttattttgtgttattaattttttagttcgtatgtcagtaggagaacataataggaaatattttgttattttttagtttgcagaataaaaaatgatgtaggaaatatttgtttccatgttttagtatgatgcagtttttaattgtttttagaaaatgatagtagaagatatttttttacatattttgagtttgcaaaaaaaatgaaaaaaaagaagataatagaaaatatatattgacattttcttagtttgtattttaaaatataatagaaaatatttgtttccattttgttactttgtagaaaaattattgttggcgtttttttatttgtagaaaataaaatatagttgtataaaaatcaaatttaatacaaatttaatgttgtgatttttctactttgcaaaaaaaatatagttgtagaaaaaatatgtacaaattcaatagaaaattattgttggcatttttttagtttgtagaaaaaaaattaatagaaaattattgttggcaattttttactttgtagaaaaaatatagttgtataaaaattaaatttaatgttgtgatgtttctactttgtagaaaaataaatatagctttagaaaaaatatgttatagaaaaatattgttgtcatgttagtttgttaggggggaaatagttttagaaaaaaagaatacaaaattaatgttggcactttttaagtttgtagaaaaaatatagttgtacaaaaattaaatttagtacaaatttaatgttgtgattttgctactttgtaggaaaaagtatggttttagaaaaaaaataggttattgaaaattattattgttattttgtagaaaaaaaaatattaaaataataattaccaatttgttttgatgaaatttcagtgtttaatataatttttatggtgaaagttttagttgtacacccccacacacgtaatccttcattgctataattgcagggatgcatgtgtggaagttggaaatagtggccaaagtgctacatttaaaaaaaaaatctcaaaatgccacgaatgtcataaaatttattaaaatgtcatgtcacctaatttgctggccacataagcgaagttcatgagctgatgtggcgttgaattattggaagaacaaatttcgctacacagagtaacgaattatatatgacacgtgacaaaaaattcaaaattgcgtataaatttcgaacggttataacttttgacttgaacgtccgattgaggcaaaatcggtggtcaaatgctcgaaatcggtggccaaatgctcgaaatttgcccagggcttctcctataaatttcaagtatttgaccatcgatttcatctcaatcgaacgttacagtcaaaagttatggtcgttcgaagtttatacgcaattttgaattttttgtcacgtgtcatacataattcgctactctatgtagcaaaatagatcttccaataattgaacgccacgtcaaccgtagacttcgtttatgtgactaaggaattaggtggtgtgacatattggcaaattttataacatccacgacattctgaaattttttttttttaaatgtggcactttggtcattattccctgtataactcaaaagctgtgagacctacgcgctagccaacagcgccaccacctcatcttattactaatgtgtttagttagtaattagcctagatgttgtgttgttcattgggagagtatgtttaaaaatgaaaattacagtaaataatactattttgttggggtaaatacttcagcgcacatattagaagtccttccaactataactgttttctccttgttattttctcttatcctaaaactaaaatgtttagttttttcccctatcaaataaagaatctaatggtcttatatattgaaagtaaaactttcatttaataaaaaaaattattgttaatattttttataaagtatttattataaaaattaataaacttatcatgaataagatgagaattgtgattgaatgacatttagattattattacatgaccattaaattcaaaagtaaaaatatgtttgtaagaaacaaaatttagaaaagtttgcattattctttgattactatgtgatgtttattttcttaccctatttagaattttaaattataaaaacctaataattaactatctagattttagatgaagaagttctagtgttgtgattaaagacaattatcatcaataatctttaataagtcacaatcattctagtcataattaccaccgtcattagcactacacaataaccatcatcattctaatcaccatcattatctgttaatattatgattattgttaccattacagttatcatgtcatattatcatattattgtcacaaatctatcattagtgttattaagttctcctcctcttttgttttgcttccatcattacctctatcatcaattttaaaaccacaaaaattgaagctaaaaattgaaaaaaaatgatttttttttataattttcaaaaatttaaaactgacaattataatgaagagttttttttttttttttacacaaagagaagaaaaatgaaaagaacaaaaatacaatcttaaataaggatgccataagagtctaatctattttagtgatcgatatttttttttaaagaatgcatcaaaatgaaatacaactgtctctgtgttgaaaatactaaaaaaaatgaaactgtgcacaattgcaattgtccgataaacaaaattacatgacactttaaaaaaaaatatatatatatatatatatattatatatcatagtataattttgatatgtggcacttatacggttaattgtgaaaattactaaaggttaactataattaagctcacttctataaaaaggggtggtggtacagttggctagcttaggtttcatagctgctgagttatcttgaggttagttctcgagcctctctcatctcacttttttcaaactgtttatatgtttaaaattttgggagaattgatttattatttagaaaacaaggaaatataataaactattacgactgttttaaatacatattctgaataaaataacttttttttttcctttgcaaacatgtagactcctcaaacttcaaacaacctttccattgcaatgctactagcattcagcatatcagtccttccattaacgatgacaaattaatccctaactacctaaaaaaatacgaacgtatatcacaaaaggagacatgaatagaatcagaagaaccgttgatgtcattcttgtgttttgttattagacgattgagacttgagagtccgaaagacacttacattcggaacccattaaatttgagggtgaacattcatattaagttctttgctgatttttccttcctttcttatttttatggcgaaagcaaacttatcctaactaaaatatcacaattttcttgcattgaacatgatgaattgtcaaaggaaatatctggcaagcattacaatttaatgagaaaaacacaaacaatagattatggtctttaatatatcttgcaaagaattgttgtcacattttgatttgcacgtatacatcatccgctgtcaattaatatatggaaaaaatgtttttttttttaaagagagatcttaaccttgtcgtaaacatcaaatatttcaatccattttcctgatagaaaccactgcagggcagctaaaatagcaacatttccaaggcacaaggaaatcttctatttagcagctactacatcttgaagtagtaattccaaatctttcaatctgcatgatggttcacaaaattttagtagctgagtctaaatgaacaaaatctaataccttcagttgttagctatgccttataccttacgttactcaagtcagggtagattgctatggcttctttgaaatcctacattagatccaaaatataatacaggtacatcatcgtgcagccagtttaagtggatagtaattcccctccatgttcaatatcaaattaatctgcagattcttgttgaatttgtttgaaagttaacttaactgcctcacctgttctgctgtggaaggtgtgtaggtaaccacgcatgacatccctgcttgtgttgctgcctatagaggttaatttagatcagatgatagtttcagcatttttgttagttaaataacaagattaaatgcaatttggtgaattaaggaacaaaatgaagattctgtaattgaaattccatatgtctaggctcatctattgatattgttatgtctaataatacacaaagacaactccttgcccttagactttctaacccaagctcatctagtccgttttcttctcttcttaaacagcatataccatataattagattggttatatctcaaaatatagaaaattgaaaacacgagaaaatctacctgcaatccaataacactatcctctacaaccaagcagtctttctctgatatacctagcttctgcaatgctcatgtaaattatgctcactcggttagtgcataaaataaatttaaaacttcatgtttcaaagtttttgatcatattgtcataataaaaccttggaagctgtcacgtatattgatgggtcaggcttcttttccttcacatcatcacctggaagtttaaataaatgaacagatgaggagttataagattgacttggtggttgaagcgagaagggaggggggaggttgtgggttcaaatccctcccactaacaaaactaacaactaacatttatcgataaaaaacaaaaataaatggacagacagatttaaactcaaatacccaaagtactgccacataaaaatatcaataaaatttgcaagctgagtggtggatgttaacaactaggaaaagtggaaaaccttttctacacatgtataatagaactaatgttatgagaatgtgttatccaattttcttataggatgaaaaaataaacatagatgaaaattaattttgagttttgatgcttcagagggcgctgcagcatggtgtaagttttgtttcacaatacttgagcaggaaacatatgtctcgaatgttatatgaccaataaaaggatatataccagcaaggaagcaatcaaggccttgaaagcgctcctacaacagagaaaataactgggttgagtgcaaattaataaataatttctactcccaatagtgacaatgggcttacaattcctataaggttttcaagacagagaataactgaacttttagtcgctgcggagcaaacagctagctttttcccctgcaacaacaatttggcaaaaaatgacaaacttaaaagataatccctaactaacataaaatatgagttataacaataaccgaaacagctcagattgaagacatcccatcagaagcaaagcaagtaatacattaggtaatgaaactgaaactagagatcagtgcagtgctagaacatatatatcattatcttactgcatctctggcctcatccatcaatctcagaactccaggtctgggttttacctgtgccaaaatgtatgagtatttaacagtagcataccaacaattcagataccaatttcacagtataggagtccactcacagttcctgacttgattatttctttgtatctctcagtcttccaatcctacatgatcaataccaggaaaatgcaatgacatcatattccaaatgaaatgacaattgaaagggtcttcaatggttaaacatcaaaatatgacattcatgcatgcataaatttgatttgccctctcaaaatagttgaaaaggaataagaagcaattctcatgagcatggttttgctagttctctttttcattaacgaaggaaggaaataaacatctctagttctcatactttgggaatcttctatatgcaaatggaatagccaaaaagaaaagaaaaaaagaaataatggcaacgaactcgttaactccatttttccacactaggatggggtaaaattccatgttcaaaagcttatgattggatgtcagtctaaaaagcttctatattgttaatccattctaattaaattctaaaaagtaacaagggctagagccaagttcagaagactgagtgacattcatattatgagaaacttaataactgaattacgaagcacctaaactaataaccacgtaatgaagcaatgtgggttctaagattggcttagtggtaaagggagaagggggcggaagagatcatgcgttcaaatcccaactaataaaaactaacaattaacatttatggattaaaaaaaaatgtacggaagctaatgcaatatatatacactaacttactctgagtgctaaagacagacaaaggaaaaaggtaagaaagacataaatacctgaagagtgttaatcaacttggcccgatcctcatcattaatgggaggcgtctcgaacaacgtggacgtaggccacccgtgttccttaaagtaccttaaacgaacacaatcacacgataagtaagtaaactccaacagcagaacataaagataaacaaaagaacaaaacagagaaccatcgcattttgggtttgcctccaccaatgaggttctggagttcgtcgtagaattgaacgtcccagttgagtgggcccggagaagaagaagaggggcagcgaacgttgaagtgaacgaaggcatcgttgtaggcttggcgatgcaggtgctcagactcgaggatcacgccgtcgcagtcgaatatgagagcctgaagcgaatttgaagtggaagcagaagctgagacggagaaggagcggtgcttgaaggagaataactttattctgggacatgaaaaccggtgtttggtgttgggaagataggagtaggaggtggtggcggagaggctgagagtgagggcgagtgtagaagaagccatgtgaagtcccacaccgctagccgttcttcaccacatccatcactttagtgagtcatcactctttctattctggtttgtgtggctgtgcattctcattctcctacctatttcttcacaacttctaatctcttttcttttaccaatttttgttgccatttctctgccactaatcactctttcatacacagctaattttgttttttttaaagaaaaaaaacagtggaaagggtggattaatgttttaaatttgagttaaatcagagatgatctgaaattatgtacatattaaaacaaaatttaaaaatgtatacgttaagtttataaataaaatcataaaaaactgagaaatatattttactttttttttagcaaaacttgttttttttataaatataatgcatatttgtattattgttcaattgtttaaaccgactaagatcggtatagtaataagagatttagatattctatataaagtcatatcttccaatctcctttcttacttatgcatcaaaaggatagcctatatatctaacagccactttctcaaaaaatttcttctattaaataaaatttgtatgggtcacattaaaggttagtcctgtttcccatttactagtgccaacatatgagtaagtagaagggaggaagtaaaagttttggttgtaaactggaaccattctgttatataattgattgcttctgttaatctcactacacatattaataagaagtaaatcagttgaggttaagtttcgagttttgtttataactatttgcaatctttttgctagagtgattgattctaaaacaattgacaaaattttcatgaggtctggagcatgtgagaaggcaggatgggatgtcttgtgtaccgagtgattcccaatgaaccatggaaagagtcaaacttttatgacattactctgtagatcttttgccagcaaaatgagttgtaacttgtaagtgatgcaaaaaacctcattccaaaagaagaattttgccattctttagttgagaagagaaataaattgtaatattaacaagatggtagttatggcagcacgtggaattccacactttcttgtatctgagccaattaagctactctacgctcagaaacatatggtaacacgatgcttaatatcaaaacaaagtgccccattctttaccagtctccaaacaaattttctagccaaacattcctagctcattctgtttttattgcttaactaggccaccagttccttcatctctactcaaaaatagaaatagaattttcatgtttttatttgacgaaagtaattgttctcaatattttcctgatcaataattcagataaatagtcgtacattgtttatggcacatggaagtataaagatttcccattttacacatcttgtacattattcaaattatcatcactaactctacataaaaacaaattcatcagtattttccagcaaaatatctccaagttccattcttccatgaatcattttgcaagatcttttcctgattcctcatcaactttcttctccattttcctctccttgcaatcagaaaagtaaatcatgcacgacacccatttcagtgtatttaacacagtgaggagcccaatttgaacaaatatcccgtaccctcctttatagcatccaagggagacacatgacaaccttaaacaaagtcccaaagcaaagaaaacaagcatcaaaagtagtcctctcttctgattaccactgctgaggtaatacgaaactcgcaaagccccaatacgatatataccatccacaactgatatcacaaaactcatattccagatagcactccattccaaatataccatcaatagctttgcaagtgctacatagcaaattaccgcaaataatatgtagaaaccaaaacccctgaagaaaatataacagttatttactgtccatgggaatgcaatcaagagacaagataaccaaaagagcatatacaaagaagttataaatgtgcctttcattattgatatgtcaatggatcttttaaacatatccttgagactaatgttattctcttctgagcgcagctttgaagccgaatccatagttacaaccgcagacgcagagcagagccctagaacatgaagaggcaccaagtaaatgaatccaagttgaatcaaaacaggcaaataatcctcactaaaacttttaccaggtgtgtcgacgaccccataaatgtgaggatgatatgcaaaatgataatatagattatttcgttccttaaaaggtagaagtgatataatttctggggtctcaaccatagtttggtggagcaaagtttcaaagtaaaccatgattattgaatctttatgtgatctcacctagttttgcttgttaaagttttctctcctaatgagttctcaggtaagtcataatctgtaaatatacagagcatatgaccatttctatactagcataaagctccgttgatgagtcatagattatgttagtaaatatatggaactaagttcaatagttcatactctgatttgcttgggcaaaaaaatggttcttctattgaaaccttagtcttaaaaggatagcccaagcatcctcatctcgagaactagcttgcaccaacttcacgtttgtcatatttttgggaccaacctgctaagtgcaaacacagttcaagtaccccaaaaagacaacaaaaattcagtttaattaaactcagaatgctcaaatgcttaaattgggtaagctagttgctaattgtggcctaatagagatcccaaggaactaagtggcaaaaataccagttggagtgggcttttaaaccatgattttttcctacaattttgtatcaccagaccaagtttaacttccaaatttgaggttaaaagaactagtgtaactcaatttaaacccaagtcttaatatgttgtgatgctatcccttttcactaagactcatgccaaaattacccgtactcataggtgctggggtgtgaacgaagaaatcttttgaattttaaggaaaaaaacattcatgaaattcatgtctaaacattgaatatttggaaaccagtgaagaatgagcaccttgttttgatgtttggcgtggtgttatcagaagtttctgagcatacagtaacttgattggctcagatacaagatggaatagagttccttgtgccctaactaccatcttgtcaatttcacaaatttatctatcctcaaatgaagaatgacaagatacttctctcggcggtttccttctcttccctggccctctacattttgatcctcagtgtatgagattaaataagtgaactgattaattcattcatacactgaagcatctcttattattttatagtataacgtaatccttctaacaaacagcaaaaaaaaaaaaaaaaaagaagagattctctatccttaaatgtttatcttattctgtgattttattttgcaatgttcaaaatttttgcaaacatgactcagctcagcaccttccaaattccagctcagcattataattcgctttccaaaagataaaatgaataccaacaccccaattcgataaaaattgacaaacatccaacaagatagcactataagtatgagtattatagctgcatgctcaatgaagttaatggatttttagagaatattattgtccagcacaattctttcaaaatgtagtcgtacatgaggttccatttattagttagtaaatctggattcagacggtccaaagatttttctctagaaaactttgaagattcaaagcaactataatttattttacagaccctgtcacaattgagagataaatttctggtctttgccgaagtggctttgttcctgtctactatgcacagtctcaagactcaatatgttgtgatgatgttgtcccttttcattcaaactcatctatcaaaatgaccagtattatgcattaagcaacaagcttgaaccaagctatctcaacttcattaattgtggttgatggcatccattatccgtagtatttgttagacttggatggttgctggtcgaccaaacaaatactgtcctataaggactacaaaaacaagaagactgacagtgtaacaaaataccacatcgctcaagagaaataacaagcgctgaagactaaactataaaaaatgcattattccattgtacaaagcatacctttctcggccttttggctaagatcaagtgtatgttggtgattttagtgtcatcaatggattttagtagtaatgtgatttactataggccaatgctattacgcgttaagctttggaaacaagttagggtagtgcggagtgcacgcttgttgagccaacgcataattgatcgcgattacggtgcggggttccgagttttgtttaaattctatgagttatgaataagaggcggttaacaattcaaaatagtaactacttataaccgctcttgggaaaggttagagaaataactactcccaaccgctccgataaccaacggttacgatggtttatcgccaagagttgtattgtttggaaaactcctatataaggagtcatttggcctcagatttgatatatacgaaaatcatactttctctctacattcctgatctgttctctattgccagaagcagattgttcttcaaagaattatcccaacaaggatttcgtgaacccaggcaagaatagggtcgaaatactttgtttggaaagtgtacgaacacgattctttgaatttatccaggattatcatataattttctaacaaacgaacaaagtattttctgataatcatggatggaggaagcgttggaggaagcatagtcaaggacatgactactaatttcggaaagttggacaagtttcaaggacaagacttcaggcgttggcagaagaagatgcatttcatgttgacaacattgaaggtggtgtacgtcttatatactccgattccagaaattcttgaggaagataccgttgaaaatataaggcgcagatcaaagtgggagaacgacgactacatatgcagaggacacattcttaacggtatgtctgatcccttatttgatatttatcaaaatgtagaatctgcaaaggaattgtgggattgtctcgaatccaagtacatggcagaggactcgtccagtaaaaagtttctggtgactgatttcaacaattacaagatggttgaatcaaggtctgtcatggaacaattcaatgaactcctccgaatccttggacaattcacacaacatggattgaagatggatgaaacaatatctgtctcaagtatcatagacaagttgcctccttcatggaaggatttcaaacacaatttgaagcatggaaaagatgacttgtctctggttcaacttggaagtcacttgcgcatagaagaatctctaagggcgctggagggtgacaagggaaaaggaaaagaagttgctggaccctcggttaatatgatcgaagagggcggtaagaacaataacaatagaaacaaaggaaagaagcgtgctttcaagaacaccaaaggaaatttcggttccaaactgaaaccaaaactagaatgttggaagtgtggtaaaacaggtcacttcaagaaggattgccgttatgggaaaaaacacaataacgcgaatgcaagtggttcgggaaaagggtctaaggaccaatcccaaaacgaaggtcagaaatcaacttgtgatttgaattgttttattaaacattcggtttcactaatttctgaagcattttatgtgaaggatgatgctatcgcgtggtggattgattctggcgccacaacacatgtttgcaaggatcgtttctggttcaagacttttgttccagtggaagatggttctgtcctctacatgggagatcatcattttgatcctattgaaggcaaaggaagcgtggtgttagaattcagttctggaaaaactattactttgtttaatgttgtatatgttcctaaattacgtaagaacttaatttctggtcctgtattaaataagcttggatacaagcaagtgtttgaatccgataaatttgtattatcaaagtctggtgtgtttgtaggatttggatattataataatggtatgtttatgatgaatttgaatggagttcctaatgattctggttctgtatttatgtctatttcgaatgttatcaattcgtctttatggcatgctcgtctaggacatgtacattataaaagaatgcgtgaaatgtctaaagatgatttaatacctgtttttgatgagaatatagaaaagtgtaaaacttgcatgttaaccaagatcactaggcaaccttttaaaaatataacaaggaaatccgttatacttgaattaatacatagtgacttatgtgatttgcatgctactccatcattaggacataaaaagtattttatcactttcatagatgatgcatctagattctgctatgtttacttgttgcatgctaaggacgaagctttagataaattcaaaatttataaaactgaagttgaactgcaacaagatgtgaagattaaaacattgcgaacagatagaggtggtgaatattatgatcctgcattcttccaatccgtagggatcattcatgagactacggcaccttatacacctcaacaaaatggtgtggctgaaaggaagaatagagctcttaaagaaatggtgaatgccatgttatcttactctggtttgagtgaagggttttggggagaagccatgttaacggcttgctatttgttaaatagggttcctaataaaaggaataagactaccccatatgaactttggtataagaaacgacctaacttaacatttctacgtgtttggggttgcagggccgtggttagactcccagaccctaaaaggaaaactttgggtgaaaagggtgttgcttgcatctttgttggatatgctgagcattccaaggcttataggttttatgttatagaacctaatgactcgatttctattaatacaattatagaatcaagagatgctatatttgatgagaattgcttctcttttacgcctagaccaaagaactctataccgattttggatgaatctctaaaggatgatcacttaaatgatgtaccaagtgagacaatcgaacctcgtagaagcaaaagagctagaaaatctaaatcttatggttctgattttcaattatatttagttgaaggatcaaaggattagattgatgcacaatactattattgttataatatagaggaggatccaagaacgtatgatgaagctatgaaatctcgagattctgttttttggaaagaagcaattgacgaagagattggttctatcatggaaaacaatacttggatattatctgatttaccaccaggttgtaaacctttgggttgcagatggatcttcaaaaggaagatgaaagtcgatggtacaattgacaaatttaaagctagattggttattcaaggctttagacaaaaagaagggattgactactttgatacctatgctccagttgctcgtatcactacaattagattgttgattgccttggcggcaattctcaatttagtgattcatcaaatggatgtcaaaacagcattcctgaatggtgatttggaagaagaagtgtatatgaagcaacctgaaggacttgtaatgcctggcaatgagcataaggtgtgtaagctagttaagtcgttgtatgggctgaaacaagctccgaagcagtggcatcaaaagtttgatgagattgttttgtctagtggtttcattctaaaccaagctgacaaatgtgtatatagcaagtttgataaatccggtaaaggagttatcatttgtttatatgttgatgacatgttgatctttggcaccgaccaaaatcaagttaataatacgaagaattttttgtcatcaaagttctccatgaaggatatgggagaagcagacgttatccttggtattaagattaaacgggaaaataaggggattgttattacacaatctcattacattgagtttgttcggtcgcaacaaaacttagctgatcacttgacgaaggggttagctagagacttagtaaagaagtcggtaatagggatgggattaaagtccatttaaatattctaattatgatatacccaattcccttctaatacaacgttagaagcagaattcaatgtggaaagattatagttagaaattggagcaattatgtttgtcttcccaaggcatttgctcagaccagcaagtgatggttaggttgaagtatatcttcttaatggttcttttgaaaaattgtaaatgctggtacaagattaaaaggatcacctatgtgagcatgaagttttgccgcttcaagaagtttggatttggcttcctatatgcttacgaatggataaggacacatggcttgtaaagtgtcaagtatgaatagtagagtgttgtagaaaacatatgtgtacaatatcttcagatattcaaataggttgacgggttcaatcgtaacgataccctgattcttgagtatatggaatgtgtatttgtactaagatgaaattcaatcgcaagacatttcatttatgcatttgtttgatcgttatactgagtagatcaaggattacactaaaatgggggggatttgttggtgattttagtgtcatcaatggattttagtagtaatgtgatttactatagaccaatgctattacgcgttaagctttggaaacaagttagggtagtgcggagtgcacgcttgttgagccaacgcataattgaccgcgattacggtgcggggttccgagttttgtttaaactctatgagttatgaataagaggcggttaacaattcaaaatagtaactacttataaccgctcttgggaaaggttagagaaataactactcccaaccgctccgataaccaacggttacgatggtttatcgccaagagttgcattgtttggaaaactcctatataaggagtcatttggcctcagatttgatatatacgaaaatcatactttctctctacattcctgatctgttctctattgccagaagcagattgttcttcaaagaattatcccaacaagaatttcgtgaacccaggcaagaatagggtcgaaatactttgttcgaaaagtgtacgaacacgattctttgaatttatccaggattatcatataattttctaacagtgtagtatctgttcttatcagtttaatatatgatatgtggtcataagttcacatgataataaatttattttttgaggggagggtctgctacagtagcttgctattggggctctcatttgtcgcccaagcgttgcaatactgcacaggcatggcacaccccatcaaaccagtttctagtattttgaagagtattgcattttttacaacttggtatagactatctgagggaatgtcaataagcatagtaaattgtattttcattttggtattagttgtggttctgccaagaatttccgtaaggaaaatgttaaccgaaggttgcgttttttctaatagaaagctgtatctaaattgcgttacgaaaatatagcggacgtgacatatgagtgtttctaagcaccaacttgagtagtgacttgcaccaactccacatttgtaataattttgggaccaagctgcaaacatagttcaagtacccccaaaaagaacatgtctgctaaatttcagtttaatcaaaattcagaatgcctaaaatagatactaacttgcagatatcccagttggcctaaaacacaggaaaccgtcctagaaactagaaagaaattgtttctaaacctttatagaggacaattacaacatcgatgtgggactttctagtccagtagagtaaattttgtgttaaaattatttaactggcgtggaactaccaataaacattttaaaaccatttgacaatcttgaaccgaaagtagctccttcgtctgggatcatacagagatttgtaatcagtctcaagactgaccctttcaaaagacaattctgatgcaactcccaacacatggctccaccctccttagtttcgtagcagaaactgtatagcattattgcagctgctagaatttcttcgtaaaatgcactcgaattgtgtaccttgcccagcctggacagaagcatgcatattggcctgtgtatttggctgaggtggttccaatctaacgctggcttcttttgttacttaatagccattggttgcgtctgtaccgttagctgccctgtgaagacttggtacaaatatttggtttgcctaaaatttagtgtgtgaacattgagttaatatcaaaatatgtaataaatttaatatataaaatatctattaaaataattaactttattatgagttacttctatgagttttttttttctttctgaattttctgggcaagaagcaccccctgacagagttatttcattcaaagagaggcatttgataaaaaaaacattaatgatctgtttggtataatatatacatatatatatatataatttctatacttcctttgaatcttatctttagttcttgaattttcatatcatataatttagtctttaaattttatgaataaacgtgttttttataatttccttaagtattaatggctaattaagtcccacaatgcaaaattccccttctcacatgggaagaaagcagcagaaatactaaaatccttctctctccttctctccttgctgcaagcctacatacatgcctttcccatgcctccacattagttaaccgattatgtaaaaagcataataggttatgcccatttaattattgtataataacaacaacaataatattttttaaaataattataactaacaataaatataaggcaaatatataatttgtatcttcctatttttttaaatttacaattttagttctcacattttttaattgaaatattttatcaatcattttttaatttaaaatttattattttaatccttataaacaatttcaaatattgatatatgtattctattaatgttgattaatacatgtctgtttattagtcacttgacaaatgttttttttttaaattatttcattattgaattgcttaatttattaaaaaataatttaaaaagtacacaatcaaaatttaaatttgatcctagaaattaaaattgtaaattttttaaatataaagaaaaaatgtctcaattaaaaaaatgaaaaatatgtctcaattaaaaaattgaaaaatttaaaattatgaattttaaaaaataaggaacgaaaattatattttagtctaatataatatgaataataaaaataaaataaataataataatagataaaaatgaatctattaatttttttactctatttttatttaaccaaataaccaaacaacatctatttttttatctatcacttttattctttctatttttttctctcacaaccaagttgaaatggattggtacattaaatgccacaatattaatagatacccaaagtgtcggtggattcagtcccgactattaataggttggtaggttggtagcttaaaaactcacatgataaaacttttctttgtatgggtaacatttatattattgtcggttaattttttaacttaaaaataaatttttcaatttaataaaacgtttttaattaacatttttttattataaaacacgttttttatcatttaatttaaaaacttgataatatgatatgagaaatttgatataaattgtatcatgtaaagtgtcctctactacagcgaattggacttggatgagacatgatattttcattcaattaattagcctctgaaaaccaaattgcttgaataataactactgagtaataaaaaatacaccttggacccatcgtacccgttactcaatagtaatactcataatttgtagtggctgatcatgtatacagaaacggatttttaattctctaccttgtccctctctttttcttttttttctacggatatcctttcaaagtcatttctattcaagcctgaatttaatattttcgaatcaatcaaatctctaaataggatttgaacctacgattaatcagttaacagttgaccactttatcattgatttattgagaaacaattgaaaattcgaactaattcagattatcaacccaaaatcaatatgacttccaaatttccttcctggtaagacttcttcatatatctttttcatcaaatcttagttcactatattatgaatgactaatttttttgctgaatctaactttcgttgactctcttaacgaattattttaagggaccaacataattaagtgatgtttaactactcaaaatccaaaattacactttgtaaaacaatatttttttttaagaattaagtaaaacaatatattcaagcaaattcaaacataaatttataaaactaaacaaaatatattgtattttgataataaataataattaaactctataataagcataattaacattaacattaacatcaatagcatctttaaatcaagttaattgagattagtgatagatgaacctaataatagattataaataacagaaaaaaattaattgagaaggaaagaaaaaggaaaaataagacaaaaaaaataaactaaaagaaaaaaagaatgaaaggagaaagaaggaaataaagagaataaaattaacctttataatataactagcataatatatttttaaattattaacctaatgtattttcatttacttcctactaaatttttcaatactaaattttccaataattacaaagaccacatttttgcttattttttaagtgcaacagctgcactcttttctttcagtttctttttcaaggtaataactgtagcctaacaattcaagaagcattctcctctcatttctttacagtaacatagcatccacacccattctcgtttcttcatagtgattgaaacttgaatctatgaaactttgaaaacttccgtaccttctcagtaaaattctgtactagtagtgtcacttttgcaattacttcatatttttcactagtatatttaatatatcatgatgttgtcttgaactaatttatatcagcgccttaatcttatatataacattcatatataattttaattagaatgaatagtcatttttgtttttgttgtgtaaaacatcgataaattcattcctgaaatgtgtatattcaaattttagtttcaaaatagaaaaagtgtaacaactttatttaactattaattttcgtccgttatcgttaatgaaatgaaatagtatacgtgatatattcaaaaaacgaatttgtcaatgctctacatataattagggacaaaaatgattttttatccaaaatattatttaatattcatcttcctcccttttttaatcattaaaaaaataatattataataaatactttaaaaaaatagaaaatcacacataaattagaacaaataaataataaatataatctatttgttgctctgaaattgttattatgacacgattagataatgacaaaatcaaattagatctcattttttgtaaaaattaacttaatgattatgcatttttatttgagtctcatatttgaaataatatacccgttgcttcaaaaacttcaaaataatagacaaattatacttattaataaatattatgcttattattatatttgttttaacttatacttatttttctattttttaagtatttattgtagtattatgtttgtaaagattaagaaaaaaataaaaaaataaaaattaaattatattttggataaataatcatttttaatcctaaatataaaagatactaacaaacttaatcttaaactctttcattaacaatatcatacaaaagttaacaaataaataaatttgtcatatttttaaatttttagagactaaaatttaaattttcttagaagcgaatttatcaatattttacatattcaataacaaaaataattatttaatcttttaattacaaagagggaatcatgtgttaaaacagtaaatacatataataagaaaaaactttggggcccatgactcctccgccaagtgaagatccgcaactgctgttaggcaagatttctaattcgaaatttgcaaatgaaaaaaagaaattgaaaggagagacaaagattgatcatccacagaagatgtgaatattttgtataaataagatggtaactccaaaaaacctataatttaaacatatataatattaaaatgaggtcaatatattttattttataaataaagtattcatatttggttaatttttttgttagttcactaattgtaaagttacttctaattaagaatgaacttagataaattaatttatatatcaataaatcgttggtgtggatagttaaatttagtctttttaaataaaatatttaaaatcaaattaaaaaaaatgtgattaagagaagaaaagttgaccactaaatatgatcacttaaattttctaataaagattaatcatcaataaaatagataaatattttatatcactaacataattaacaaaaaaattaatttatatttaaaaattactcattaatttaaaaatagtttgacaatatttaaaaaaaaaaatcaatacagagaaatcttttgctctaataacacttaagaatgagtaaacagacaaggtggggggcgggatcactcataggaccacgagacacataaaaacaacggtgtgaacatgtaccatctcgcaggcaatgaaaattccaagttaggcgaaaaggttatgacttatgagacagattcgcactataataggttccaaaaaccaaaaagaaatcagggaaaagaaaagacatttgcaatggacaagacataacacaacccctcttgctatctgttcttgtttgacattgctccgacctctaatcctcgtgcatctcatccgaggtatattatctggtttggtgcttaatggtctgtcatgattttgtgcttaaaagacaccttctaagaataaaaccgtgaaggaccattttgtgcttaaaaaacatcttttaaggataaaaccgtgaaggaccattgagcatcaaaatgaagaataactcaaataatatgatcctaacagacacaaaagcaggaacaggtaactttctcaaaattaagatgcaacagaataaagttgaaattcatgaggtctgtaacaaactctgtacaagtatcaagctctaatgtataggatccatgctgacgtacgcaaatctgttaccctagctgaccactaagccacaaatattaaaatttaaccaacaaaaaataagagggtcattttacaaatttctaggggttgaagaagtggtcaccacaatggcatttccaccccaatggcttgtaattggagtacctgttgccttggggagaagaagggttaagaaaacttgccatcgcagcagttttggtaagatctggaggattagagtcatggcttggcaaagttggcacttgaactgccatgcatggatggcaatcattgcacttgttgtgacagctgggaggaattgaacctagcctgtttttctcctcaaataacagttcctgcacataacaaacaaaccacattaattttgtacataccctccattattagaccatgtacacatacacatacacacttgaagcagttataatataaacaaacatggcttagactaaagcttacccttggagaaattgcagactgagggtgattggaggcagaaactagagatagagagagcaaattatggagaagaagtataatgagcaaggaggcgattgtgtagtaatgatatgaattaagtgcagccatgaatgcatatgatcatgtcaccaccccttgaagtcattccccatctaaaagagaaaactagcttgggtggtaaaatttaatgcgagttaactgagatccgaatgccaatcctctgaaggaactttatcaggttgtgatgtgaagaagaacccaaccaagagagagaaagagagacagagagagagaaaagatcaaaactcaaaaggaagaaggctttttactctattattttccagtgtagagtagtgcttttcttctcatggcgtatagcctgaagaatgaggagaagagaggtacataaattggaagatgtgttggcagcaatagcaagcaagtagagagagagaaagagtgcagtgcagaatgcagactgtagcagaaaaagtgaaaggaacgactcgagagggttaagcaaattgggagaatccacatcagtatcaaggggcccccttggacagtgttctataagtagtttgagggcttgagactttgagcctggttattagaaactgcgtggataacaaatggccttgtcctttctgtgtgcttaaaaatatcacagacaagaggggatagttcaaactggcatttattatgctaactaatttttgtctcagttttcagtttagcgatttatctatttgactgtgattgactttgattactttacttacacctgattatggcggctagtgcaagtaatttgtgtgctttgtctttgttaatgctatagaaaaatgtggtgtaaactcaggaattatttgagggtgaatctgattataatgataaagttatattttaataatttattgattataaatttaaatttaaaaataattttttacatatataaaattataatatctttttttcttatattgtacaacgtagaacattgcataatggaatcactagtcttttaaactaacgaatcaatcaaatggaggactttggattttttgcatgtaaagtatgaattactgttactgacccctcaagtttgtatattgtacagaggacaatgaaattgaatgattaagtacgggtatttattgcctattttctttcaaatagaacttctccagaagtggtcccatagttaatactcttgttaagttgatttgaaaggtacctgttactccttaaaaaaaaaagttattggatcaaatggtttcatatttaaattttttaattaaggttcaaagtttaatctataacttaaatataaaattatagttaaagatatcactttatctcaaaataagatgatccaataatgaaagataattagttagataataaataaaaaatctacagttaaatcaaaactcatttcatttaacttcttaatccaaaacggaattatatgcctaagatatacataattatttgtaatcacaattaggaaaatggtgtcgacattttttctgctgcaaaaataattgagaccaaaatgccttaattccgtattaaactgttgaaatctaaagtatattattatttagtggcgtgtggggattcatttaaaaatatatggaagtgtaaaactttgttaaaaagatttacacaataagaatcaatttgaaaaattaatgaaataatgataacaacaattgcatttttttcttgctttgatgcttttgtgtaacaccatcacttttagtacataggttattgttgaaaattcccatacattcaaacacacattttaacataagctgtttataaactttctaaaattgatctagcacacatcaagaaagcatttcacaccaaatgagtttcagggcatgtgaaactattctcgtttcagtttccttttcgaggtttcgggattccttgcagtgactctacagctttcaattagtcaaagctgccattagagtattgacattgcactgagagggattgtgactgtgtgagtgaccagacctagctacgcatcatttttgccactgagtggacgaaatagatgtgtctgcaaaaatgaaaatctttccattttgtacagcctttacccattcttctaaaaactccaccagtcacaaatgatgtgctcagcaatcttttctttgcttcattgctttttaatcgatgattcaattatttttaccattagcagagaaaaaaggtcgcgcgaaagacaaggacactcagcttgcttctcttacatctattttaatgtaccttccaaatccaaatccttgcttgctctgaatactgaatatgcattttattattattttgaaaacaaactctatgggtgggggttcacacacattcacatgcaatcccggatttagcggcgttgatagtttcgacaattgtgaccacaaaccaggaagctaatatatgcaatgtgcattgtagccttgtattgtaggcaatccaagccagtttagcgtagcacccgaaaaaaaaaatggtttagacaagtttaacatcccctcttacaaaaggaaaactaatgttaaaaactaatgttaacgtcgtcgttggtttagacaagtttctaagtttttaaattttaaaagattaataaatggtcaccgacatcatattatctttctttttttctattataaagttagacgaattgaatctgaagagctcaccaagatcgtagtatatctcaagtttcaccaaacgattacaaaggtattcaaatatgattatctaccaataaaaccctcacatcatcttcagaatttgaacttgtgtttttgtgggatatgaattctatctttaccaattaaattaacttttgttagtcgagaccatattatttgtaagcattaaaactcattattaacctttatttttataagttttataatttatttaaaattttaaataaggctttataatctaataatgattaactaagtttcgacattatatacaattaaccactgttggtgtaaagttattttcaatcaatagtttttagtttaagttatgaacatgcagttgcattaaattaaatatttggagttaaaaatctacctaaaaggagaataaaaatgtaaaacctaatggagattaacccaaaattaaatcagtcgtgtgaaacgtgactgtaacatcccgtgagcatccagtgtattaacatttattatatcagaatgacgcattaaactttaattaaaacttgcggaagcatatacgaaaccatatttcttgattacattatgtatgaaactcataaaatttaaacatcacagcctcactagctcttgctaatccagaatcacaagaacataaccataggcagataatcataaatatctcaacatatataaataggaggagcatcattacataacataaactagttatgtacataaacatcatttgatactcacagtgtccatacaaaagaataggcatacatcgccttaatctcaaagatctttactcacacgagggtatacagagtatgtacaaaacaaaagaatacatgtgtgcacacacacacatcttccctctataaaggtacaaaacaagcatcaagccaaaacgagccactcggctctcatcctgcagcccacatccatgcaagaaatgtctctactggggcctcccgccctgagaccgttcctctctgccataagagtcacttgcccacacggggtgagatatacatctcagtaagctcaggttccttgaaggcatttcctccaccctggctcactttcatgacacgcgtcatcaaggcatcacaaacatactggcctcctggccctcataacaatacaagcaagtcatcttactctatgtacggtggatcatcatcaacactaacctcagtgtgagattgaaactcacacccgtaccatcccatctggagctaccccttacgcatggatgcacgtatatggtgcctccgagaataggcttcaaccgcgacgggaccacctatctcttgattttaagggatcatcatcacccagggatcatcatcaaccatgagcaaaccaaattaggaggtgcgctattctcctagggaggtccatatccatctaactggcagaagatctaatcacaggtattcatacacatacaagcatagatacaagcatacatatcattatgagaatgcaataaccatcaacgaatgcatcatgaatgcaactatcactccctcggagtgtggtggaacacaacaagtgggaaacatccccaagagaccaagaatttacctggcaaagtcgtgctttacaattcagtcccaacactgtgggctacgccactgacaccctcggtgtcacgccctatagaaaggcacacaagcacatatcaaacatcatcctatccgtacaaagcatatatttctagcaaaacatacggaaaaacataaactgctgcataaaattctgcagattttacacccacttaaaaaaatcacaaatccatgtgggaagctcctaaaatcacgagaatttagaggcatcaaaatttacctctcatattttaaacaaaactggtttcatccaaatccatgaaccacaacctctgcagcaaaccaaaaactagaactgtcacacactacaatagttctgacagaaacacactaactcaaacagccatctttcaacaacaacccacaccaggttactcgtccaaatgagctgatattttacaggcatgaagttcacatacccatctttttattgccactgaaagcactcgatttggatcatcctagacagatttatgatttctgcaaaatggacctctgcaacagaaaaatctgctaaaaacagagtataacagcttataataactctgcaccacaatttctaggagtctccaaaaatagcacgaaaattccagaatagacctaactcttttagctttcaaatggcactggttttagatcatttggacaccgataactcctgttatggacaaaacaccagaactgcccaaataggtgttcttggctgtcatgaacacgcatgcatgatttacgcatggaacaccatatcaacttaaaatcaacttctacccactcaaaaacatacttcaaaactgtcccaccctcctaaaactcaacattcatcaatctcactccaaaccctaaccctaacctcaagaatcaaggagaaataggaggaaatttcaaaccttagagttcaatagaccaaaatggatggtagaccagcactctatggcttccaatcgcggttcagcggcgccgaacgaaaatgggtagattcaaaacccactcttctcgtcaaatcaccaacaccaaagctcaaaagcaacaaagaacaaggaaaaatggttttctttcttgtttgctttgtgatttcggtcactaatcaagtggaaatgacaagaagagagcttgagattgaggagaaaccagaaaagaagaaaagagcaaatggcagaaaacgtgttctgcttcttttgaacatgaacccgggggtgcgtccagcaattactaactacacccgtacctccgataaagaccaaacagtctttactttcgtaaatccgtttaattacacaaataacacccaaaataccttaattaaatttagtgatattacagtgagagcatacatcgacaaagaagcacggacgggattgtgctacaccatgtccccgtaaataactttgaaaagttgagcttgtctagaatgaattttagaacatctataccaaattctatttgttctttgaaggaaggtgcataagagctttaactttagccgggaggctggtttagtgaggatattctaggcaagatcgatctactttttatttaactttgcagtacatatattttatatgagttccatttcaccaagtcaagtaaccacattggttgaaattatttctaaaagttaacaaaaaataattatttctccaaaagatgcactacatataagagtgtgttggaaaaaacgttttgctaatgttccattaaatgtaaaccagagaatcactcccactaaaatcctcttgaaacctctagagtctagaatctagatagtgtgagctgtagtccctttcccttgtgaataccccaaagttccgcctttatgacggtacttgatcccaaagatgacgtgaggcctactataaaatggcaaaggtgatctcttaggaagcaacctgcaacagccttcttagtttgcaaattcaaagccccatcacagttgagtttcacaaattcttcatgagggctgccaatttgaacatagcagagaaataactggtttcttttaatccagtttatgtataacttttcgaataggaccaatcggttaagcagcagaaggacccgaaaggctgggcagaaaccattcgttgaaatgatgattatagaaacatatcgcaagggataaaaaggtctttctaccataaaatcttattaagatccataattttaaggggttttttttcttccactgtcaacagtagagttcaatgtgtaggatcctcgaatagattttactttgggtaattaccttgaaaggatatgaatcctttactcacggccttaaccaatcaacattttcaatatttatcaatgaattttgatcaatgtgtaggatcctcgaatagattttactttgggtaattaccttgaaaggatatgaatcctttactcacggccttaaccaatcaacattttcaatatttatcaatgaattttgaaggttcattttaatatgatacagaaacatgcaggggagaaagaaaaatgtgataccgagcctttataactaccaacataagcatgtttgatggagaacagcttataaacttgaattcaaagtacatgcacaacccaacagatacgttcctgaacttttaccctataactggacagagttcaacaaatgcccccacattagtttgtcttgactctcgtgtaatctcttctcacctgtatccacaacaaatttgaggtactctggaaaaacgagtaatcattatttatgtgctgataaaattctggtaattttgattttctgtaacaatttgatgattcagtgtacacgacaaaaaaaaaaaaaaaaacaaaaaatattgctccacgatttgccactttgaaatttcaggaatttccccttactttaacccaatcttcatatttggtgcacctcctgttttacctcatcctcggctgaattagacatttctaatgtgtcatgtcgttcactggtttcgtgcttgctttcccatagcttactagccttcccaattgcaagaatcagatcaagttgttttcgctgttgttcctacatgaacgctcagacacaaccaatacaattcaaactcaactataaaaaaatgaggatactttggaaagtaaagcagtcaagaaaatttttactgagccatatacggtcaaactagatccatggtcaatatataactttttacattaccaaaaaattaaaaaagatatatctgaacacaatgaaagatttaggatattcgacgaaaggtaacagtaattctggtgtgtgaaaagaaaagggagcatagattgagatgatttaggtatgttatgagacgaccactggatgttcctgtgagagtaagagtttgttaccaagagctcgacacaaagagaggcagaggtcaaccgaaactcacctggggaaaagtagttaaacaagaccaaatagagtgaaatatagattggcagacgatgtgtctaacgacggagtggagaaaaactttaagcttggtggagggttgaactcattattatgtctatgttccagtcgtttccttttttttagttattttcctcttcatttctctcctcctttaaccattcttttattttagctcatttttcctttcttttgtcttatttcccctttttcttcctatcttcctttctctttctttgttttttttccgatctatcattgggtccatctaccaccgacccccaattaacttgagttaaaagtgttgttgatgttgatgtgttttagcatgggtggggaggaggagagggatggggattgctaaaatacacccacttgttttacactcaagaatcaatttcccacaatgcacatgttccaagagcaaaatttgtgagtaacttttggtcttaaccctctgattcatcaagagaaagggaccctgattaatctggagttcagccgggacggtaagtaaagttcgaccaagaattgtttccgtcaagaatcaaacttagatactacctaaacgattcaaccttaacttcaacacattaaccacttatgtccaatcacttgattgtgatagagtaatttgaatacatatcccaattatgttgaatatgttaacgcccataattctacccaactttaaaacaaacaagccaatagtttgcttacatacacccacatacttctaaaaaatagagaggtgaatgtaaattataggtttaaatacattttgtgtccctatagtctactcaaatttggttttggaccttttggcccctatgttttataagttcggtttttggtcccttttatgttttagttcctgcctgctatcagcgatacaccacttacccttcaagagatagcctacactatagagaccaaaaacatttttaaactaaattatattatacaattacatgcacatttgatttgtaaattgtgcctgcactgtcaggcagagtttaaataacatgggaggggaggattacctgcattgctagtaaaacctgttgaatttcaccaagttccttctccaaaatgtctgattgcactgctaatgctctagcagcctcagaattcttctgggccaaagctgcagtcttaaagaaatgaacaaataattagatatcttttccagtcagatttttcaatatattaaacttcaaccattatgttaccaagggtaggctaataaacatttagtgtacatattcttaatttttacaaacaaaaaataaacattggaaatttccttgtactagcaattgaaataacgtgaaattcagtacatgctacaccatagacatgagtttaatcaatacctgcggcacaggtatggccatatgggtatgtcatgtgtattgtatccaacatgatataaaatggcaatgcagaatttaagtgtgtgtgtgtgtgtacagaaagacacaaaaaataaatattaaaaaaaatatggatgaagttaatatagaatatttaacaatatatttcatttagaagtaccaaagacaaataattggttttaagcgtccactgattagcttctaaaaaaaatgtgatcactgactattagcagcttagggttttgtaaacaaaccaaatttgtaaacaaacaaaaagcgatcaggtgtccaaacatgatttcaatattgatgaaaatgtcaccaacgatgggtattgaaccatgtatttgatgaaaatgttgaagatggagacttctatggggatgacaatgaagaactgatacatgagtaatggcaactagcaagggcagctggtgttaaataagcaagtaaaaatacctgaaatctgagccaaatggctaacacagcttagtaaggagcaaaaggataccaaagagatggagcttgatttggatgagacataaaatgatgttcaagaaagaccaaaatctaatgaaggagatgaaagttctagtatttaaaatgattcctggtagatataaacccatttatagggcttccacctaacagcttaagcttttgggagaagttttagaatttaaagtgattctaaggtatctatatccaaatgtgtgtctggttgcacttccgcagcgcacatattgacagattttcacatccaatccataaaattaatacaaaagctagtgtaatttgcttcaacaggatgcccatcaatcttctctaatccctgatgtgcaaccaagtaattaggattgcagtccaatccttgccaacctcactctaaacaaagttaaatttcaaatttcaatgcatgataacagaagcctgtgcatagcacatactacaagctcaaagggctctaggctaagcaagtgagcaagatataaaaaccattcacgggcttctacctaacagcttaagtttttaagaaagctgatccttgactacagctatggaactgaatccagtgatggttccacgaatctatttttcttataaggactttgggcagaaaatataggttatttatgtctttttgttatgaattatataatttgaagagctgccaaatttggctaggatcataatcttcagagtttgtcagcaacttattgttaaaataacaaagctattttactatcagccttaggcttgctctcactactacttgacctgagtactagtatcatcaagcaaactcacttcatattacactaaaaccatacactcaacctaattatcagtatcatcaaacaaactcacaccatactaccccacactttcagaagcgcagttctcattactttataattttttaaccattagaagttgccaatgatgcattgcatatatggtcctcactatgctcggcgaatgaaatcccaacaaactcagtcaccaaccacattccacacacgaacacgtgcgaaagcagaatcacaaaactagtgtagcaaaatgagaggtagttacctcagctatgggatccttcaaggccttccttgtaaccctaaacctaacccccaatttctcgagctgtctcgacaaaaccctaacaaccgtcgcggaactcctcaagtcctcctccaacttctcaatcctctccagcaagttcacttccaacccgcccttcccagtctccacacacgcgcgcctccactgccgcctccgaatccatgcgccgactagaaccccgaccacaagcaacgcaccgccgaacggagcagctctggtaccgatccccgcgaggagctcgttcttggaacccgcgactacggcggcggcagcgtacgctacggcggaagagagcaagcacgagaactcgagcagcgaaaggagagagtcgaaattggaaacgccggcgacggcgacatgttcggatcggaggtgaaatgagtcggcgcggacagtgagggaattgaagcgttgagcggtgaggttaaggttttgcgttgtgaggtggagaggacgcgaggttacgatggaaagagagagagagaggttgccgtttctatttgtggtgcagagtgagtgggttgaggttgaagaaaccgaatgagggaaggggtggtggtaacaagtgagtagcattgtttgttgcaagtggcgaattgcgttagtgagtatggagtagaagaagcaacattgattggagtatgagtatggttatagaagagatatcatatcatggtaggtttctgagcagcactttggtgacgatagcttcgaggggtcgactatatgcaatgcagggctccatatcaccactggcactgagtagctgaaccaggatttcatcatgttgtccacatttttctttctttcaagagcatttgggaaatgtgatcttttatacccttttgcttcttcaagtgttttctttaattggttttcatatttaaacttttttttttaatattatatatatatatatatatatatatatatatatatatatatataagaattaggaatgaaaacatgaatatttcatacttagcaagataatactgtagaaaaaatggaatcattttaatattaaattttcatacttatcatgtatattaaatagtttcgtttaattttatctttaattgttagatttgagactttttgactttaatatagtttgaaatcaacataaattgcatacaaccccttgatgctgcaacatttcggtcttatacataagtattttataagctataacatccccttaagtatgggatattgagatagccagttataaaattgtgatgatttttaagctttactcaactcatttttagcaccacacatgtaacaaaacttacaaaatttaccgtgctttattttaatttttaaccaaaaaagtcaactcaaatctttcttttcttctcagtctcgcctgaatggaaacaaatcatttcctctgttacttttcttaaatatttggacatagacagaatgataaatcacaaaactcaattagccagcatagaattagagcttaaaaacactttaaaaatgcttcctcggtctcctctttctttattggatagaggcgtttgtatttaagaggaatgctagagtcaaactctcactcttttaaacacactccacgttactgttccctagcataggaccagtaattatggttaaattttataaaaccagttatatgaacacaccctactataaaggaaggggggcgcaagatagaaattgtcttacgacctatatgccataaatcataaacccaaaatgtccagtaaaacgccattcatatttcaatctctaatttgatcaaattttggtaccaccggacagaggaggaggcctgatgagtttaccaaagggtacatctttggttggtataaaccatagactgaaaagtcactaacataatattcaatggcaattgtaaaccatcttccaagaactacgcaagaaaaatgtaaactcgagcatcctaagacaaattcacagtaatattctcaatcagagtatataatactgaatgaagatagtgtcaatgcccaaatcaaaaaacttatgctccaggatgctccatcttcccaatatgacacattccgcatgaaacttctagtggtacggcatataacgatttggccttctaaacctaggaaccttcctgcaggatatttaatggaaaatgaacgaaaattcaaaacatcaatcaaaacaacagagggcataacatgcaaattaaatgagtcacacaacatacccgtatccataaggggagtaaaagtaaggaggagtatatggcctcctgaagccatatgccatgtaaggattaaagcgcctaggacgatattgtttcattccaggaacattggtcctcttaggcaaaacctggaaagtttccaaatgattaaatacaactaatttaaaagaatgatttcttggctgattgaaacaacaatagcaaccaaaacagtaattcaaatagcaacacaattgaatcaatgtaccttcaattgacggccatgcaattcagattcatttaacaggagagcctcttgaacagcctcagcttcaacaaattccacataagcaaaacctttaggctggccaaacttgtcagtcaggatagtgaccctgtttacagtaccacaggactgaaagtgttgctgaacttcttctggtgtgcatgcataatcaacctgtaaaacacaaatcaatttcaaggagttttgatgccaataatatcatgttaatccaaaaggggcttaaacctgattcagttatcataagaaattagattccaaaattacagattgcatataaacaataatattgttagtaaaatttataatgttaaataaatatctttacttacaaccactctgtatagaattctccattaatataatggggaattcaataaattgctcaggacaattcatatgagaaactccagagcatagttcctcttatccttcaattctatcttttagattattacttctctttttagcgaaatatttttacattattacttgtctctaagaaaggaacacaataaaagcatataaattcaggacagacctctgaaaacatcagaacataaccattctaccctaaaaatcaaactgactcagtttattttattttttaaaggatggcagaccacgcttagatctcaaacattagtgcaactcatcatcagaaatatgcattttcccaactccccaaacaacagaagaagtccaccaattcttactccataaacactttcaaactgactcattctattttttaaaaaaagtatgccaggccaccttatatctcgaacattgatgaacaattattttttctaactacaacatcaacagaaatgtgcattttcccaactcaatcatgagaagaatttcaacatttctaactccatgaaccaccaactccaaacaagatggaatcccaaacacaaaacctaaccaagcaatgcaccctcctatagatgtaattttaattgatgttcatagtcattttacaggctcttctcaaactctagataaaactcttgccttctactccttagattcatcctcctcatagcaaattgacaatcgcatcaaccttttctggtctacaagcagtggcagatgcactcacagcattatgggggcaattgcccccacaagcaattttttttacttaacatctttaataaaaaaaaatattgcccacacaagaaaaatagtgatgcccccattagacaattgtttattaaaatgaaggtagaaatttataagagataatagagaaaatacattgatatgtgtagaaggtagttgtaatgtatagaaacttagatattttagatttttttgtcatgaaattatgtactttgtaaaaacttctgtataaatccagttgggaagcttggtaactaagtgtaacttattattattattagttgtaactcaatacccattagactatttttttgtccccactaaaccctaaaccttaaacatattaagtcagaattctaaccctttctgtataaattgcactaatcaaattttgtaagaagtgatagaagaggagtaaagggaaaacagaatgcaaaataatcattcacttgcaacttaatgtttgtgtaacaacttgaaatgagaaagaaaaagcctcaaatatcaggtagtttaattcacagatgaaaaacaattacgagataaaaggccagtaggcaagcagcagctgcatacccattggcacattggccaaatgacacaacaaaggcaccacacacctcactgcagtcaacaatagggctctatgactaggattgcatgcccaacactcacagaatgttcttccaaaagaaccacaagctgtctcctccaggagtgcagttgatgcatctttaacacattctactccagccgtaccagtttgagccatccatgaaatgctactcagtttcctccacatattctttattttttctttctcttcctcttctatttctcattttttttcctcaatttgatctattttttcttctgtataatgtttttcttttcttgccttttttcttttcataaacttagtttttttctcctcaatttttttgtctgttttccttcatgtgatatcttaataaatttcataagcacaatatactttctttttttctctctaatacaaccctaagaaacaccaattagattgtcccacacacaaaatacaatgtaagcatcccagattcccagcgctaattatagaacctgagtaataagaatgaccctgcgatcatagtcagacaaaagtcaaaccttgtctctgaagtttaacagtattcattccaaaacaaaacaaaaagcagtatcaaatatatcatagtaaaataatacaatgaaaagaagcatctagaattcagttcaagatccattcaactaaagtttctattgacacaactaatagaattacagaatgcttcaaaaccaggcaaaattaacagatgattgagatattaattgaatagataacctaactttggacaagtctgttatccctggtgataaacaagggcaataaatttcagaccaattcatcctcagttaggtggtttaatagccaatttgtaagttatcggttaaaagataggaccaaactatttggcagatcagtttattagttcaaccaatcaaaccagaaggtctgcaattcacattcatgcaatatgagcaaaataagacttctaaataaatactaaatatagttcataataaccaaatcaagattcaaattgaaaaactaatgatgataaaaaaaaataaaaaaaaaaacaggataggataggattatacattgccaacaaaaacagatcgagaatctgcatcctccttgtttgcctgagaagcagctgaattagcaggatctgcaaaacagattcaatctagaagttgaaaaataataatgatgcaactctatttagatagtagtcacgtgatttggtaaaatcaagacttcacaaaagcatatctcagcaaaagacattttattttatatcatgttttgccaagattttaaccatagtcaaggaatgtaaatataaaaaaaaatatttcaaataaagtaccttggttagaaactaggaactaatcataattatcaatttcaaatagtgatatgcgggccaaacccaaaaatgctacagcagtatagcacatagcaggagaactgctattgtccacaatttcccgcagaaacaagagtttaagagatttttattcaagctctgccgtgttttaggttttatcaataatcacaaaagatgagtttaacgtggctgttattcgagacctggtgagcttaggttttatcagttgccataaaatatgattaagcttctgaatagcgattgatcgaaagagtataagataaagttgacgaattaaaatgaggataatgaaaaaccttgaacgctgccaatctccttctcgaccttggcttgcatctcgcgaagcgctgcggcttcctcttccatttccttcaatcggcgcttcatctcgtcgagctccttgacggcggcgtcatcgtcggcggcggacatgtcaatgtctccttccatctctccctcgtcagggatctctcctccgtacacctcgtgctcttcctcttccatcttccgattctacgcgatctgccctacacttcctaccaacacaattgcaatgtaaattagggttcttgttctgtatttatttggggaatcacactgtgttgttccaattcggtggagtttagactttagggttcgttgagagaaactgagagaaaaaaaataaagaataaaaaaaatacaattaaaatatttcttttttgtttggagaaagaaaataaattattttgtaaatacaaaaagtttaatttttttttcttttcattttctttcttattcaaaattttgaaattttcctagctgttttcttttcatctaaccaaacatgttagagttttacttttactacaggatcatttttagcatttgcggtcaatatttgtttttacataatttttttatcaaatttgttttatatatttattttataatgaataatatattattacattataatttaattttataataaatattcttttagtatataaattatattttaagtatataacgaaaaaattagtttgtgatataaaagttaattttaattattgaaaactaatttacagataaaactaaaagatgtatattagaaaataaatatttattgtcagttttataatttactttatttgtaaatatttattttctaaatgtaattctcaattaactgtcggatttataatttaggtccaaattcataaggtgaataaaatgaacttgagacaatataagaaacttcataataaataaaaatgttatatgtatagagaattttggatttattatttttaaattattgatttaaaaatattttcagtttaattaatttctttaaatgtttattattttaattttgttgaattgactcgtccctccttataatttatgtccaaattcaaaaaaaaaataaaaaagacaaaaatgaacttcaatactttgtaataaagtttataaataagtataaataatatagaattttttactaaaagtcttttagcggggatttggatctaatcaattctaacttttatatttgaaagataatttagttaacttgatttttacaattctttaattttgttatgttattttaatttactagtattaatcatccgtaattaaccaagtgaatctagaaagtcttataaattttttaatatatgtctttcattcatacgcattaaaaaaaaaaaaaaacatccataattgatacaaataattaataataataaagaacctggaacagattcatcttttatgtcgttttagctcaatttgggtttagctagccaaaattttatacaaataaggtttttgccatacttcaatcttatttcataaaatcaaattgaacacggcctttgaattattataacttgaaacacgtattaagtatttatctggatcgatctaaacccatttgatgaactgtataattttaattttaatttttgaacatgaactttaacccatttagtttaattcacaaaaacgtcaatatagcttgttccttattttagaaacctaaatttaatctaaactttctagtctaacttgttgtaaactatgactcacatcgaatttaggatcaacttagatttaatctcgcccaataaaatgtgggacttcggatacaattttttagcacaatttaaatgtaaattattttagtctaatttgataattggtcaatttaagtttaaaaaatcaaataatttgaaatttcattgaacttagattatatttgataaaatatttcaattagttacttttttttattaactacaaaacttgtttgactattcgataaataaacatttttaataatttattagtagtttttaatattttttgaaatatttttgaagtagcctttttaaaatactaacttataatttataacttttatatttttctttcatttttatcctaaatatatttattcaattttctaattattcttttaaataaatcatgattttatttatattttatcattttacactttttagctattttaataattaattttactaagtatttataatttaataaattagttttttgagcttccaactatctattctatgagttttgccaaacatgaaattagctgaaaactacaaaaccaataatttgttaactgaatatttagctagctttcagctttggtttgttattcaactagtttattttttatagtcatcattcttaaataaatcacaaatttattattttttttgttattttacatttttcatttacttcaacaattagttttaaaaaatatttattatttaacaagttagtttttcaatttttaattactcactctcaagtatcaactaactttttaacttttaattaacttttaaactaattttaaaaaatataacttaaatataattgataaaatgtaagacttcaactttagagtttgaggacaaattaaatgtaaaatttttgtgtatttaacctaactgtttctaattttatttctcctcaagccttattttcctctcctgaaattatatcttaataaaatattgaatttaacaatatttttattttattaactatgattttaatatgaaatatttattaataaaaaatgaatattttctttaaatatgaattatttcatatttatatttaattttaagattcgaatcctacatcatttggttaagaggtagatatcaatatcacttgtgtcaactaatattaataataatatttatttaaaaataaaattagttgatctaaaaaaaataatgttgtgaatattttaaatagttatttgcaacattaatgtctggccatgacccgaaatatctgtatttgtgtcaacagtactaatcagacaactcacccgagaaatccgcaaccgtagacgctgcgatcgctcgaaagtaaaaaccaaagagctgtcctcaaccgttcttcctctcatatttcattaatcatcaatgatcaaacaccgcaatcagtttctctgtgtacaagcacccaacaactctttatgcaaacctgccacttctcattcattggtggggagacgcgcttcttcattcccacctcattcgtgcatgtgtcacgtgacacgtgtcccacccctagtaatcacacacgtagtgtaccataagagttttttttttcaatcttaatattcatacttaatattcacagttaaaaacagaaattaatttttgttgaaaattaggaagagacaccaaattcccaaacataattttcataaaaattcaaatttttaagaaatcagtaatcaatctctttcactctatcacttaagtgttaagagagagatatacaataaataataaataaacaactaagtgttcctttaataaaaaaggcaataacaaaaaaaataaaaagagtgtggcatttaattggttttaagttttaaccttaaagcgaaagaaacaccaaaagcgagacactatatatatgtgtatgtgcaagtaagtgagttgaagatatattattgtgactgaacagaaaaagtgtagtgggaaatggcaggtgcgggtacaggaggagggtatggggacgcgaaccagaggatagactacgtgttcaaggtggtgctgataggggactcggcggtggggaagtcgcagatactagctcggtttgcgaggaacgagttcagcttggactcgaagtccaccatcggtgttgaatttcagacgaggactttggttatcgatcacaagaccgttaaggctcagatctgggacactgccggccaagaacggtactctataacttcttttccaactaacttttatcgttttccatagtttcttaatattgttagtttcggtttgaatctgttaatttgcgtcaccgacgtcgtttcgcgcgtgatctgatcgtcgcggcggaggatcgcgtggatttgtgttttaactaaggttactgagctgatctattgtgatcatcgcgttgtgtattggtaattgatatgtgactgaagcacgtaaaggaaaaagagacggtatagattatagaacatggacaaggatgagtcccgggactttaccacgaaacaaggaaaattcgatccaataatattcattaagtggaaaggaagtttcttattgctaccaattcgtgttccacgaacactatatgttgcttatcaccgtgattttcgttaattttgaaaaaaaaaattatttattttacaattgagccaattatattaaaacatctgtttcgtaaaattttctttttctttctacaaattttcgtaccatttagtattgctagagtggaaaacatacggcaagccgttttgtagtttacatgcagtttcatggtaatattttatattgcgaaatattgttaagaaatctggcttatatggccacaattgtagtagtaaagaccaaaaaccttgattttggactgtagttgtgtttgcaaataactttgtaaaaccttgaataaggttttaaattgtggtgcctccagttttgtcacaatcctggatattgtgaaaaattgttgacaaatattgttaatatggctgcaattgcagctgctaattaagaccggcaaaaccttgaccttgtggctacagtaatgattgtagaccattttctggttttgaattagaagtagttatttgtacagatgactttgagttgtgactgtggtctcagattctcagttaccgaaattgccgggatgctgttaattccccctctcagttttttgaagttcgcaacggtatggaacgaatttctggccacaatgccactgttttcctgccttttttggtgtgaatgatgcagttattattaaaactccaagctcccgttagatttaagcttgcatttgcattgctggttgctgttattgtcttttcttatttggtcgatcgttactgctattgtctaatcttttatgataaatctatgtcaaggaattgatgctgatgccttctgataaatcgttatacaaagttgttgactttcaagctgatgcatctctgcatttggtttttcttgctcgacacataatactctacattctcaagctatatgacaaataataaatttttaaacaaaaggaaaatgaaaactgaatttggaacatcgcatgcatgtgtaaattttggtattattttgggatgggattccgacagatggtaatgcatgaattattgcataagttgtttaatgtgatatgatgtgacgttttacatagtatagagaaattagttgcgcaaatttgtgaggaagactcagaatctcattaagtttcccattttcaactagcagtcaccattctccatttagtgagattttaaaataactgattttccaatatgaagtacaacaagcctcagtttaaaaccgttgtctatcttgagatttagagcatgcagacagaagtcagaacacgctgcgacggactatccatgaaattggctgcatgggcaatctatgcaaatggttcagacttgaagagtgctttgggtatctcaaaatattattttcaccatctatcttttattttttttatcggccttattttcacaatttatcatctcaatcttccagagactttattattattattattattattattattattattattattattattatgattattattattattttgaacagcttttattattattgttgctgttgatccttcaaaaactttaataataagtgttttacaacttgtcaattttgatcaagtagctttagcacggggcatcatttagttaaattgtacttgctaacataattagtttggacatgctttgctttttctcacttgttagtaattatcaacagtgtagaatagaactattttttcttgcatgcaatttatatctagttagtgcttcttcacatgattaattacgattatttcttatcatgtcttggtggttcgaatggttgacttacaagtacattaaatgccaaatttcagtttaacctaatatttcattttcaatggtttatgatacagatacagagcagttacgagtgcatactacaggggggctgtgggggcaatgttggtttatgacatcactaaacgccaaacctttgatcacataccacgttggttagaagaactgcgcaaccatgctgacaagaacatagtcatcattcttacaggaaacaaatgtgatcttgagaaccagcgtgacgtacccactgaggatgcaaaagaatttgctgagaaagaagggttgtttttcttagagacctcagcactagaagcaactaatgttgaaacagccttcataactgtcttgacagaaatatacaacattgtcaataagaagaacctaactgctgaggaaaatcagggaaatgggaactcagcatctttgtctggccagaagattatcgttccaggccctgcacaggaaatccctgctaagaggaatatgtgttgtcaatcatcttgactttatttacaatttgtttcaatttagtgtatttcatggttgtgttcttattaccaaattttaaaggtttggcgcattgctttttgtacatttaaatttaatttgatttggttgccgagttaaaaactaaaaatgaaggtagatacaaattgcttttttttttctttttttgaacaattgcttggttcaatatacattttgtaggtgaattgggtggacttggaacttatcgaacgtgaaaatatcatcattcgtgcttatagtttgaacattgctatatttttccaatggggtcatctggtaagcccctgcaatcttacgtacaaggtttcttcataaatccagaaccaacgtcatcaacagtggaacttgttagaggattaagacaaaggcaatggcttaataaggtgctaattgttaaattaacaatcttaagatatggatattacgcataaacactttaaatcgttatttaatcacaatttattatatattataaatttattaattttgatattaactattttaaaaattatattaatagtaacttatgataataaaagtgtaaaattatttgacaatgtcaatatataatcattaaactttaatttaaattagatttgttaatttaggtaaatatgataaattttaattttattctttaagtccttgtaaattttggaagttttttaaatatttttgtaactatttattgataataacatacaactaaatatgtcatatcagatgccatcttaaagattttgttaatatgatatgtttggaaagttaatactttatcattaaataataagagattattttgaaaattttcatacatcatcaatgtacaaatttatagtcaataaattaaaaatgttttaaatgatttttaaaataattattataaaagttaacatttttgttatatatcacaatttatatttaaatgataatatagttctattaaatcatttgaaaaattaaatttatgaagatggaaaacaacattttttaaagagattaaaataaaaaaatccatccattttacatcaaagacaaatctaaaagtgaattctacttttatggcttgtttagtagtgttgaagagaaggagaaaggaaaggaaaagtgaagaaatgaaggaatgttgagaagcatgactcatttggcttcgtgaaaatgaaggagcaaagaaataaaaaggtgtaggtcttcacaaaaaaaatgcataaatagacaaaaaaacgttgatggcaagaaatagtcaattatattaaaaaaaaaaaaaaaagattatgttgcttattgaaagagagttttgactatagccatcaacaacataattgattatgtgttggaacataattgaatattgactttacgcttcctcttaacacataatcaaattaattacactcacactcacttagtgtgtgtttggttggagttgaaaaatagattgagtttaaaattgattttggatactttttcatatgtttgtttcatgttgaagaaaaattcaaaattgattttgttccataattaattttgggttgaagcaactttgagtagtttttgcgttagattcaaaaatttgtactgaattttattcctaacttgattttataataaaacatccaaacataaatcacatcattccattcaaaatcaattttgataatgtccatctaaatagacacttaatcaatcaccctctcctgaacacctaatcaattatctctttcccgccaaccaaacaacctcttttatttctcttttcttatcttctttcctactccattttcactatatatatatatatatatatatatatatatatatatatcttttcttttcttattttcgacccacttctgcttgcattttcttgtctctttgctaaaaatacttaagatttatggttaaatgtgtgagaagaccatgaaaatgatgagaagtgggaagaaatacaaggatggtggtggtttagttgcaatgagatcaaatttgagatgaaatcgtacatcatcaacttgttataatgcattcaatgtgttaaataaacaaatattttcctaccacataatataatatattttatttaatatgaattttttatctaccaaatcactttaattcaaatatttttcttttatttagttctttttctcttcaatcaaatcacttctatttctactctattttagcccatttcttatctatttctctcattttctcttacatattctctttcattttcttcttttctttctttacaatcaaatacatccttaatttctcaatttgaatagcatgtttgttttcccatcacgtccacttcaatccacatctatatagcttctaagtttattttgatatttgacgtgatttgagccactgacccacgtattagatgcagtaacaaacatgcattgaatttgaatgtatccaatacgaattgatttcaactaccagcaacctagaatgtctagacctatcagagccaatactgtatgtccaacggaaaagtacgtcaaacattgaactagagttgttaactaccgtaatgaacaatctaagcatctcaaactaaaaacaaaaacgcattgtagctaggaagctacctagatataatgcatgtttgtttcttcggttaaattgcgacagcatgaagcctgagaccatttcaccacaaaagtaagaatatcattgtttcctaaaaaaggaggttggtcccaacatactttcggaccgataatccaaacacgcttataattgtagagttaattcccgtagtaaaataaacggcatctaagttcgactgaaatctaccagttacatgtcaataataacctggatgcgcgaggaacgactttataaaattttctcatgttgaacctctaaagtctaaaccatacagcaacagagtttctcagaagcaatttaagaaaccaaaactataaatatggaccagcgtctgtctataaaaataatgacggggttaacaaaaacaagcaattttttcactatcgttgcataggtgaaggacaaaatcaccatttctataaatgacaaatagaacaaatatctgttacaacgtacaacagagtaaagaatatctgttaagcagtcaattttaactcagtagctttcacatcatcatcatcatttttcctgttcaactcttgcacaggctgtacttcttccacatcattacaggaattgtccaaatgcccagaggagcccttttcagtgtcaaaacgtattaaaagcctttcaagtagttcttggcagtccattgcagtaaccatcactgacaatctcgccctacccttccagcatccaatggctatagttgactcatccacttggagagactctgcagcaactgtttttcctgcagaaaaagaaggtcctataaacaaatatgttgatgccaatgggtattaaatttctcaatggcgtggtgacagtgatacatacctatacacagaattaccacacaacagcctggcaataggtttgctgccttttgaccaaactcggcatcagtaaaatcttcaaattttacttctttgttctgcagaagatgcttgaattctgcgggagatgcatgcaaaatctgtttggttatgtatgggagaataaggggcaatccttcagatgatatccggaaagcacatggtgcagagctaccttctcgcgctgtttgtctttcctgtaagatgaaagtatatttcactcagtcataagaattaatcaaagctcatttatcacaggcagtcaaggactgaccaataaatattactaaacggagtagatggtgccaataactagcagaatgcatgtcacttgtaatatcctagaatattccaaaaagaaatttggtatgtaaaacagtcttacacgaattatttatttattatattacataattaatcctgaccatcatatgtcgtagttaaatgagcaaatgactgtaatccatatcctattaaaatcaacatgaatttaaaaactgtcaacaaaacaaaaatagaaataaatgcctaggtactgaaacaatttatgaaacgactcagaattactattctctaactccaatagtagccataaacaatagtatagtctactgacttctttacaatcaaaatgtcaaacaaattatacacttcacttttactaatcaaattctaactaaatttgtttcccttgcctagatcaatctcctacgactgtaggattatctaactacctatgttttttggagtgcttctaatgaggaaattattaacataaacataaattatttttacaattagtatcatggagaataaataaatcaatcacataaaatataatactaacaaaaacaatatctcttaagttgaggataaattatacttacaaacatcttcatgccaattgatgttattttaagttgctgcccaactttgaagttcaactcaagaacatccttgactgacttggagatataataaattcttttcacatgatttgtatcactgtttcttgtaacaaggtgaccattgaatggaaaacgctcatcaattccatagaaatcctttatactattaataattgtttcatctttgaaaaaaacaacagggtcaacacccctccatttgccttgaatttgtagctttcttttgcctggaaccctctttgctgtgttttgtacattatcaggctctcgagtttccttggaattgttctcttcacatgtaacagggccaacttccaaatcttcggtattgggttcattgtcatctacattttcctcagacactgcattcaagacttcttcatgtgcactttccggtgaagtaatctgtggtactagtgcatcattaagactctggtttgctggttctacatattgctcgttaatcttttttttggtttgttctggaattgctgcaataaagaaaaataactagaaaacctattatggcaacaaagaaaggtctgtgactaaatgaacataaaaaaggcagaaatggaaacttggaatttttttcccaagttctccaaaatttcccaattatctgttaacagaatcagagagagagagaaacaaatgtagtcataagaaaaactacctggcagaggagaaactttttgcagtacagcaatgaagaaggctccagtgttctgatcatgaggcagtatcctcatgcaatgctctagagggacatcacaaacttccgcagcagactctgacatcacaggattctctactgcttgaacaccatctccagcatttccgttaataccattagtaacaccctctgggtcaacactacaactactatcaacaagatcatgatggcttctgccagaaggaaacatactggaaagaattacacttctacgatacttaggaacatctttaaaagagaccaaccaagtgcccttgtcatatacctgcatctccaaaatcaaacacttataaaaaaaaattaaatgcatgcagctacaaaacagagttaaccccttccacatttgaagccacaaacaaaatccaaagcagaaccaacagcttctataagaatgcatggtcaagatggataatcttaagaattttctttttagaaagtttaaaacttgattctataccatggacatgaatgttggtataacttgacggacatccaacatatcaaatagcaaaaattttattagaaagaattcactaccagtcacattcacttataaaaaaaaattaaatgcatgcagctacaaaacagagttaaccccttccacatttgaagccacaaacaaaatccaaagcagaaccaacagcttctataagaatgcatggtcaagatggataatcttaagaattttctttttagaaagtttaaaacttgattctataccatggacatgaatgttggtataacttgacggacatccaacatatcaaatagcaaaaattttattagaaagaattcactaccagtcacattcccccccccccccccccccccccccaaaaaaaaaaaaaaatcagcaaaacagcatttcaagtccatcaaaattcaaatagcaaggaataacacaactgatgaaacaaacattttcacaagaaagccagccacccttaacattgtcaaatcacataatgtaagagggaattgtctccaagataatcctcaaacatgagatacacattaaaaatttgggatgtaaaggtagggaacatatttggtcattaattacatatattttcttcaaaattctgacttcttaacaaataaatggtaagttgatcacagcaaacacaaaccttccatctcttgagacctggctgacgaataagttgtggaagctcactagagacatcaacaagtttgacagaccctccacaccttcgcaaaacctgcagcatgacataaaagagggcataaaaaaaagaattgagcagagcttctctttacattctcatttgtctttttttaaaagaaaagtgctttttagttaaaaaattgactaaaaaagttactgtttccataagctaaaatctacaaataatcacttttgaaaaaagcgccaaatcctgcacgcaaaaacatcagtggtaaataaatactcataaacttcattcacagattattagtcataaattaccaccaaaaatatttttttaaaaatgtcgggagtgagattgagagaaataattcaagtaacatgggagaaaaagcattcatttatttttatcaggaagtgaaagacagagaaatagaattgctacgctgcaaacagccaaaccagtgaatgaggaatgggatgcctttggagtagagaggaaaagaaacaaaaagaaaaggtggaacaaaactgcctaagtcatatcctgctgttgtggaagcaaatagaatttgcaagcctttacccatttttcattctcaatattaatatatcaaagcacttttaaggggaaatctcaaaaaaggtacgtctgcaacaaagtatagagctttcaagttaagattacctcagcaaccacagcttcattctcaataggattcattgagcatgttgaatacaccattcttccaccaattttaagtagagataaacctgagaatagaaatattcagtaaatattgacaaaataatcttagaaaaatatcataagccctagttcatttctacttattaattagctaaagacaaaaaacagcagtagttttttaaccgcagtatatctgtttattaaagttttagaatgagcaaaagagaaaatcaatttaaagtacataatatgaaactattccttggtgtaagaatgtctgtcatcttcagaacacacaaaataagcacgataatgatacattgagaaatgaggagtggtagtaacactttcattcttacacattattattggtttaaattaattggaaattacaaaatcatgtgggaggctaattaaataaggagtaagacacaattttgtggtttccaataaatttcagtcaataatagtgcattaaagaaattgatggaaggtcataagcctttgtaagtatatgtcaggagaaataagaaataggttttagcagtaattctcactatttctgtgctgaactgttatgtgtaggttacgtggaagttatttgtgtggtttatttggcagttatttgttaattgtgggttggacagttattattctttgttttatatgtgttctagaagtggggtggattattcagagtgtagttttgttgcttgctgtgtatcaaaggagaatacttcttgaagggaaaacccttgtgtgctgagtgcctgacagcaaatctggtcattaaaagtttaaaaccagattttttctgaaatacaatcactgttttgtgtttataaattcttgaaaaattactggtctggtccttcaggctcaacataatgcaagtgtgttatctttcaaagaatcggagagaagcacagaacaataaattacataacaaacttaatctggaagaacaaatagtttcacttaatgatccttgtcaatttaaaaaaaacacacacacacacaatcaaagacggatccaagagggggcaagcagctcgacaccccccctgatatactcctggatctgtccgtgcacacagtatagagcagccaagtcaccatgaacatcttgtaactaaacctaattgtccatgttagacaagtctagttgagttcaatttataatcatctgctagttaacaaaacactaacaagcatatcatagacttaaagccatcttacaatcaatcttctttttcaatggctacaaagaaatttaggttgagaggaggttatccttgatccaaggcaaggacagaccaccgacttcagcaaggatgatttctagtgattagtgaaatgatatattgtctaaagcaaatgtcttgaacaaaaggtcaatgtgagacaacccctgttggctattactaattttctagctgaaaaaaaaaaagactgtgatgatggcaccatacaaggaaacagaacacaagactaatgttggcaggacctaaattacaaacagaaagcaataaaaaagcacctcgtatagcaattaaaacttgtaggctgtgaaggccatgtcccatccctgtgttcctgcaaaaaggtaaaataggtattaaaataatttggagattgaaaagaaaagaaaaatagaagtggagctagataaaggaataaaaactaccatttcctccagagatcaggtgccttacgaagggtaccatctccactgcatgggacatcacacagaacacgatcaaataacagttggctaatattgtgatctaactccatcctttcataattcctgtttaaacggcatcctgggaagtgctgagcttcgtgatttgtaacaattaggttggctgtgcacattctttttgtttggtggatgagaagattacatctttggacatcaagatcatttgctataacctaattataaaaaagacattgataaaaactgttgcatacgtagctggcccaatcattacaggttgaaattagataactctttagtcaagaaaatcaaaatgctgctaactaacaacacggaataaagggcaaagaaacagatcaacattttcgtaattaaaacggcacaaaccattccatcaggtagtgatcctgctttagatgattggtgcataatctcaagcaattggaacgtttttgaacctggtgcagcacacactgaaaaaaggaaagaaaaataaaatagtcagaattgctgaagtttgaattccaaattaagcaatataaaataagggctggtaaaacaataaaaagtactttatacactagaagttgcttactatcaagcacaaaatgatctgaatgcacatccaagaagaggggaggaacctatgtttcaaacaaccattagagtgacattagttgaattcttgaaaggagaacaattagtaacctacaggtactaaagcattcaatattttcaaaattctaaaataaaagaaaatcactttgtatgatcatgaagattgaaagagtatatgaagtgacccaccatactgacagcttcctgtcttgtaatatttccaatctcattttctagctttaagaattcatggaaccttcaatgcaagatttaacataatcagaggcaccaattggcataacatttcaattcattatttggaagtagcatgttcatgtatttcaattcattatttgggagtagcatattcatgaattctattgacctctcaagcgtttggttcttcctgagctgcatcctagaaaaatttgaatgccaagcgaagttcccagggtaccacagcaacggccgaatagcctccgtctcacctccttcaacaacctgcaaacaacagttcagttcacaaccaaaaataaacactatcataaaaaatacaaaaaaagaaaaaagaaacagtagcaggtaacatacctcgtcgcgaagagaatgcacgaagtcattctccaattgagaacgaaggtcgtcggagaactggctactgcaatcgcgaaacaaaacgacatgcgaatgagagaagagaagaatagaatagttatagaatagaatagagaggttgggattgttagtttgacctagagttgattctgaaggttgcgggcaatggagttctgagaagtgcaacgaattggtcccagtattgcgggtccactattccctgctctttgtagtagaaatcaaaatcggcgttctcagtggcgaagggagtccacgcgggattgttttcagttgaagaaggatcgggatccgatttggaacgcttccacacgttctctctgctctggcggaagtgttttctctgagtgcgggatctgcctcctctcccgccaccacccattgttgtcgtcgcggattgcttctgattctgctttgccgggcagttacgccgttaggcttttggtagggttttggcaaatcgtgtggtttagtaattgattgggcttttcagcctcaacacctgacccaaatatccctggacctgcccatccaaacttcttttttatttccttaaagttcgttccaatatagagtatttgcgaaataatatgatttttttttactcgtagttcccatgggttttaatatattgtagttagcctaatatacaattgagtattttttttaaaagaaaaaataaaattgatttaattatatttcccctcgttttcagtcgatttccacttttaatccctaaaaaaattgactgatcttaattcttagtaaatttttcatccagatttttttttttgaaaagagactgaaaatattaatattgcaaaaattcttaacatgaaaagctctgagtttttttttaacaaaattggaaaaagtagtaaacaatccaatcaaacccaattaaatttaagctcaataatacatatgctttatcacatcgaactaaatagctcatattttattcgaactcaaatttagaatccaagccctaatatttaaattgttattatcataacaattaccaatatatgaacttatagataactacccattaatgtttaaattgttatcattgaattaagtaccaacataatgtgatgactgacaaataatttagcttattaaatacatggtcaggtgttcgattcctaatacttgcatataaaagaaatgtgttgggagttaaaataataatagttgcagcaacaataataagaataataatggttataatagtgataataatgatcatgagataagagtaatatcaatggttgcgacaataaagaagagggggaggagtgataacagtgacaaatagtaaaataatgacagtgaatgacaataaaatatataatacattagcacgatacagataacacgtaatacaatagacaaatcatatataagtgtgcaccaaataatagtaataaagtataattattatatgttattgtatcatattctagtcatccaagtcttttttaaaggttaagtttaaatttgaacattcatatatcctcggtttaaaaaaagaatcaacaaaaggttagtattttaatttttaaggagcatgacagcataatgcatcagcatcgctgatattacattagttgtctagtgctcttagacgatgccgatacaatgacaatgatagatcacttattattcaaatgtgaatttgtcatctaacgtttataataattacatgaaaacgatacatcgcaaattattttatttatataatagagagagaagggaaggatcgtgcaacagaaataaacccaaactactatattattaattattacatatgcatacagtctagcttgattttttggctaagcattaaaccaaccaagaaaccagtaaggcagtaacattcccttattcccacataggcagataacaagacaagctaacttctaatcaaaggcaaatcaaaaaccatggtagagaggttttgtttgattcttccctatctatctatctatctatctcgttaagcaacatcttatcttaaactgcttttaagggagaaatagtgtgcaaagtgcaagattgcaagcatcatcaatacccattcacagtgcacagacaaaatcaccgcttgtctcaatgtcatcaatgtcagcatccgcatcaatatcatcaaggtccatgctgcccccaacaaattgctcaccaacttttggaccctcaccaggtttcctagcctcttgaattatggacagtatttcttcaatgctttgagtctcagatgagtcgtcattcacatcatcattttgcaacaccccttcaccctcttccataaattctagtggcaaattctttaggaaccaagggtgcattttaatctccggtatggtaattctctgcttcaaataatgtaacacaaagttaacatcatataataaataaaaaaatgttattatgttctgcaacaaacataaataatttgtaccttttccgggttggccacaaatattcgagacaaaaggtacctacactctttactgatacgtacatagtctggaatagaatagtggacactaagaattcgctgccaaaattatccaaaaataaactaattaataattaattagtcatattactcttggaaaactaaaagggaactcgtattattattggtccaactaacctgaagtgtttttctgaagtttcttgggtcttctgggtcttcaaaaggatatgctccaaccaacatcacatatagggtcaccccacaagaccaaacatccgcgacctaatcattctcaaggataagaacttatcagtggccaaacattagctccaaatgagtgaagccacggctacatgattggaaagggaaaatttagatataaagttaccttgccatcatattctcttcttgacaaaacctctggtgcaatataggcaggggttcctacagtagattttggctgggagtgcaaaacagatgactgaagaaagataggaacaccgttgagtaattaagaaacattatgttaaatgaaattaagaagtagcaataagtacttgcctttgagtaaccgaagtcacagattttaagtcgtggtgctgagcttccatctagaagtgtgttctccagcttaagatctctatggcaaatttcctgcagcaaaattacaccttcaattcagctatttaaagtagtaggacttaatttaaatcattcattgaaaaataaaccatttggattcagattggacaagaatatggtaccattgaatggcaatagctgactccagaaatcagttgctgaaagaaatatctcgcctatgcatggaaaaggagaaattagtgtgaaattttctgttacaagtatctagaatgtgaaatatagaaatactatatataaaataaaactaaaaaaaaaaaaaaaaagagagtctagatacgatgtccaaattattagaaagcagccaacaggccatcaacttgccattcgaaatttcacacactaatatgtttcatgcataatgtacagttgatgcaatcttaattttactgttttggaatctaaaaagttaagtaatacaatggccatcttgaacaaaagcactatcataaagccactgaagcttttcgttatcaattattagaaatgatttatatctaatctaatctacctcgtcctcactgaatctcccagcactgcatattctttcaaacagttctcccccggcagcatattccatgactattgcaagatgagttggagtgagtaacacctgcgatgaattatatgtcacaaatcggcataaaagtcaagatgctgttagctaacatgctataaatcccacctggactagtcatatagttacaataatatatataaatgagggacgataaaacatgaagagagctttgaacgaagaagaaacattacatctcctattacaagagtaatgtatatcttcttctttcaaagcacctatcttttgttgcctgtatgcactgttttggtcatattactagttgacatgggagctcgataaaatataagagaaagaatttaagaaatcaaattgaaaagatttcttgttcagttctttacaagattctggaaattccttttaaggaaaaccaaaaaaatgaccctgaatattgagatccttcagggaactgtatattgtagagaataaaactgaattatgaggaagatagaaagaaaccatgctttcataacccgtctcgaatatttattccattccgggacaaaattgaatttaggacagagtttaggtgtatatgtccctggatgcatatatattttcacaaagttggtaagaagtagctaaaggaagggaatgattttcttcagagaaggtaaacaattacactttgagactatactcatcgaaaccaaaaatgtctccaattccttacctctttaaatctaatgatattgggatgcttcaaggacctatgatttataatctctctttgcacgtgttcatcaatctgcaaaacccaaaagaaccccattaacaaaggacaatccaaagtacatatgtacaagattgagatatgacaacacaaaagatacatggagtttgaaaatggaaccttgaagcctcgctcaatgaacttgatagcatacaattcaccactccatttttccttgaccagctttgccacaccaaagttccctgacccaatatctttaattatctcataccgttccatggttaagcttgcaagcttgaattgaactctatgtaataactatcagcaacagggtgttgtattaattgaggtgtgtgatctagacaatctttctatcttgcttttcttattggactttaactacttgtttgcgtgtagcatcgcatcttttttatggcctccaaattccaatgcgcaaaagtttgcaaatagaagatgattaggttctgggtttggatgcccttattgcaaattacaattggactgtcactatgccttcagacacaggactttgtatgtcagaaatatatacaagtatttagtttaggtaggtataatttatgagagatgacatatcctttttcactattttttcttgataatcgtcttaatatcttatagaaaattaaccaacatatttaatattttgaaaacataaaaatcttcgaaatttactttgtttaatggttagagaatattgtaaaagaataaaaactattagtatttactatattattattactattattattattattattattattattattattacatcttttaagtatttgaattattaattgatatgtataaataccatatttgtattataagtgaaaattttacgcatattatggcctgcaattttgtttatatcagataacaaccctcacataaagcatctcactaatccgagcatgaagggtaagactcttttaccaagtttttaatataattactttttaaaaatggattaaaaaatactagttacatttataataaatattgtatttgatttttaatgttatttatatttattttatttttaatcaatattaatattattttatttatttatttgataagattagttttataaaattattattctatgatatatgatagtatttattagcttttctaaagtgcgtaaaataacatattttaagatggggaaagtaaacaaaataaaatatcagaagataaaaaaaaaaaagtgacacatggcgtgaattcattggctgaaagtagtagcagacaaacaaagattttgatccgacgatgcagtcgattgtttccaggaccaaacgtcgggtaaggacagcgacgcgtactcgcccttccacgaacatgaagagaacacaggtcaactggtgttgaccatttttcgcgtcagaagcgcgagtataggagtttgctactctcggcgagtgggtgtgggtgcgcactacagagaagtaatatgcgaatgaatgagggtacttgttacgacttacgaggtggaggagcagagacaggtcagatcacagccatgcatagacaaatttggagaagaccttatctgacacctcattacaaatttaattaaaatgcctcgtgtattacttttatttggtaagaaaacagcaagcatttattttattttatagctaaatttagcaaataaaaaaagtatattcaaaagaacgtaggacagagttttgttaacaattttttttccctttgttagaaagagtaaaaaaataaagtacttgataattttatatttgtaatttaaaaatcacttttaagttgtatgcatagatcaataaaatccccttaactgttctttaatcttaagatttgaaataagaaatgaaatgattttaaaattaacttatctaaacatagaattcgaaacataagagatttgaatcactattttattcaaataaaatgctttaaaaatgaaagggttttcattgtaatagttaaactttcatgtattttaaattgcttaaaaatgaaatttcctttatccaaaactacctcgtttttaaaatttaaacacgattttatttttattatttataattaatatttcattaaccaagtaaaaatttgaaatgctttaatttatagttttatattttatttatatttaaaaataatcatatgatagatgtcccaaaaaatatattcacgtgatgcacgatatatttaaaacaagacattaatgtcttaatggagggcgtatttattgtatattcgatgaatctggaatttattgtatctggtctaggcttcatttttgttgagacagatgtttccaactttggagtctatcacattcacatcctgcagaatccatgccttgcccagttttaatgatttgtctaattaattaccttacctttggaggatatagtttcaaacatcctctctcagtgcctgattgtataaaagggattatctttgaagttagaagttagaagttagcagttagcagttagaactgatttctttttcttttcttgaaatgaatagctttcacaatgggtttttgtcttaaaaatcgtataggctccttttctataaataaatgaacacagcttaatcaaacaaatgcttacatgaaaatccaagctcacatctgagtatgtagattggtgtggggtttttctcaatttaactaataatttttagtttaaattattagtttgtgattatattaaatatttgaaaaaaaattatcatttataatgttattgactgaaataaaattgtttacaaaatatatgtgttattaaaaaataaaaacaaaatacaaatcctagctaaattaacttgtttcgtgagtcacaacattatgttcacttttttttttttagtgaacattatggatgattttgtttaaacataaaaaatcaatttaacataaatgttatttaaagaaacgtataagatttacttttttttaaaataaactatttattttaaataaaaactatttaaattaacaaatcagaaaaaataaaattacttattttattaagaaaattattgttttaaaaaataagtttaaacaatgtcacctatctccatttaaagatatgcactattcaaaagtttacaaagtaaattttgtttacatatatgattttaaaaaaattgtaatgtatttattttatattgaaatatttaaaatattaccgtgtaattagtttttttattccttctaatagtaatattaaaagatgatgataaaaattaaaatgatatttttaattttatagataacatatgaaataaagaaataaaaactattttctaaaacgagtgataatttaaattggagtaagtaatttttctcgaataatttgatgctttacaaattaaaacgaatgctcttttgattattcaggaacaaagcacagtattttgagatcttaaaatgtttttatttttctattaaatgattactctttattttatttttataaaataaaatagaatatttcaactttgtacctattggcatggaggcctttcttctaatacctctcattactaagaaatgtaactttatcatattatttaacaatattggtatacttttattttgtatgtttttcttcatattcatgttataacttttatctaaatttcaaaacattaatatttgtgaggaaattattgatatttatttattgttttttaattagttgttgaacaattgttgtgaatattattgacaaataaatgattgataattggagttatcatgttggtttgatagtaaaaggagaaaaaagaaagacaaaagttgtagatttgataaaaaaaatattgatagtttgtcaatttaatgataaaaaacaataataatagatagatctttggatttttcacatgatcatatgtacttatagtgttttttttttttcaagttaaattaaaaaaatccaatgattaatatatgtatatacggctcaattctaaattttatcatccaactttcatgatttcacaagttttactacctaaattttcttcttgcgaaatttactatctaactattgaatttgtgcacattttacaattgttgacatgtttaaaaaaatttcaaagaaaatacaaaatgatgttgttttattaccaatgtaatggtataatagatacatagataaatgttaattactcttttgaacacattcatattatatattgagataattttcattttttagatatcacacaaaataatcaaattttaatggtacaatagtatttttacaaatttattattttatttttactttatttttacttaacctaaacaattaaacatgtcactttatttttactatattagtatatttctctttcctctagttgtctctcttttatttccatttattatatttatcttcttataaccaaatagagtcttgattattgaaatcaaccattatcaatatctcatttagagcatttttagtgatagattctaaattgggatcttagatcactttttaaaatactcatagtaacacgtaggattgaaaatctctcaaaattccttccattttgttttttaatgatagatctcattttaagatcttagggagaaagaaagatggattttttttgaacaatgtacttatcttaaaaacaacaataataacaattatcgcaatacatatgaaaaacaaaatatgagatgaaataaattatcaagttgaataaagtatgaaagtatcccgtgaacataaaagagaacaaaactaagaagaagaaaaaactaccaaacaaaaagcaaattttgataacggctgaaaaattagagaccgataatgtgttcaaattatagaaatagagaaagaaaaaggattataatattaaataacatatttatatttttaaagtgaagagctgccacatcaattatgagccaaagttcatacttagacaacctcttccacccatctccggaccactctatgcccttttcctctctctttattggagtatcactggacaaacaggggataatgttcatacatatgtatcgctggacaaacaggttgtattataaaagtttccccccaaaaaatgtacgaacggaaagttttaatattaattcttattatgtaaaataaaactactgctttaattggcgaataattcttaaaaatcacatataatactagacttaaattttgtgcaacataaactacgtgtttcattatttatatatatttgagttcatcaaacaatgtgtttatgaatccataaaatattaaatgcatggtctttttaaaatttatattaaataactccaaactcttttataaataaaagtattttctgaacaactttgaattatttataaattgagagaaataagaaaaaaaagataaataattgttttgattgataatatagtataatacaaaaaaaaggacaaaaaagttattaattgaatgtttgaaattttttattgtccaaatataatttagtatgtgtactaaattggaagttgtaagttataacatgaaattttgattgaatgtttatttgtgtggattgaataaatcttggatgaagagttggaatgaaaatataaaatttgttggatggtgaagatgatgtcatcctttatttctttaaaggtatgaatgatgcagtttcgacttctaatcctggtgaattttaatgagtttcttatttgggacttagattacctttttctcacaaaaaattcgttggatgattaaaaaaaaaaacatcttcaattaataaaaactaacgaagtatcggattaaaaaaatgaaggaagagttggtggagtgtagcaaaagcaatatttttgggaagcgggtggtgggtgtggtgggaccagcactgtccttgttagagggaaggtggtggggccctcttttttctttgtttggggactgatggaagaaagccaagaaaaagtggtgcgtccaaaagcaagcatcaacggttgtgatgagcatatgagaagaaggaaatgttaagtgggtacttttcttgaacttcggtttctgagagaaacactgcacactgcacctttccttttcatggatttctgtgaccttacccggatttcagttaataacacatgccattctatcggctccgtcttcaatttagtcatgctcgaattatatttaatttttgcaaacttaaatttgaattagactttagtttataaaagtacgttaatttttttaaaaaattgaatttatagatttctgtaaaaaataaaaacagtaaatagacaaaaaaaaatttcaaacaatttttgagataatttaaataattctgattttattttcaaatatatttttaaaatattctaccaaaaatccaagcatactcttagaatgtttatgctagctttatgtacatgctggtttaagtttataagttagttaaatgttataagttgttacttaaaagtttataactttttaattatgttcttttatattgtttagttatcttaacagataattttattataataactcgagtttgtaaaaaaaaaaaaatattttcactgtagctaggactgatagcgtgacattgtagtataaggttatttttcatggtttttggcgcgattagtgccagatatggcgccgatagtgccagtagtgccctggaaaacacattttctctggattttggtgtggataacgcttgaactggagcgattagcgccagaagtgttccagaaagtgtattttctctgaaatctaacgcgatcagcgccaaaattggcgcggttagcgccagaacacatttgagccagtataaaaggccatttcacgcgttttgaaggccaaaacccttcttcttcttcttcctctgacccaaacggccattgatgaccataggagcttcataactcctccatacttcatctaaacacctcctaactaccaagaaacatgattagaaccacttatgagctagattccaacctagattcttaaagaaaaccaagaacctccattctctaaggaactgtgggaaactgagttttgggaggaaaagagggcgattcaagggcgccagagctgagagaacctcgattgtgttaaggtaagaaacttaagtttcaccgtttaatttgtgaaatttgtaataggatgaatagtaacccttttgtgttagggctggaattagacttagattctttagaaatgtatagttaggaggttgttctgagaaatatggaactttgaaacttgatttatgatgaagtttggttctgaccttgagtttggtatgggtaggaagaagattgagtgaatggaaggtattatgatatatatgaatctaagtgtctttacaaaagttgttcataaagccaaataaacgatgaaaacgtgttggtatatctgttttggctatgttggacaattgttgatttatgaactagtagatcattaattgaacctatgcagagtctaagagggactctatgatcttggttggatccaaatggatctaggtgagggtctatagatcacttataaggtggtttacccttgtaaccttaagatagaggacagaggggattttatggaaatgaatggtgttttcctttcattctaacggttgaggaccgtattgattgtttgttacatgcctgatgtaggacgtgagatttacattgtgggtggtggtgaccacgaaagtgggagagccggtattgagctgagagcaggtaagctcattgttccttggaatgatttcctttgcttgtgtgtcactgttttattgaaagcatgtacattatgatgagatgaacactatgatagtgttctatggttgatgataaactaaacactgtgataatgttatgttctatattgataataagataaatgttatgatagtattgtgttattgtgagattctctggccagtagaataagtttctatggattcccttggaatgagtgcccttggaggatgatcttccctaggatgtaccatagatatccatctaagacctgagcgaatggagagtccttcactggatgatcttcctcaggcagtggataaaagtcctgagtgaatggagagcccttcactggaagatcttcctcaggcagtgtgtgtgtgtgtgtgaatggagtctggagagaatgtatcttttggatagatgatatctccgaccatgtgatatgtacatagagaaatgtatatgtatatatatatatattgttattttgatgtaataatcgtgtcatatttatggaagtgaaccaaggggaggaaagacctccaaggaccctgagtttactgagattattatcatacccctgttggagctcatgtttgcatgtgatgatccaggagtagctgataaatctcaaggcaagaggcttgagtagggatagttctttgataaccttagacatagagtgatgaacatgttggctcaaattttgattatgcctgtatttaataccctgaggggatatttgtacagttttgagactattataccttgtatattgtaagaatttcccacatatgtatataatgtatagttgactttattaatgacgcttgatgacgtcatcttgtttgaagcttcttgttcttttatgatattgctgcgctattatgatataataataatgttaatacaccgggtgcatacgagatgttacatttataactttcaattttcaattattagttaatttgctagttttcagttaatattttaactagttttatcaaataccaattaattaaatacaactttaattcaatttatttttagattcttaggatttttaaaaaataaataactatttatctacaattaaactgaagaatatgctaatgtcattttgcgtatcagaaaaaaaattccttcttcctattttttttattaaacaaatggtaaaaattagatatttttatcccatgtctttcactcttccctttctattttcatctatttataagtctattcaaagaaacatggtgtagtgtacgtgataatttgatattacatccttaccaataattttgagttaattacgaaatcatctcccaattctttattttattattgtatgtaatgatcatataccatgtattatctgagaaacctcaatttgtcgagtgtgtagtgaatgattgatagccaattttttttttttgaaagttaacacacttgaatagtgatgacataattttgaaattttagcataccctgtaggaaagcttaataagatagtccaacctaacctaattaccggaaaaaatgaaatttgtcataacgactagtaactaatttttaatgttaatctctgtaagccaagtgagaatgggtagtattaattggattgaacttttttattttttattttttttataatgaatgacatgttatgtttagttgtttaggggataaaattaatttaaaattataacagttattaaataaattaactgttgacatttgagaatttattttatataagtattttatcataattttaactattgatttttattaatgaattgatttatatttattctttaaaataaagaatgtctttaaaaaaattgttattagcgttttcaagttttcaaattaagttgaggtacttcaacagataggagacaggtaatcatttttaaaaaaaatctaacccatattcaaaatacaaaaataaatcacttaaagcaatactaggattcaggcaaacaagaatactttctaagcatcggtcatcaaagtgtgtacttaattattccacattgcatattccaaatccaacattaattctcagagctaaacactggaaacaacattctcatgccttgaatggcatgtcattgattattttgcaagctctctgcaactgacctgctctactcatcacgtccactaagcaagcatagtgttcagaccttggtggaataccataattatgaaccatcaaactgaatagattcatgctttcatcaaccttcccagcatgacaacacacagatagtaaactcagataagttatgccatcaggttgaacactgactgtcaccatctggtcaaagatcgtgctttgtcattagagaccatgcggtgcatatgcagcaatgactgttccatgaaaaaaggtcccgatgggaaatttgtccaaaaactaactcagaatcaacaattccaccacatttgctgtgcatagtaatcagggcattacacattgacaaatctgaatcaaagccatggttaattacaagagcatgtgccttgcttccttcttccagtgatgcaagacttgcacaggcaatgaaaactgaaacaaaagtcaaatcatctggttgcataccggtcctgatcatttgtgaaacaaattcagtgcctcttcccctctcccattttgggcataacctacaaacggtgaatcaattgtgaaaagatggaataataaataaataaaaaatgtaatgaccagagcagaagcaaacaacctcctcctcctaggaccacaagtcattgttttttgctcaacaatttaatcaaaatatgctataaacggataaaacttttctaaattaagctaaattttagagcaagcaaggaatattcgccattcgtttttcttaaaaaaaaaagataataaaattatattagagttaaaaaaaaattcttattggatataaataataatctgtcttaaaagttaattataacaagtccttaattgataaaaaaagagagtatctctattgaatattactatattaatattacttatattacataacaggcagagaggatccgatttattttttcaaaagacttacatatatttacatgattattatacactttaatagaactagaaactccaatggaataagtcacagacagttaggcttctagttctagttgttattcgttccttttttaaaataagatataatgaaagctttcccatagcaagagcatctactggctgataaaaaaaagcaagagcatctactctagcatgcactttgaatggaagatgcagcagcatgaaatgagcagacctagctacatcatcattgtcaagaacagcagtgagaagtcttaggatgtctttgaccaagctggacttttgctctataaaagggttattctgaagaaaatctctttttttttttctttgatacggaggggggggcagaagcccctaatctaagagagaataaaacgtgggaaatgaatccctacaaaatcaatccaccaaacattatgaaagtccggaggaggagagttaaaaatatgaagacccaagagaagctcatgacccttagctgctaatctatcagcaacatgattacattcacgccaaacatgggaaagattaacttgccaatctttagctaaccaagatttaatctgctcaatcatggcagcatgctgatggttactattctccggacctttaatgagttaaaaccactggtttcctgtgaatgaaacaatgaaggctgggactttgataggtgggaaatggcccaaaggatcttcaaaaatgcccatttgataaatcacaatcttcattgtcatcccgaaggtctagatcatatgtaaggatacccacaaactaaaaaatgccattcaatttcaattcagactttggagaatcatatacaaggaaccaaacaccaaagacaataactagaagcctaactaccaagcttatttctatagagtctctagtttaacatttttttaaaaacacatctaattgaaaaacaaaaaacacttctctcaacaaaaataaaaataaatcacaaacacttttcagttataagctaactaacacatattggcgtggaggttgaaagcttgaaatcttaaagctcggcgtactcgttatgattatattccaagaaaagctatctctgcatcgaatctcttgaaacaaagtcttcgcgtcttccatcttcccttctttacaaaacccagtaatcatagcggtcctcgcaacgtcattcttctgcggcattctcacaaacacttcccacgcttcctcgcacaacccattctccaccaaaccattgatcatcacaacccacgacaccgcgttccttcgaggcatcgcttcgaacagcgcccttgcgcgcccaatccctccctccaccctcgcgtacccatccaccatcgcggtgtatgacacgacgttcggtcacgacatcgcttcgaagagcctctgcgcgtcctccatgcgcccgcacctcgcgagccccgagatcacggcggtgtacgacgcggcgttcttctccggcgcggcggcgaagtagcggaacgcgtcgtggaggtcgtcgtattggacgcaggcggcgatgatggagttccaggaaacgacgttgcggagcggcatggagtggaagagtgctttggagtgttggagaaggccgttttatgggcatttcgtcgaacagtttgcgcgaggcgtcgactttccggcgagtgagagggcagcgatgttgaggttcgcgtggtacacatcgcgagtggaggagaaaggagtggcgttggcgccaaaaggttgggtctatgagtgaaattgccacattcctaagtaatagtattatataatattttaagtaataaaatataagaaaaacactattcatttcacacttcactaatacaaatattggagtgaatggacgaaattatctcttttcccttcaaatataatatttcataccaacatatgccacacacccgcaaatggttttctcgaacttaataaagcattgtgttgtgggagtgtgtggggcccgttcgtctgtgactgtgtgatccaataagaccacaacgatggagaaggatgccaagtttcacacacagcactttttggcttctatattgtctgataacaagttcacggagaactacgtttagaacaacacagagaggctgaggaagaggtgtcaaatgatcattgaagggttaacaagtgttgggatagagtgcttgaaagtgaatgtaggattgtttgctgaatgaatctgagtccactgttggaagccatctaggggaaggagaattggagctttggaatgccattttgcattaagtgaattacttaatatctctctcgccattgttgtgaacagggtggttcagggtctgctttgcaaatatgagtgagcacacgctggacgtcgcattgaaagagaatagtatgcgatggatttaattaaatttagatcctagtcatggttaagtgtcaagtaattaaagggtttttctttctctcttttttaatggtctaaggacgtttttctttgtatgaaagtttcgttggaattctgtttcttgtgtatgggttaatacttgtattatgtgtcttggctgacaaaaaatggaacgaataaagaaagagtaatggtgttttggtaagtgctagctattattgtttctggcagaacttacaaattctttattctgggagtaacagcaaaacccaaaactcgtatcaggaaatgcaaatgtatactgaagagcagtggcggggactctggatcagtgggactaatttatttaaaaaataaaaattgataattatcattatcatatgaaatagtttgattcaaacacgaagataagaggtataaaatttaaagttttaagataaatatttgcattttattaaaataagagagtgcatttacttagtcttacatgtgaactggtaatgagattcaaatacataaaattagaaggtttaaaatataaaattatggggtgcaaaatataatactttttacattttattaaaataagatggtatatttacttactcttacatgtgaattggtaagaagattcaaatatataaaattataggatacaaaatataaaattatgggatgcaaagtataatattttaaaacaaatactagtttattgaaacgagggtgtgcacctacccaccctgactactatatagatccgccactgctgaagaggcagtagagcacattcattgcctgatgtagagaagtgtcttagttcttgtttgcttccattgcttaagcaaattattagaaggtccttttgtatgattaaagtgtctgaatacaatgactaatgttataagtttttcttagaaggtccttttgtataaatgtttttacacacatggtattttttatccctttctttcacatcatttttatctcaatttttttttctcatttctctttctcttataaactttataataaaattttattgtataaataaaattcctcttgtatattatttatgttctttttataagaaataaattatgatgtataaaatatacttaacttgtcttttataataaggaacggaggtaaggtactattagatagcttccgaggccgagtgatcaatggtttatgcacccatgtgttcgtgtgcttgcaaaccaaccttgatataagtttttcagtgcaagtttagaatagctagtttcaatgcctcctttgacctgatcaatgatatgtggaaaagtatgtgtcatcactcgcatcaggtaatactgatagagtctatttttagttattgcatgaagtcctaagaatatctttgcaagtcctaagaatcattaagtgtggttttgtaaattttacttttatattttaagaaaaatttacacatataactgcacttttttctaatttatattagtatttagagaataatatttaacacacatttataaattgaagatggatataaatagtttgacataatacaatattaaaatttgccaataaacattaaattggacagttttttttttaaaaaaaaaataaaagaaggtgacatgcaacactggacagtaatgagcgtgatcccaactattattatttcaagaatataatattaatgtaaatgtaaattaagaattaataaataatgcaaatgcaaatcgttccagcttaattagttaatatgtaattgtattaaatatttaaagaatttttttactacttataatgattttactcagtccaaaaatgaaaaatatgattaaaaaaataatgtgatttattaatatactctaaagataaacattattacaaaataatttaagttattcaaaattgaaactattagctgcattgtgtgtattatttatagttcgctatagtcagcatagtaagaaaagtttcttgtaaccccatttgacttttgtgataatcttacagtaattataaaaataaacattttatgtattatgaaatatcaattttagctttatctattctttagcttttttttctttagcttttaacatagtctttgtagtagttatgtataatctaaaaatgataaagttacatgtgactatcattgcaatgtcattatatacgtggacaccttccatgttaacaatgctacattaatagtgttgttataagaggatgaaagtcgacttttcataggaagacggatacctaccattcatatttttatattaacagcatatcaactatatgagtcatttcaaataagtgtaatcactttatcacctaatatctctacaagttatatctataaataacagtatataggtacatcttatcttatattttgaattagataactatgttattaaggagctcatttaatactcattattcaaatttgaatacatactctaatactcatatccctctaatattacactcaattattctcttataattgatgtacttgcttgaatttcaaagtgtttttcctttgttttacatattcttcccttaaacaagattgactcctatcggacgtgaaattttaagaatatagtattcacagtagttagctatttgttgtctatcagattgtattatcataattaccgcatgatatgttgtgcaatgtttctataaataaatatgataaaactctaaaattgaatatacagggtaagtaatttacttttgggttttgacggaattagttcttcccagaatacatcctcctcaatcaatgttattcaataccgtccaattctgctccaaaaaggtaaaattaacaatgactttcttttttttcagttttcaaagctatgaagtatgaacaaatatttaaactaacaactatcttgccacgttaccaaaacaaaattatcttgccacgaccaaacacatgaaaagtcaccatgcacccatcatgacctaaccttaacattacagagcaaaccaccaaatacagcatatagatcaatgaagcaggtggggtcaaattaagcaacacaacaggcagaggcaacaatctctttttccatcagacagcccatgccgcacaataaatactcttgtcctgtcgcccgaaaggtcaactcatataatgtgttgtattcctttgatctgagaatccttagcttccaaagcctgcatgtaagcctaacattttactcgttactttttaaagtcccaaaatcttacgtttcagtaaagtgaaagtagtcagcaacgtcaaagtgcatggcaagttgcaaaacagcagaacgcacggcttcagacgttggtgcaacagaagacggtagatggggtaaacaaagtggcaggtactgttcactttcctcaggtgggcagaaaaaagatatcacggatcggcagaatatgaatctgtacataaaatgatgccaacatgtcatacagcaagcccattcaataacttaaatttaatagcgcttgaactccaaatagcagtaaacagctattttgtgattttccaaaacaatcaccaattaaaataaataagaaaaaagactacattggctaaaaactagagagtaaataccttagaataagccgccttagaaatggatcacttataacctgcgcccatactaaatccatggtagttgatgagcaaagaattatttcccactcagtgaaagcattagcgattatgttctctgcttcattgtagacatcctacaggttaacacaaaattagaccaacaagaattaaaagttaatctgagaaaggttaaagattattcgtgcattgcttactgtatcagactcgttgggggagagaccaatcatttggcaaaatgctgacaaaggagcagtcaaaaaaaaggtaaattggcttccattatttgaatttacatcagatggattcttgaaaatcggtcttaaaggtgaaagaaatagagcagccgcttcacccctttcagccccatgtaaaacctgcaataatttatgacgtacacaatcaatcaaggcctgtcaaagtaaataaaatgggtcaatcaattctcaagcctaaaaaagacagcattttctaattcctatcaattccaatataagtttaacatggaacaagccaacaagcaatattaacccccccacaccttaaaaaaactaaccataaaatcattataacccagaaaaatgctgtatttgccattctttttgtaagtaaacatgaattgttgacaacggttctttctttccacccattcaactttgtcctctgagaaagttctacattcatattcaaatttttggaagaaattcgacaaggcaaggttttctgaggttagtgagttaaaattcaatttaaagtgttataacaaaccctcagactacaaagtaataaactaattgcaaatgtgaccaagccattaaaaagtaaaattagattcaaggaatatcctgaacagctccgcctaacaaagttcacaggcaacttatacacaagttctgagttttgacaaacctgccttgaatgcatggctgttatcactgtcaataatcaggaaaagaggtttcctagtgaaggggataagatcgccagggtagagattatttgaacctggtgattcaaataaagcacatgtaagtgcagctacaacatagatgattgttttttatataacatctaattaaaactaacccataaaatgaagagaaaatataacatgcatgtaacatttcctagaacaatctgaacagaaatttgacagagaatagactaaccactatttcccttgggaccaaaccacagataattgtcataatagctcagttctctcttgccattattttgagtttcggaaggtccagaattctgtccctgggaagtctgggaaaggaatttgtgtcttgaatatttggatgaactgctaaaattctccacttgagagacattattaagaccacccttccctgcatgagtgatcattaaggtaactaacctagtataacaggacatgagagagagactatacttgaaaagacagggcaaatgtaaacctgaggctgaaagatatactagcacaacacagtctggtggaagctcctcacaaattgtagccaaaacctgcataacatcatgaagtttatacaagaaataacaaattgtgtgttaaacagcctgagaaagattgcatatcaataggatgtaaacagccacttttgacaagtgaatattttggatatcaattcatgaatcagatcacacagcactaaggaaaaaacaaacccaaaaacaggtatgtgtgcacgaacagacaagaaagcatattatagtatacataagaaccaatgaagcacaccaaaggtacccaagaatatcccagtcctgataggagaagccataaaatagccatgaaatactatttgatattgaagaagcctagttctcagaactgcctatagattttagtaaatagacaagcaagtatgtaacgcaaactttccaataggctttgaaaactcactgctatcacatgtgtcacagatggacggtacagggtagcctttctaggattaggaggtatagttggatcagacatatctgcagtaagattcatgtctattatcccggaagctcctgaatgatcaattatgtcaccattctccttaggtttaactgtatgtttttggtagaatactccactaggctcccattctaaacattgtatcattctatagatgtccaatgtaagctcagcaaacttgacctgtaggtgagagaatatataaagattcaaaagcttcagtcctttcaggtactaaagtaatttattaatccaaatctaaaaacaaccttggcaacatgaatcagtattaacctcatttcgatgatagcttgtcaacagtgcatcttgaaatttcaaaaccctctttgcatgaaaacgagccacataaggaagagaagctcgatgagtatcaaatgtggcacaataacgcatgggcctgaaactaaagcccttgtcaactttcgtgaaacggttaatttctgtcaccacttgcctccattccttaaagttagtttcctgaaatgaaatgaaatgattcacatttataaattaaccaggttatatagatataatgttttctccagatgaaagtggaatacaaagcatcaacaaagtatattatagcaaagtttcatgagatttttttttatcttaaagaaaaacacaaaattcaatgttaataatgaacagtatgagtttaaaagtgaaattatataaaacaatcagattgagaagtggaagcttgacttcagataatcaaacgtgcaaaataatctaatgaagtaaatttataagtgatgaacacctgaagccaaacaatgcagtcttatgcagagatgaagatgaccaaggtctcaggcgagagacaaaaagttcaagtaattttacaaaaattaccaaatatagtcaataggactgttgtcatcatgcaactagttaagtaacattatttcaagcataacacttttattctcttggtctgtgatctacttatcaaatcaacatgtgtaatacatttaggaacttcagaaccttttgtcttgtcaactagctgcaatttgtttttattatcatgtacttactgacaagaatttcatatcatactttcaacaaatcgatcattgaactacgtgtgcataggactgtaggagcatatcaggtgtgagcatgctcttatgagagaactgattttgaccataaaatcataaatagatgaccaatattagatctaagtaaaacaatcttgactatcaatgtttagtagtatggtcaagattgattctgcctacatctcatgctctcattagttacacaccctatatatagatagggtttggaaagaaaatcatatttgcaccaacaatgttattctagaaaactgctctccataggcagtataacttaggaacttccgaatcatttgttttgtttagcccactaacaggaatttatttctttattattatatacttgctgaaaagaacttcatgtaagatttgaaaagaaaattatcaccacaccaacaatttattctagaaaactggcccctgcagtcaatatagcatagtagcgtacagtttgaaattcagttgatccagcattaatatggttctaaaatgggaggctatttcttttaaaaagaatcatcacttgcttttctttattactttaaaactgagtaacttcaaataaccttgatatatcctattcaagagctctcctgatcactttcatagttcatagttcatacaatagtcagaagtaaccaaaagagaatgttgctgctaaggctatgaaaataacctattctaaaacaaaaggaacggagagtttgcttaaacaaatatccattagatacccatcaattttatcccgtgaaatcagatgtcaatgaaacaaagattaaattactaattacagaaatctgctacagtgggattgccatcaaacgatgaaactaacataatttagtgacatggattctatccaaaaaaaaaaaacaaccgcgaactctaccaaccatatcacatggaagaacaaccgaggctaggtggggtcattacacagatcaagtcctcaagtcctcgcggttctgttctatcatatagcccagccaaaacaagagaagctattcgaatcatcctcagacgaaacctatggaccctaaaccaagtatcatacaatgaccaagaaccagttgattcagagcaacttcttacttaatctctaagttaaaagtattatcacttttcagcgtcgaacacaagaaaggaaacaccaagcacatcacacatcttttcactcctaacaacttcattgacaaaaacaagaaaataaaataactacacacataacacacaaatacaaagatgaagatgaagatgaagattagttagttcagtttgctttcggaaagctgaaacaaaaattaagtcaaattgagcagagaaacaatgcattacccgaaaggtagtcctgcaatcctcaaccaaagccccaaagcgttcgacgaggtgcttaaccatctcggtgcggttgagaataactgaaacgagcaaaaagcgcgcgtagaacctcagctccttggagcgaactccgagatctttggcgttgggttcggatccctggaagtaccttctgctgagtatggcctcgtagaagacgtaggcctcgacgaggaacctgcactcgctgctcctcatgtactgcccgaagtacagctgtccgattcggctcgcgatctcgccgatttcccaccgcttcatgccgcactccaccagcttcgcgcggttctcctgctggtacttccacagccgcgtgtacgccttgaacaccttctggaacgcgtggtgctgctggctcgcaccgccgccgtacgccgtcacgtcgcgcacccggccgaacttccggtccgcgctctccaccagcgcgcggaacgtctgcagagccaggttcgcgtcctcggacatgcctgccggagaatgagtgtttgtgagagagagggagatgtttttaggtctctgtcccgtgacgctcgtcgccgccggtcattggagaattcgagaaagagagtggtaatcagaaaatagaaacgaaatttgtgtgtgcgcgtcggagaaagagaggaacggtgaagactggagagggcggttacactttttgtttgtcaaacagtgtgtaagaaaagtatataatataattatattaaaattttcttttactgtatcataattatattaaatatatagtagaaataaataatatgtgcatattctatgaccttttttagagttaaactatcataaatttctcgacttccataattcgttatattaaaaatcatattaaaatgatttttaattaattgatattataaaaggagaaaaaatgtcattattagtacagtataaaattatctaattacaaatgtcatatataataaatttattaacttttacaaaattatcttaaaatcatatcaataataatttataattaagatgataatataaaattattttacaccattaattaattaatgtatcaccattagacttttataaaatgatcataatttatatttactaccaagtatacaaatcaattggtataaaatttttgtaatttaacaagtgattttaaatttgaattctaataccatattaaatattgaataaggagaacttttttaataagaactgagtgataatcatttcataaatgataatcatattaagtttgagttcagcaaatttatccaaataaaaactcatgtaatgaatgattaaaattatttaattttaacaattattccatattcatcctcatagtcgtatccattgaactaaaaaaaagactagtacatgtctcattattaggctatagagtacgcactatgcagttgttgttgttttttaacggaggtgtgactggtgttgagatgtttctttaggggaaaaaaagaaaattgaaattgcggtttctttcgcttttgctttgtttggttttctttttggctgtttgagatagaagcgaatgatggtgttaagattttggattatttgatgaagggactttctttctagccaatttattttggcttttgtactagagaggcagcaattaattttcatttttctttttaggttacgtgagaaatgaaagcaatagcaaaacgaaggagctagaaatgaaaaaaactacggccttacaaatgaaatcccaacaacgtcagccaaaacaaacgttgctatgggtttggctctttccaactttggggacagctctaataggccagaaattattttattatcacgagtttattaattaattacctgtatgtagattaaacaaatggatgaataatgatgctcagaaaaacattggtgtctgaagtctttttcagaatttttcaaagatcaacgtaattattatctcaattaaacaatactagtattacttttaaatgtggtaggttctattattattattattatttttctagccgtgtttatacgcaaaattagtcaaactttgaaatacaggtatatttcaataaagaaactgttctggtaaaccaaagatagagacactctttctttaagttccctgctggcaccaaacgtggaactaatttctttttcgtgaaaaatgtccaactaattgcgaacgcttgctccttctctctctctatctcttcatgttgcgttggctcgtatttaattcagccatcgtccattcgttacaccataaatgcagtttttaagtggtggaccttaattgattaatcatgatatccattaatttggaatttagttatatgtcactttcacgcatgtatttacacaactgatagaaacttcacattagagtatatactatagagctattgttttcaagtgtaatgtacgtttttaaaagaaaaaacagtgtgatgtacgtacatttacaacaacgattcagcagaattagatatggtaaagtttgtttctgaggaatatatcaccatagtaagttccaaataatgagtaaaagttaaggatgttaactggcatgcattcagaaagtttgtagtatattttaatgtaacattttgtttctggtaacccttgggtctaatttgctcatagtccgcaattgggttggtgtgtgaagatttgtgcataatatgcccaatgatattatacaataataatcttaatcattctctaattgctcgcaaaggcatatgagttataataattgggttatgaagtcggaaacaccctagcaattgctgaatgatgtcaagcattaggaaacaccattcacagtcttccttggttgttttgattagttcaacgtgtacagattggaaattcttttaataatcgagaacatgccacactaatgaaaatctgagcttggaatttgggaagaacttcaacattgacctgggattctaggtaataatgatttctctttttccacttttctggtctataaagagatggtcggtaaatcatgatatttgcggtccaaattaaagcagtcaatttattaatgtgccatatatttgagtgagaaaactttgctcgtgttagaaatggaaaaacatggggcaggtctatgtttaattgtagccatgtgtgatgatatatatatatatatacaactaattaaactagtaattagtaaactcgttttttttctagcctcactttgaaatgcctaattagaaatcgatctagataattgtggttataatatgccaaatttgtgtcggcctgattcactgtgctcggtgattcacaagtttagaactcgacaaccatcatgtgacttggttgacatcattcactatctcatagcaccatcaaaataaacagctaaaatacctttgacagccaccacacgtcccgaagttggatgttgtgggttcagaattcagatggtttactacgttgtacaaaattcgtagaaatcaagggcatgcaggtttaatttgaaaagaaaagaaaaaaaacaagtttttaactactaattgtaaaatatcatcttttttactttattttttaaaatattacaatgagaattattaaaatgaaaatattatttttctattttttgtacatttataaagaaaaaataaggtgaaaataacgtgatatttttataattttatttttaaaatagaaaatattttttcaggtaaccaagaggtttcgaactcgctaaaacaaaggcatagggtgtcacagtcaactatcctctatcacaaggaggtttttgtaagattttcttcctcttctttttcatatatataaaattgttaaaatataaattccaccgcatcaatacaacaaaacagaattggtagataagggggtttggtgaaaatattgcgaagttatatatacagcatattcggacattgataacaaatctgccctgtgttgtatgcataatgaagctccacttgccccaactgttgctaatcaacatgcaattttccccataacgggtgggaatggaagtaagtgctttacttgaagagaaacaaaacaatagctagcttatagagtagagtagtattagtaaagttcgatcatcaatttggaaaaaaaattcaaacaattcgatccgttaattactttttagattcttaggtgtaaatgtaatggaagcatttttcaattggttgactttcatagaaaaaggcgcatgaggagcctgaaatctatgaagagtgtggccattatattgtgcccgaccaaataatttacctttttctatgtttccaaattcatccatctcgatcattggatttcttaattttcccagctgtctacccatcgttaatgtgcaaaatgtgttgatctctttccgccattatattgagtggttaaattcaattactatgatgcttgtctgatagattaaacgaaacctctttcgtccacacaacttgttttattggttatatatggggtagtcatatttagctacaatttccatccaacaattatcaaagttgttgctgcctacaataaactctggagttgttgcatcatgatgagtgtttattgtcctgtttgggtcactgggcccatggagtattattttatcatatttattattaatacaaataaaatacatatattataatttactatatctttcttcttcttctttttcaatagaagagctgttgttttttggactgaatgagatgaaacttaaaaagtcatctaattttggcccatcacttccatcgtgggtttttaagtttcaaaaaaagtcatttactcttgctttattaggtagaacctttccctactcactaatatcttgttcctttcatgggacatgtccggtcatgctacaagccgaaaccagcgttcaaaaatatatccacttttcattcattcaaaccccagttgagaagcatatgaatattttggggaaaaaaattaaaaaattgtttttttttttaaattacgaatttattataattttaaaagtatttacgcatttatagcaacgagtcgcgcctcccctgaacgtgactgattccgtcgctatcaccttttgcgatcacaacttctgtcgcaaacagtattagcgactaaaatagagactgaaagtatcgattaaattttattgaccaatgttttttttaaaaaaaaaagattcgcgccacgtggtaatttttttattgactaccctgctcccatttggtaaataaataaaaaaaatgtccttattggaaacattggaaaactttaaaacgaaaaataaaattaaacctaaatataaaacaaatcaaaagatatatttatatatttattttttttaagacataaatatatttttgatttttagttaaaccagaaatgcaatctaactacaagtgttagttactttgtcatactcaaacttcagcattagagtcttcggcacttcgcagatatgcaaccttgctaaagatcaatagcacaaggaaaacatgaacgcatgaagttggacatatgtgcaggagaactacattgtagaaatcgtgtgactgatcactcttaattgtctaaagctgttcatacatcaaatgatttttctacacatacttttttttagtgttgatgaatgcttctcaacaaacttattttttattaaaaaaatataatcaacatcttactgagaaatagtatttaggaaagaatttaattagaatatattaacaatgtaaaattcactattaactaattataaaggattatgtatggtaaaattgtttatcttagcaatgactagaatgtgaacttttgtgaataaataaaaaaaaatattgacatctttatattgttagaaagagacctcgtttcaattaattttttttgcaatagctaatcaggtactttttttagcgtattacaatagaagaataacatgaatttattctttaataaggaaaaaaataagataactgaatccacttattttgtgatacaattacaacatttgatgatgacatatgcacaatttataaacaaagtatgtattatcataatgtgtgtataccgtaataaaattttacatttaattaacgtgtaccacaaaaaaaatattttcttttatctaaaataaactccttcagttaatgattctaatacaaatgttgttttaataaatcaactcatgttttatatttggtaggaaatgtcacaacaataaagtcaactagcaaattctataaatttgtatcatagataatcaaatttacctatgtattattagtcaaagtaaaattaaacttgatttttttaaataagattttgagttcaaacttcactgaatgtgattattaagtctcatttatatataaaaaaagttaatcaagtctcatttatataaaaaaaatatattttggaataggaaaatattatcatttatatgtacttcaagcgtaattttaacttgctatactaaaatagtaaagtcacgttattcattacttgcttactggtataatagttttttttattggtaatttactagataaccctatagactatacaaaaagtaaaagtggattaattaagagttacacttttatgtgcaacttctctaaacttagcatgatttgcgctttctaattgattacgatgactgatttaaagcagaatttagaaagttgacatttctttcagaacttatcccttatcactatttaaacttacgttcctagttaatctgttcccaaatctcaagtgcgttagtgaaatttcgcgagtgacacggcatccacaaaagagaaaacagaattggagcataggttggagggttggagaaatagaccgcaagctcgctttggcaatgttgtcatgtcacacacacacaaagaaaaaggcacacaaagtagaatccaatggcagttaaaggaagtggggataacttttctacatgctcattgtggttcaaagaatcttcttagtgttcacttgaggaatcaaaagagggggaaggtaggcctacaaaagcatacctaatgaatgattatgagagtgaagggaagcttcaaaattcggcagtttgtgttactgctgtcctctctaacattaattgtccatggcttgtttgcctttgtagtgcaaagtatttattagtgatagttagtgcccaaaatggaacaatagcacatttgttaagtgcccaaacttgagctattaaatgagagtgacttttgagtttacctttagggatcgtttggtgcaaggagaaaatttccatgctcgagtatcattgtttattggaatcatatattttgaaaatcatatttcataaaatgattaaattgatttgattgatcataaatattttcatgagtttcataaaaataaaagagtaatataatatttttagcatgaactttaaattattttaaaggataattaataatcaaagaactgatacaatcagaaatgacagaaaaaaaatgtaaactaacatataatcgagacgtccttaaaaatcatgagtgatttgagttgtttattggtatatcaaactcaaaaaaatagttgttagttaagctttacaatacacttattttaccgtaatgaaatctttttattattaattagatttaacgtaagtgcgtctcataaatagtaaagtttcacaactatctctataaaactatgataagaaggttattgaaatttaaaataaatttgcactctcgattaattgctttctccattaaagtgaatgatgaaatctgacatcttgaactatctgttgcattctagaacttaggtttaaggattgattaggagtatgaaatgtatgaatactaaagacatctattctaagagtgacaacttataagtttaacgatagctctaaaattgattaatttgtcctttataaaagaactatttttttgagatgtaccaatttgtcttgcgtattgttaagaatgatatatgactgtcccagggagtgggtggttaaataaccgttattttatagagcagatttaatctccataatacattatgataaattgaaaattctagaaaaaaaaaaggtactgtacaaaagaaagaaaaaaaaagattttttttatttatttgaacagcattaatagttatccttgtaagtggaagcttagtaagactaaaaatgaaaaaaaaataaaaggactataattgacaatacaaaattacaagattaaaaatgaacaatttttttttataaaaaccaaaattgaaaaacatgaatctataggaattaaaaataaataaaaaacgtataggaccaaaataaaaaaaattgagaatttataggaataaaaaacatattcaagtctttatttaaaaatatataagtaaattaaatattaaaaaatgaaacgagtttttggagaattttccataaccttacaaaacccaagaaaatgaaattacatttaactaaactattttataaaccttaagctataatattttcacttttgacggagttaggatgaggagatcggattgtcaaatccgacctcgttctatcatgttaccatgcatacttttatatcatttttcatttaaaatctatcataaaattttaattacttaaataagaaaaacaataatgtaaagaaaaagtgataaattggagttaaatattattaaaagaagaacaaaatacatgtaagttactgcaaacaggaagggaatgatgcgggccctggaagcccagatagatatctagtccgcaaacaaaaataaggcgcgaagctcagagggaatgatgcggttcgtattgtttacgacattttaccagaaaagtgagtcatcaccattcgccactgcgattcatcggagagagagatcttggtgttttacctaatctctttgcccctcagtgggtatggtactatacacaccattatgctattatgctattttgctattatgctaattggtttattgatgcttgtcttctcatatgcttgcctacatactaagcattgcaaggaaatatttgaaaggaacttacaaaactgaaaggaaaatttgctcatttatttatgttattgttatgttattgctctcttctttttctacttgtcttctcatgttttaatgtattgctctcttcttttttttattgtaccagatatatgtacttatttttcaagtgcctgatgtttttcatgttttttcatacctatacataaatgttcacttttttcccataagccaaactaatgaatcattgacagctgtcaatcaacattttttgctttcattcctccctgttagttcttttttctgatttggtgccttacatgactgatagcagcgaatggggaacattgataatgctgtccctttctttggagttaagtttaacagaagctatccacttattatggttatatactcccttttggttgcaagcaatttctttgatagggtatttgattctcttgggagctggaagttatatgttttcgaaactgaagctgaagatatggatgggttagatccatcaggattaattatcttgccgaaaggtatgcaagctaagaattctgttattgtcaaaactttagttcaaaatattaaatgacaaatgatgtctaaattagtgaactttgttcaaatgtgggatttgttaattacttatgctgattatcaattcatataaatttgtagaaagatattggcttgagcaaggatgcaatgtaagcgagcaagttgttccactagtgaggaattttaattgaattgatgttgaatctggcgagaatattatggtatgtcaacaccccactgaaaagaaaatagaagcaatcttctttctctattttcatctttcatgcaacattatcaggactttgatggctgcaagatatgacatttgtaagtcttcttgttgtggtcaaagttcaaacagttcactcactttatagctgatatggttcaggtgaagaatggtgttgaaatgaagggaaattcttctttagttaataaagaaatagatggaaatctgcctaaaaatttgaagagacaaggagatattgctcgagcagggaagccatcagcagcagagtggattaacatctaaattgaaggcagaagagaaaaacttagcatctgctagggtttccttgcttgatcacggcaatactcattctagtaatgctgctggaacttcaggcttggcttcaacatggcaaacaatgaaaacaggttttcggagtttcggggctaacttagggggcaaaggatttttacccatacggcaaacacaggaagctaagatgtctcgtgtgtcctcatctgagtcccttgatgatatatttcaaagactgaaacggcctgcattggaccaaaatattcacaatgacaaggattattttagggggggcaatatttctggtccttctagatgatatccagaatttgggcgagaagttgcaagtgttctataattaatcatatgcaaaaacatattatcatgtacagtttcttgtttcctttggtagtttatacctcaaatgcattttaaagatagatagaaagatagtctttgatacaggaactcatactcgttacaaaatcaatctcacattaaatgtagattatccatagaaagaatacttaaatttgcaccattatacagcattcagatatttgttctgttttgattcataatcttatttcactacccgcttagcaattagcatacctctccattgtacattatttacagatctcatgttttgctcgtgtatgtacaccctgatcacagtagatattaaaaatgactagtttaaaacttgtggagcaatgggaataagggttgccatcacatggtaattgttaaattgcacagctgcagaaaagaatgaaatatttgtgaacatcgaaatgtaaagaaaaccattaaaattcccggaacaagccaataatcatcttaacaatagaagatcgtgctcatcccatcacccatcctctaattcagaggagagttcaattttgattcacaatcatgtatagttacatcaattgaaaaactggatataaattaactaattaaaaatgccaattctttccctccctcacggtcctggaatgcatgaaggtctcttgggtgttctttttggtcaatttgagcagcttggaccaaataccccttttcttacttcccctgttgctcccattgacttccctatctatggcttggcttcttgaagcaaaggcaattgagttgctcttctccaacccataattgaagctaaccatggaagaagcagaatccattacgagagagctatggcggcggtggccacgagacacataaggttgaggaggaggagggagagaataagttggattgctgttgtcatagagcttcaatagtttgtctcttaagcaagagggacaaacacccggtagttgcttgttatttgggtggtacttacaccctcctcctactgcttctaacttcatattctaatggtacttgttttgttcatttttgtgccttgtctcaatgaatttatagattcattagttgtagttgcaatgcataggaaatgcacgagtatacgacttcctcgaagtttcttggtaatacaaggaatgatggcagcgaatcaacttctatgactgcgtccaatctaatcgtatttctggatgttaattttttcccttaaatgatttttttatgcaatcttaacattaaaaaattgatgtaaaccaatttaaggaaattgcatccgtggtcatcataagattattatgaataatactagtcaaaatcatttcttcattaaacttataaaattgattccattttgaaaaaaaaaaaataaatagaatgccatgtgtattgtgtatctagggagaattcctttacaaacaaaacttccatttcaccaacgtcaagacttctataacgtggtttttgcaaaaggaaaaaatctcacgttttgaaaacggaggctaggctataacgagaagttaaatagactaaatagaattttcatattgggtatctgctgattttaactaatttccaaaagaaaacaattttgaacatattaattttgggttaattgattttgaacatattaatttagtttgacagtttgtaggttttggttcaaattgaattaatagactaaatagaattttcattttgggtatctacaaatttccaaaaaatcaattttgaacatattaattttgtgtaaattaatttttaaaatattaatttagttttgtatgtttggttcaaattgaattaaattaaattaataaaatttaatcatctttgactcagatattgattttgtgatttaaattttgatgacgggttacttgaataattcattgtggttggttaaaccagaaaataaatcagctgtgattttttttttttactggaaatctgctgtgaattaggaatatgattatgtatatgtacatttctgatttttttgtattattaaattaggaaacaaatttgctataaattaagatgtgattgtaacatatatttatgatagcttgtgtattattcagaaataaatcgttaaatctgctataaattaagaaacaaatatgttgtaaatctgtctatctctctatctgtataacaagacttttgactaaaaaaatgattattgaatcaatcagtttaaatatctacttagatttgatttcatttttgcttataacgtacgtatggcatctttttattaaaaggaaaaaaataaaacatattttttaatggaattttttatttatctaacaaacttattaaaaagtggttgcttgaaccaattaacttgaattttatctctgtttttttaattcaaaatataaatcaaacttgttgaaacgatgcaacaaaacttgtattaattggattaatacaatatgcgtttgacagaaaatttataaaattaaactaatttatttgaattgattcgaattatttctttcattaaaataaactaaataaatctactaaaatcggcgtgaaaggtttggataaatacgttttaacttcagtgtcaccattggaaaaaaaaaaaaaaaactaaatcaaccggaagacattcataaataattattatataattatagttgatttccctttatattttatagatgcattatttttttgttttaacaacttttcttacttaaggggtttcctttaatatatatagatatagatatagatatagatatatgcttcctaattgaccattaacttccaagttccaagttaatgcatttgaatgtaaccttataacttaaaaataataattagaatgtaacaaaaaatataatgcattagaattaaatgacgcatttcagtcatagacaaaccaaatactgtgtgtggacagtattacgtgaagaatgtttcttcaaagaaactcacgaagacaaaggcagctaaatcaacgtttgtcctttgactatgaagaagaatatgtagcaagtcaaggtagcgcacgtgagatgattaacagaaaagaaaagaccacccacgcaaaatatcaaggtttgtctaaaaaacaactctgctaattgtatgtctatttttaatttaattttaaagtattatatgaaatagacacactttaatttatgtatgggtaaaatatgtttgactttattgtaaaatttagaaagtattcataaaaaaaattatattaatttaatttgtgtaaaaataaaatatttttttattagtattgaatgataattctattagatggtaatttgccataattagtaaaattacacgtctaatttaattataaatgaattaaataatttgtaccaactaaaaactttcaatttggattaaacaattggactattaaaaaccttcaaaaattataattattgttactttttagacgattttcttacactttttatgagattaagaggaaaatgtaaaaacattagattgggatatcttttgagtgtatttagaaaaataggaagaaaatacctaactctcttaatcacattagaaattctctaatggcttgaaatcaataataaaaatatgtattattattacaaagaatattaatacgatagttttttattttttcaagaatttcaaatattctttatccgtattttactatcaatttattcttattaattggtatctgaataatattaattaaaaatatttaattatctaaaatataaatactaatattttttgtgttttaatataatataatataatacaatattttttaactattaattcatattttaaatatactggttaatattatttttgaagtttactccatccgatctcatttattttaaaaaaacagtgtattttaatcctaaatataagtatattttaattatttttgtcttatttatgtttgatattaaatttcaatcaaagaatgatttagaaaaaagagtttattttttaattaaaattcacataatttaattaacttaactatttttttaataagcgtgtttctttgtcttataaataagataagaaaaagtgtcttatataattttttaaaattacattacgatgatagattagattgctaagcaatgaacctgcacatcaggatattctcgtttattgaaatggtcaaggaaggagacatattgacgtaaaagcccattttggcgatcgaaattcgaaacactgcttaccgcaaaatataaaaaagaaaagaaaagagaaaactgtcaatgtatagaatagggatgttgaaaatactaggtttccgtaaatttattcaattcaatgtaaataataaaattattaaattcatagaaaataaagattgaattattatttttaaaaagaggactaaattaaatttcatattaaaatttgaaagttaattcaatctacttcaagtggaacttataagtacacaagattttgtttataaaataaatatataacttgtataagtaaatatttatgatatgactacgctgtttttttatggtttcactatctaaattgggtcttattattattattattattattattatattttgtgtaagtctattaattatgaagaatcggtttaatttttttacctaatattttttactatataaattttgtatttcatattgaagaataaattttaataaaaaaatagatataagaaatacaagaaatggtttattatataaatttggtattccatattggaaaaaaaaacagtttcctatgagtagctaattgtgtctttgagaaaaataaaccattcgatgtttttttaaatttcagctatggctcagtgtttaaatatttgcaacaaatgacaaaataatggggccgttatgtatatatttttggttgttagaggttcaaagatatgcttttgaggacccataaagagggtgggcctgatgggctcttcgaatgtcataatgcgggcctcctctataattcaataggtctaattcggaaccgtccgataaaatcgaatattatctatcttagagatatatcaagggataaataatcggaccggtccttaaatttttttaaggctttaagggagccgtatgaggtgaaaatctcatgtacggttctgtaatagagatggtaacagtaatgttatcaccgactaggattatctaacagtttaagtacagttgatatagttgatgcacaatcaaaatatggtttttggggatggaatttgtggcgtcaacctatgggtttcattgtttttctaatctcttccctagcagaatgtgaaagattaccttttgatttatcggaagcggaagaagaactagtagcgggttatcaaaccgaatactcgggtatcaaatttggtttattttatgttgcttcctatttaaacctattcatttcttccttatttgtaacagttctttacttgggtggttcaaatatctctattccatacatattcgtttctgacttttttgaaataaatcaaacatatggagtttttgtaacgataattggtatctttattacactagctaaaacttatttattcttattcctttctatcgcaacaagatggactttgcctaggctaagaatagatcaattattaaatcttgggtggaaatttcttttacccatttctctcggcaatctattattaacaacttcgtctcaactgttttcactgtaaaaaaaaaggtggaccttatatattcataacttgtgtcaaacaagagaaagaaaaaaaatattcagagatattcatgatatgttccttatggtaactggattcataaattatagtcaacaaacagtccgagctgcaaggtacattggtcaaggtttcacgattaccctatctcacgcaaatcggttacccgtaactattcaatatccttatgaaaaaataatatcatcagaacgtttccgcggtcgaatacatgaactctacgaacctaaagcaaaaccttttttatttcagggagaaaaggcaaaaccttaatagaaacgacctttcttatattaaacctttatgatatgataatcctatggcggatattgaacatgcagctccttcctagttattagatagttcagatcaccacttgcctttgatctcaattaatttctacttaaatagtatatatgtaagttttttaatttataaaataataataacatttgattacatgctatgcaaaaattaataaaaatcattataatccaggaccaattaataatttttcctccatcagagtactttgaataaagtctatttaaaatgatacaaggttattcagttgtcatatcagcttaatcactgaactttttaaagctggctacaccacattttcccttgaatgttgcctttcaaactaatacgaagcttccaaactatacttttgctaatgtaaagtacatttcagtgtcctcatcttgaaagcctcacgggaatggattatcttcacaggatatgttccaagagaacgacacaaattcaagagtggcttacgtgatagatagcaattcataacagatccttggtcaatggtcaaaaatctgtctggttgccttagttttgagtaaatgcttactaattaataacccaactacactatcttgatcttgttgtattaactaaagggagaatggtcctaactttttgggtatgccatatttataatatcgaaattaattgtttaacagtttgcgcataacatgataccaccagctaaaaaattaaagtatagaatttgaactgcaattacctaaagatgcaaattaatttctaacactgcatataatttattataatcttaataacttattttacaattaacaaaaattattacactttttttaaaaagtgcacctcactctaataaaaattagaaattaacatttcattcacagtaactgtcaaaatcaaatgtcattaaaaatagaacaatgtttacttaaaacaaattaaattaaaaaaatctacaattcttttttctttttattgtttatcacactattcttcttatcatacatttctttcttatttttctcttaaattgttagattttttttctctcctaaagtataagagttgtgaaaataatggtgtaaaagtaacatttatttcttaaaaatacagtaatataataacgaggaaaatgaaatagggacaaatataaggaaaatgcatgcatgtttttgagtccaagtaataggcaattagaaatgttgggttgggtctatctagcgtttgagcttggctgaaaagtccgttaagttggtgggatccaatccaatgggccaatactactccagccttctcaatgttgacctgacctgaaagtaaaaaataatacagagaaatccaggggcgtagggtttgagtgtgtggacagtggacagtggacagtgaacagacacagatcaaaagaaaagaggtgggccaacataagaaaacgacgtgctctgctgacattagaatcttttcagtcaccgtgcgtggccgataagttagagccaaatttcacaaggaacctgaataaccaaaactaccgcatgacgagaatatcatcaccacgtcagtatataaatcaaaagatgttctcaccgctgattcgatgcttagatcttttagctatgatttgaaattataattaaaaatattattttattttaaattaaattttcagtctttagctctcttatttatgatgaaaataaaccttcattaatctgaaattcgatcagaaaataagtaaaatttgacaaaaaaattatttttactaagaatcaaattcacataatatacaaacaattcaattttaattttaatacattaatcatttttgtctaattactttatttattttaaaattaaattgacatgatgaaaaaaaacctaaatacattcttattacacaagaggaagctaatatatatagaaaattagttatttttcttcacatattttagtttgaagatatttttacttgagatattgtatgacattaaacgtgtatagagtttttgatttctagaaattcaaattttaatttgtcatataagagacaaatgtcttttattagaaacttacgattattgctctgacctcatgacataatgcttatttaagaattagatatgaaaaatagaatttaatgtttaattctctactaaattatgatttgtgtaatatgttggacgaattatatcatattgataaagattcaaagactgtgtacataggtatgaaactgtacaattgattatgacttaacaaattaatcggtaatacatacttatatccataagatgtatctatttttcgataatttattatttaaaaatttcataaataagcgtgtttaggttaaagtaattatgagataaataactttctaaaaagtttcttaagaagtgtgcaaataagaacaaaacacattaaaaagtttcatatttatttcaatgttcattgattttagaagcaattagaataaattgtcaaggtctaaaaaaaaatatctataaaaatttttgacttaaagtgtgatagagatcaataactaccaatagcatgttgtatccaaatacttggaacataaagaaaaataaccaattttctaatccctattggatgtagaaagtattgggtggattgaaaagtcattcttgcttttcttattttttcgcatttcactttcatgacctctctcatgtaacgtttagatgtgacctaataagacgctctctatatagttctggggtctacttgatacttcccaccaaccatgttcatctggacagtgagactcagcctccttgcacctagactctttttaattaacatgcaccttcgaagtcctgtccaagataagcatccatgcatctttaatggacgtcaccttacataacaacaagtcttaatattttatatgcttaattatgttttagccatacatctaatattattatttggtagttttatccttgggtctatttttcaacttgtcattcatgtcttgcaagaaacagatgggagtagctatcttcctgggccatagttcaacttcaacctcctcagcgccgccgcttatggaaattttgtagtcaccgacgaacatacaaaccccacataggataaaacccaaacataaaatgataaaacaaaagtcacacaataaccttaaaatcccataaatttcgacccaattcatcatcttcccattacgattgttgatggagggtatgttgttacttttttttaaaaaaagaatgttgttacttgttagtgattgatgaacttgtaaagtgggacttatagatgttacttcggcagtgtattttttaaaaggaaaagtataaaattatatttctaaataatttatgtaagatttttaatcaattgccattctaacgtctgtctaagtataaaacgagttctaaaatataaatcttttaaaattaataaagaaaatttattaaaattaaatacttctgataactaattttagttttcaattaatggagagaataaaagggcaaatagatgtcaaaccttctttatggaaaggggaaaaaaaggcatcatcatatgagaaattttatttttcagaataaaaaaaatactcactccagttactattaatattataaggttgaagttaaaagtgcgatttaatctttttcataaggtctaatctaaaatatattttttttgcattgtttatttttttccaaaaaatatcattaaattcaatcctaaaatagtgtgataataaaaaagcataactcattaatttgttatgttcacaggaataattttgaaaaaatattaacttaagataaatttaatgttttcaactaaattaaataacttttttaacgataatgagtttagttaaattagacgttataataataacatgcaggagtatttaattaaacatattaaactaatgttatttatcagatattttttaaattttgtttaaaatataaacatgcagaaatatttttaggaatgcgtttaattgtccttgcttaacccataacggctaaaaacgacctaggggctggtgcaccttgggtgtggaagtttggctatgggattcttaagcccaatcacgcatccagcaaatttctggctgcagaaactgaatcctacatataggcaaatatagttattaattataagtgataatttttttttaaaatatttaatataattatatagttaagattcgattccaaacttctgatttaattaaaataatcttatgttagttaattcacgtgcttttaaataaactgcttcctagtttgagctgcagttagtcaacttgtcttagaaaaacaatttttttatccttgttttagaaaaataatagtttatatatttgtcaatttgttgaaaattatgattagtttttcaaaattaatcgcaaccaaatattgacccatccatgtaagtggaatcacttccattattagtaaaaactactgagttaatggatattaataattagattactgatcacatgtagaaaggaaggacatctttaattatatcatgtcaataatcaatgcctatcataataatttatgtttgcatcggatgacggtaaccacaactaaattgccagtttaataacactgccacatgtccattttgatgtgtgctcgaaaggtttcttgacctaagtggcaaatttggtttagtttgagatctattagtatttagggaaaaccaggttaaatatgatcaatcaatattattcatttcttttccaacatatctaacagctaataccaaaaggagtatacatgaccccttctttaaaaacacatataacttttttttttttttgagaaaaaagaaaacaaaacaaagtatgatcagaaaacatggttgtgtatagtgttagaatgataagtataggtagaatattatagcattagaaaaatatgaataagcttaataatatataagtgaaaacgacctatacaagattcatttggaggtaaaaatataataaaatagattaagatatgaaagcacaagaacatcatacattaagattaagataagataaactttaattatatctaatagtacatagcaattaataaataagataactttattgaattatcttgcctatttaatacagactagataatatgatgaagtataaattatgttcaaatgataaaattattatttcattagaatataactttttaaaaagtaactctcaatttattttaatttttaaaaaatttcaatttaaaaaaatattttttattatgtagttattttcttaagattaaaaaaatatttgaatcacatttttaagatttcaattattattcaaatatttgaataaaattatttaactttttaatcttaattaaaaatatactttaaatttacatgttgaaattattatgtaagtacgtaagtttgtttgatggttgggggagggaaataaaaattggagttgtaagaaggttatgaattcaaaattttctacttacataataaattttctaatgctaacatttaccgatcaaaaaatatattaaaattattataaatatgcaatataattttataatatatatatatatatatattaatatgtatattatatactatatattattgtatatattatattgtgacaagttttatcatatcctttaactttttaacgcatgtcaggttccgtatctcaaataaaaaaaatattattagacttacaaggtaagatagaaaataagataaaattattatatcctattgatacaataaaaaacttatcaaaacatgataagataaaatatatcctattttatcttataatatattaactaccaaacggctgtttaatgttaatctggaagaaaaacggaaagggaccgggaaaaaaaatgaatctttccactatgacgttttgtcaaggaaggaaagaaacccaaaaaagtaagtgggtctaactattttataatccatccattttggaaaagaaaagttggagaaggtagcttttctgaaataaaaatgtaaaagtatcccttttttattatacatgttttttctttttattttattcacaataacataagaaaaagtatccctttttttttctttttttttctctcttaccaaacaatctaaaaactattttattttactctttttctttgtttcttaaatcaaacaaagcattaatatataacattttgaaatagatatatgaaatttatttatataatttgttcatagttcattcatgacattatccaaagaaatgttacgtatactccagttcattatgatatttgtatgcggtaaaatatttataatctacactatctttttttttttttacttcaaaaaatctaagttatcataagtaatgaacattattaaaatttaatttatcatgaattctaatgcaatactccagtctccaattaagacaaagtatcttgctatcaagctatcacattatagatcttagtgcctatcaatggggccctattttgccccgttattatatgttgggcccacttgtccctaccacccagctgagagctactttctttatgggccttacctaaaagagcaacctttatgaccttccagatgaaaaaatctcaaataaatcagagtactacactcacaattaaattttgatttaaattgtattactaaatattataactttaaaccaagtaattgtgtagaagtaattaatatgttaaaattaagattgaatcacttatgtagtagtcaaatttaattcttatcaaaaataattattaatcaaattttacttatttcctaattgaattctagattagtcaaaattttatttctcctcatgaactaatgaagggttaaggaaaaaatattataactttagtttcatgaaacttacagttataatgttttaaaaattatagtatttttctttaatttgtgttttaaatcaaaattttcaagaaagggtgtttatagtattttaagtatattattcaaggtgtatgtgaaaattcttggtttaattagtcatttaattcttatacttatataatttttatattttaatccttatacttaaaaattactcatcttaattcatacacacattttaaaatttgtttttgttggttatctaaaattatagagactaaaacgaattaccaaatatatgtgtaagaattaaaacgaacagtttctagacgcagaaactaaaacgtgaagattttataaatatttttttttggtgaataaataaaagattttataaacatagtcacaaataaataattaaagaaaatatctcgatggatgggccaaggcatggccctttctcataatccttcggtctgtttttacctaagacgtcatcacgcactgatcagtgccattgtgccaatactgtttagaactatattggctatggcttcacacaagaagcttaagttttatgctaaatttgagatgtttaataataatttaaaactttaaataaggtctagttagcagtgttggctcagagcctcagctcttgattttagacgctgaactataaatagaatcacgagaggaatatgtaaaaactttaaccaaactatatttcactaaactacgagtaaactgttcaaatttttgagacgttgctgtcttgccatgacaaaatgttgccaggctcatctctggttataataataaaaaatcttttcatggactatatagttctatttattccggaccacaaaatgaatgagaaataatatttgtacattttttttatatataacctataaacacgtgattccaaaaactattgtaacatatagcaatgttgaaatttaaaacataaataaattacacggatcctcctgaactttatcttcaatacactcgattgatatcccaccgttttttaatcctatagtaaattaacctcttaattttgagatttcgtcccaccaggtctctcttaagcgttttgttataccaatccctcttctagatataaaaaatattgttatatgatcttcctttaggggattcaaaataatgtaaaaacttgtgcgccacactgcaagctcacaaacagttcattttatcgtcttcttgttgaatttagcattcttatcaaacaaaagaagatcaagaaaaatatatacaagaacaaaaagagaacaattgacgcggaaggtactgaccagatagcttttgtttttgacacacttggcacacatagctgtttgttgcatgcattatattttgcgcgaaaaatgtcgttttaggtttaaccacaaagtgcagacattgcacaaatcgaggaagtgcgtctttcatgtatcggcttgcttttcattattttaatttttgggttgccaagtttgtttatgttcacttctgtattcttcctccaaaccaaacatgtgcacactattgctatgtgtcggcaggtttgatgactacaatctgttgttctctatgatcactttagaatttgttcaaactccttgttttaatttttttattccagcctagatgatgacaagtactgggtatgaattatcaatccagtaaagtatgggacgatatctgttgagaaagcacaaaatctagtatttaattcttattccaatatgaaaaatattttcagcacttaaaattgtactcttatgtttcttaactatttttttccagacatatattacatcgctgccaaatacgaagttcatactctaggaaacatttgaatatttttcatgtgatttatagtttttatttatttatttagcagaaatttaaacacgcaactaagatgacacagctaattgttgatcaaagtgatcaggtaattatttttttctcaaatgaagtattcaatttgtgttaagtgaatgaaaggaataaacattaaaagagttttttttaaaaaaaatgaaaataataacagtaattaacaaactatttttttggaatgtgtaaagtgttactattaccatgtgatactcaataaataaataaaaacatgtgatactattgattcattatagtttcttgttatcatgttataaatgcaaaatgaaaagtctatagataaaaatttatcaatatttatctacaaaacttaattaacttaattgatgtaaaatatttttttaaagtatatttttatatttataagacttaaactcacaagaaatttttagtctagtttcacttgccaagattttttttacgttgttgttgtgaatagtcgtctataagttatttttaaaaaggtttggctagaacaatagtaagaaattaatttggtaattacctcagaaaaaacttgtgtttgtaagaaaaatagggaaatgttaatcttctaacatgttatttataatatattctttattattgtatgaaaattagttaatatgcatattatctgataagatatatattaatttcgttaaataataagaaaaaactttagaaaacatgtcaaaaaatatattactataatttcttgataagggtacacgggaacacatttttaattatttcagtatatagcttttaaatacagattttttttatataaataatgaaagttttttttacaaagtatcctttcagtttaagaagagactggtgactaatgtctctaatgattattttggaatattattatgtatcaaagctagtattcttttaattaatgatttttgatacacataatttttgaaataaaattaaataacgctgtatatttaagatattgttacctcccctacccccaacattttatcgtgcaaacgttcatgcattaaataaatcacttctcttagtcagtactcatgattaacatatagcccactaattcaaagccagattattagccaagccagacgaagcatacttggctcggatgctatttagcagcagcgccaataataaaaagatgggcagatagggacgtaagtgaaatttaatggtgataacgaaattattattttccaatatagcttcattagtgccttctctctcttatataaataagtatattcttgcatttgcattgcttttcaacgccatgtccccaccccgatataagacacgtaccaaactccaaaattttaaaaaagttggaaatggggtcgctataacataaaaaaaaagtattaccctggtaattaaaaatctgccgaaagaaacaaaagaaaaatgggaagtctttttcatgcatgagttgtgtagaaaaatacttggattgcctgaagttcaaattacaagttgtcaggacttaatcataaaaggagaatccaaccaaaaaaatagtttattaggtaagaaaatctcaaatcttaagtatcatattaagtaatatattttatatttattgttttaacatgagacttttaacattatcattcctttaagagatgatgtttatggtgacttttattttatcaacattaatattaatatggtggtagttatttggttttgacgactttactcatctattagtattcaatttgtaccttaatttagtctataagcaatcttttacatgatccaactcataatgaaaaaatcaatttttagaatttaaacataaaaggagagtctaattcaaaatattaatccattaagtagaagagtccaaagacttaaatatcatgtagtgtattcgaatttgagatccttaacacaagtgtaattaaatagagaaaatatataaaagcccagtattttctttcttttcccttacactttctgttaaaatgcaagcaactaaaatttaaataatatttgttacatattatgcatattaaaaaaatttatatttttaatatatatatatataacattttttaatatacatacataatatataattgttatatactatgtcttatacatctgcaatatttttttgtatgtaattattgagtaaattcgtaacgtatcattaatatggtcatttttatttcttcttattatttgctgtatttttatatttttttaatcatgttataagtttaaaatatttacgcaattttaaaaaatgaaaatacaatatatatatatatatatatatatatatatcataaatacaacaagccaacaacatactaatttactaacgatgaacttaattaaaaaccattgttaccaaccagaacaataaaataacaaaaaaaagggaaatataatttttttttaaatattaacacaggttgacttaactcatccaagttaactcacctcaaattatagatcaagtgaagctatccaagtttacttaaacaaataaattgagtttctcacataaattaaaattaatttaagtactttaagttttatagaaactctcactaacctcttaaaaacttgaaatgataaattgatattagtgtatgataaaagttcaatttattttattttattttttttctcaatttttgtgaactctgtagattgactaacaggttcccttttctcttttctatcaatatttttcaactatgtaaacgagtctcgcaactagttatgggaaaatctgactctcatcagtaataattatgtgttaattttattttttttgggtgattttaactttgtttccattttctatattttgatttaaaaataacaaataaagaggatggaaaataagttaattttctatcacaataggtgtagatcaaggtttgactcttagtttgtatctttttgccttagtgatagatgaactaacaaaagatatttaagaggaagtgtcgtggtatatattttttacagatgatattgtgctcactaacgagatcaaagattgtgttaataggaaactagaattatgaaaaaacactttgaagcgaaagaaagaccgagtatatgaagtttgaattttcacgtaacagatgtaatcaagatatcgtacatctaattggtcaaggggtacccaaaaaagatgttttaagacatctgagatcaattttgcaaaaaagtgaagagattgagtaagatgtaaatcatagaatcagagtatggtagataaaatgacggaatgcatctaggttattgtgtgacttcaaaatttctcttaagctaaaaagaaagttctatagaacaactgtacaatgttatatgaagctgaatgttgacgaaaacataagcaatatgatcataaaataggggtagcagaaattaagatattaaggtggatgtgtaatcatacgaagatggataagataggaaataaagatatttgatgaattgtaacaatagtaccgatgagtgaaaaaatgagggaacatagattaaggtggtttagacacgtaatgagacgatccatatagtgggatgtagattggcggacagtgtgtcttaggacgaaatgaagaaaaactataaatttgaatgagggttagacccgttgttatctcgatgttgcatatgatccctttttagttgttttcttcttcatctccccctcttttttccccctcatttgcttttatcttcttttcttttcttttatcttagttcccatttttcttttttaacatcttcatatttatcattaggttcatctatcaccaatttcaattaacttggattaaaattgtgtttatttttatattttgatttgatttgaggtaatttgatatgttctgaaataattactacgtgatatttttatagttcttattcttttgcaggttttagagaacctgaaattatgaacaactatagcgtttagattgacattgatattcttgatttacttaaacacctattctaacaaaaagaggtgcttttgtatatttcttttaaccatatgaaagtattcatgatagtttatcaagatgaaacaatgaattgcgtagcttttgctcatggatatgggtatgttttgccaaaatttataagtcattttgggctaagttttaattgttagattagtttcatgggatgaattgaattaagtaaatagtatttgagaaaataaaaaataataaaatgcaaaatatattattgtctttcttttgcataatgtcaaagaaaaatagataaagtggtaattataaaaatagtttctcaaaatttgattactttattttttggtttatatttaattcaattataaagtagtaactataaaaatagtttctcaaataattattaatgtgtaaataattttaatttttccaactcagggactgaattacgattatgattgcagtggctattttggttaccaaacatagaagagattaaagaccttttgctaacgacataataataacgttaattttgtaaaattattattctattttattcatttattaatttttttagtatatataacacaatctaaaacgataattataatgaaattgaagaagtattacctttgtttactattgagtgagattgttaacaccttcatcatcgatggttaatgcaactgttgctattattgttaactacttgaaatacagaaatttcaaatttgtttcaagagtgagaaggaatggagaatgacttttggaccttttgttaaaatttgatattaattttaaaattaaaactaattttccattatacctttaaatttttaaattttgattgaaatactacaaatttagattaaaagaaaaacaattcttatcaattttcaacatcaattgaaggagaggtgttacggatgtttggaatgggccaagtcataagagattcaacaagacttagactattctgtcaaatagttctagtaatgagaatgtggcaataatcgtccaaagccatgatcaccaactttttgggattctcggtatgcttcgcgggcagggccgttcctgaaaattctttggtccaaggcgaagtaaaaaaatgggctcctaacacacaaaattttttaaataaaaataatattaaaactaagatatggaaaaaatgaatccttaacacacaaattttttgaaatacaaataatattaaaactaaggaatggaaaaaatggacctcacccacaaaaaatgggtctttaatacataaattttttgaaatacaaataatattaaaactaagggatggaaaaaatgggcccctgacacataaaatttttgaaatacaaataataataaaactaagagatggaaaaaatgagcctctaatacacaaattttttgaaatacaaataatattaaaactaagagatggaaaaaattgacccctaacacataaaatgaattcttaacatagattttgtttttattttttttttcaaaataaattttacttaaactacctgtacaaaagaatttgggctctgggcgaacgccctgctcgccttgccccagggccagccctgttcgcgggtaatctcttctaactgatttccacgtgaatgattataaatatgagcacttccaatggagtaaggtacatacattctgactttcttttccttacacacagtacacacatctcacgtccaattgtggtgtttcctcttgtgagcattgtaatctttttcccttaggtattttactaccattgacgtcctcagagaaagagaaagtttgatcatatatcaatcgtccaacattattgttggatatctgttcgtagcggacaaaacaagagggatattcgaggtagatttaggaacctcgtgtcatttacgagccaaactccattggaatactttgcaatacttgtaaggactttgctgttcaaatgtgtagaatttaaatatgtgtcgctctttaggtctgttaggctttctgacagagctccttatgggtcaaggtaatatttcttcttgcgtgatgatgtatgagagtgcctctaagatgaaaccctttaattacaatgtatatatgttgttaatgcattgtgttttatgtcatactttacgtctacataaactttgatggagtatacaagaagattctcaagttatgagggacattcaggccaaccaagcataaggctagataaattctaactaaaattgcaataataacacaatctaactgctcagatttcacttatatatttagttgattctttaattaggtccaaagtataaaccttaattgttaacaataataattataaaaaaaagctaccatctttccctttgatattttttcctaatgtagagtcacttatgcaattgtttccatcaatatacttggttaactacttaattttctgcaatgagccaataactgagacatcttacattccaaatggccacatcaaggaaatttgtcattttttttaagaaaataaaaaataaaagtattttttataaattaaaatttgcttgtgaaaaattaaaatatttttttcagagaaaataaatgattttaacttcttcaaaaagttgattttaacttctttttttaggatcaagactttaacttagatgttggttttagtttatgagagaagtttattttattttatttttaattttcttctcttataaacggttgtggagaaactaatctaaacaggaacttaactataattatttttaacatacctgtcagtcctcaatttttagctaattactccatttaactaaatattttttctgtattaacaactacaacatacactaaaaaaaccttccatggtgcgtaaagagacagaaagctatcctctccctacctcttggcttgagttcctttctggatgtttcatattccctctcatttttattttttattatttttcatcgttgttgttagatccccaataactttgttgacgagattaatctgtcttcttagatgaaacttaacctacagttaagaattattaattttgtcatagtataatattcggccgttgcgccgattttatgactagttcgtgttagcatttgatctagaagtttgcacagataatggacattaaaatgtacatccataaccactactgggcccagaaagaaaaggatagataaagaaatattatagctgagcggtagtcttactcaatagccatgaccaacctctaactagacacatcatcttacatcaaagcctaataatattaatattaccgcataatactataaggactaattttaagtacttaaaataattttattatgtcagctaaaaaattataattttattatcattttttttataataagcatttttaataaaaataatttaaactacttaaaatcagtataaaatgctgttattgattaataaaattatttttattatgtaagcagaaacgtaaggatatggaagatttgatggtgcttaacatatttcaagttttcaaatttcaactaaaaataacatatattttacagtcatattaccttcaaaatcaatcataaactaagacgtagccgtaccttgttgcaaatgatattctaattaatcttgcctgtatttgttgggcagtctgaacgtctttcctatacaatgtttcaatttcaactatgtttattttgtcatttttttcttctttttgggtgggttttatttaagatgtatgaatagatactcgtcgaattttaagaatgtgaataagctgctgtaaaaagaataatgtgaataagctcgaattgattattattaaaaaattcaacaaactaagtacacaaaaaatgtgcgttatagaataaattccttttatattaaatttttacatgactcagtcattagtaattttttttacattttttttcataaaatttactatattaataagaagagatacgttttaattagtgctttaaggatacagatcttaataaattaatgaatatacatttattagtaatcatggttggattgtattgaaaagtatgatggaatgtgttgataattttttttcattttttatttttatttttcaatcagaatttcaaagttaccgagagtgaggaccaaggaatgaggatgaaataaataaaaaattaggatatatgtatttatatatatatatatatatatatatatatatgaaaataatacatggaattttaaatcttttattaaccgagtaacatataactagtttgactaacattagacttgaattttttaagtgttgcctcgagtttgaatcttaaaaaaaatatagttataaaaaaattcttattaatcaattagattctaaataaatattaattattacaaaattagtagatatattacattaatgctagctattttaaataattaaatctttggttactagataacattgtatcaataaatgtcaagtgacctgaatataatgcacacgagtaagtgtgcttataacataggtcattaattattttaatcacaaaaatatcaataataaatagtgcttacgaccattggtgtaaacacaaaattataagcatctgaacaatttagaaaatcacatacaataagaatattgatatcatacgttgaagatgtttataaatctataaccttatccaatgtgaaattcatgatggtcaaggaaactacaataaaagtaagtatgtatattcattaaaaaataattgatgttcttgattcttaacaaaaacgaccataggcatccaattaaggattttgctgggcgatcctacaaatttttattagaaataagaatgaatcaaataaaagtaaaagaaatatgttaatacacaatgataaattaataatttaactccgtcactgatatagttactttaatactcatgctcgcttcgtttataaccttggtaaaaaaaattcacctgctttatttgcagatatatgcgttttttttttttttttcatcctagtctctaactctgtcgaacagacatccagaggttcccactcttgtcatcatgcatgaaattctttcttgttcttcttttttcgctgattgtcatcatctaattcatgattgagcaacaactcttgtataaaaaagctgcagaggtcgtgagtatgaaaattgtgcacccacggaaagagctttttggcagtcattttcttatccgttaatgttcaactcccaacacacctatgttcctagttagcttcacatcattaagtaattaaataatacatcaccaactgcttccgttgagcgtgtggccacagtatatgaacacacaagagaaatgttttatatgggtaaaaaattatcatttattaagaatttagtattaaattaatgttattgacataatttttacaatgaaagataaagtatcaatgtaaacattatattttctttttataaatagcataatatattatagcatggtgtattaatgtgctctttctgtatgtatttttcgcactccttgaatctactataaatataattttctatttacggataaaaaactaacaaataatttttttgatatagaatattaatataatacatgttgttagtactgactttcaaagttcatcttaataattttgtttttattaaacaaaaattatactaataaatacaattctatcacttaatcaattttatcttttaatggacacttaaaagacatttttatttcctataatttggatattttgtttttttttagaaaaaataatatatataataacaatactgtaaagtttttttacactatcattttatcataaaatattatttatggtaagtttgtttaatactatatatgatcttgtatataagaaataaaagtggttaaattgtttaattttaattaataatataaaaaaatttgaattttttcaaaactagccatattattaaatagtttaagtgatgattatatttcaaaagataaatttttcaccaatgagtttgtcttgttttgttaataacttaataaatgtgtctagtttcatgtgatatgagtctctataattaataaatttcacaattattaagagtaaaaaaaaagttaacaattaatacacttaaaatggtcacatatcagtttcttataattaggataattttttcttcttcttttgtttcttatttaaatgtaaatcaactaacatgagattgtttgagcttaatcagaaatcttagattcaagtctgaatatatagttgtgtgatatatttggagggagagttttgttaaccataataatttttttgactcgaataaaattatttctaattgatgatacttgtaacttaaacaaaacacagaaataggtcattttcatcctaaaaatcttactaaagcttatttttaattgtttgacaatataagttttttttactgatggtgtatatttattaaactccttttcttttaatcctcatcattagataaacttcattaaaagattacgtgataaataaagtataacctcatcgcatcagtccaattttacatagtgatatgtattcaaattatagagactaaaataaccattgtccctatatagatcaatgattaaaaaaaaatggaagaatgggatgagagattgggtaatcacctaatttaaaatatgggacatatgatagtttagtaatagaacgagacaattgccctagttttgatatgatcaaattgggaaacacaaaggagttgaaatgtaagatattatccccaatcaagatttaagggaataggattgaataataataataataataataataataataataataataataataataatagtaaaaaggaataggattggaaggttaaacaaatatggaatgacattgaagatttgaagtaattgtcagattcctaataaattaatattatgtattctgaaacaaattgctactacaatcttaccatttcacatgccatcacatgtttcatgtttctcgtatgttacgatgaagatagaacattgaaaatattatattatttggatgaaaaatattgatgcataaacatggctggcatggaagtagattataaccgtgaagagaatagtaatatatagaagctaaatcgaacattccacaaaagtttttagagggaataacaaattgaaggtctagaaaaaccgatgttagtttttcatgtttacaaatttgagaaccgcacgtgtcaaggtatttagttaccccaaatttcacattttcacttgcatattcttatcttgagagaatctattaagagggtgaaacaagaatagaataacatgttaattgtctaatttagttttgaaataataagatgaagggtaaagcaaaggtaaaagaacattagggagatgtaaaaaaaaccagtttctcccctgtacttaaagttttgctagataatatgagtaactagattaaattaatttaaacatatattttaattattgaaaatgaatcaagtttttggagtgcttggctaatcccatattttctacttcaacttttttgcttttgaaaaaaaatgaaaaatgaaagaaaacaaaaatctgagtctttagagatgccaagtttattaggtagatgagctgtcagcaatcgtggcgtacaaagaaggaacactgtacacattctcgtcgtccagcttccagctttggtgcaatttttaagtgacggtgacccctttgaaatggacatgtttgatgcagcacgggagtgggacccacatcacatggctctaccaacacaggaaccaaagctaggggcgccatgggacccacttccatgtaggggaccactctcatttccttttttttaaaaatattttctttgttttcctcgggggtaccgcatttcttttctctatctggcccaatttatccctcctaactccgaattattagaaattataacacaaccattccaatgggtattgggaaatcaaggatcagcaaggcttccaatggaatctgctcgtgttttccacagtctgatagaaaaaagaatgcatccacatactaatataatatctatgtcattacgataaactacaaatttaaagtcaccagacaaaaaaatagcgtcccatccctccaacttggactgggaccctttccgaattgctgtttggaatttctcaaaggccaaggaaaacaaaacagtgtttccccgtatcaccgcatcactctttattggtttcctcgggaattatatattaacacatgatggtatatagctaaggaaaaaaaatgaacaaactgcattacccgctatttctactgtttgatttttttatttttcacatgttttcttttttagaaacagttttgtttgaggtacgtttctactagatctaattcccgatggttgttccagttttggtttggtttttggtggaggctagggtccgaaaaagtaaatacatctatagtcgttagatcaatattgtgggatttattgagtaactattacaatgttttacttattaatattttaactttttctaatacgcatgaaagcgacatctgagaaaataataaatttattcatagaaataaataataatatactgtaaattaaaataaattaagagaaaatatgttatcatctgtctaccaaaataattatgcatagtatgcatatttaatatgtttctattgttaaataaatttgtgaaacatttattaaataatgtgatttttaataataacttttatgaattaaaattaatgaaaaaattatattaaaaatgtgttaagaattttttacacgaaatgttaaggtttatgctaaaaatatattattaatacgtattttttattttaatatcaaactaaaatgactaaaataatattttcaattataatacataattaaatttaaaaaaattttaacgttaatattagcaagcatcttttcacaaagtttgctaggaataattgatactagtatttttataaaataactttttttaccaacttataaaaatgaattataagacacaactaaacataatttgttttattaacggtaatattagcaaacatcttttcactaaagttaaactcttaggaataattaatagtattttttataaaataattatgcatataaaaatgaatttatatttttatataaaaatatattatttaatttaacatgaggtttcctaaaacaaacatgaggagttagttttattttttttctaaatatgtcaataggggtggaaatgggttagaggaccttcgaccttgcctatataaggtctgatttagcctgacttatttattataaatgacagactaaggtttttttgaaaagcttatttaaataaaaaggtcagactcaagtttaaaaaaaaaaacttattagacctatcaggctagcctatttaatatatatatatatatattaaaacttaaaaacaatatatttatttttctaaaaatattttttcttattaacaatcatatagtgtatgatgaatgacataaagtatataatatatatatactagtgaagatgaatggcgagtgtgagaatgagtaaaataggtttattgattttgacaagcttatgcacataagaattatgtctacttcatagaatgactctaccagtaacactcaaatccctatcaaatcaagtgtaccacaagtcagctccattagtttggacatttaccatggagtagttaaacttgtaggaccacgttttgggcttcagttcgaggcaggtgttgtcggtgagcatcagtattacattaattttttttttaattattttttatttcatcaggctttgtatacaggctttcaggtcaggctagacttttatgcatgttaggctcaagcctgtcaaagcctagcctatttccatcactatctgtcaacataaaatcttttaaaaaattgatttaattaatcaaatcgtaattgaatattttgttggttcactatgtcgacagatatttcacagtatggggggtgttgtggtagttccctagtgggcctcaaggagattacgaaagaaatggcactgtcatgatgataaatcatgaatcaatggtgcatgtggtttacctaggagtgttaccatgtatagatcacttgcaaatctaaattggtctaaatcgattcggatagtttgcgttgagtcatttatgcatttagatcaaaatcgaatcgaactgatcaaaactgttcatgtacgatttgggtcacaggtttagatttatagatctgatcgaaatcaaattaaatcgatcaaaaatgataaaaaaaattagagttgtttggttttgttaaatactgttaatattaggctccaagtgttgaaattgcaaatgtttataatattaatggatcatattttgttcatttgtttcagcaaatatggttataacaaatctgatttcatcaatgttttatagtaagaaattaatttgtaggaaatagttgtgattcagattattatagataatgtcgttaaaagatatttgttttaatttgttttagtctattttagaatattatgttaatggtattaaatgaatcaaatttactaatttcagacatttgataatattatgttagtgtaaatagtcattttcatctctgaatgtgtagaacactgataaattcgtcctcaaaagttagaaattcaaattgtagtcctcgaaagtgaaaaaagtgcgacaaaccagtgttaggcttatttaattatattggatatttggatgaatcatgatataaaatagtaattctaaaacaaaaaatatcaaatttaaatgggtaacccgttggcctgaattgaaccgaactattcatgaatgggttgggttaagttgggtttttacaaaaatttctaaaaatcaaatcaaaccaaatttaaattttattgaattgaatcataaatttgacgaaaatcaatccgaaccgacccacagacatccttaatttcacccttggtgtgtagtttagtgtgtggcttaaacttaataatgcaaggtcatattatccttcttttgaacaagttgtaaattaaaaatgaaagttagtttcgatttatctttagttttgaaatgttattatgtacgagtattttattttattttttacaaaaatgttactatgtaatgttaatataagtagtattatactagtataatacaatatttcgatttcctaagacaaaaaataagttaatcaactcaactataaataattaaatacctttatttaataggtgtagttaaatcgaaaccacacattgaatttgtgtaagccaaaatgtgttgtgtttttatataatatattcttgaaaaagtgtaaaaaaattcaaatataattaaatttcagataaaaattagtattataactaatcaaaatgactgaaatttatataaatatttaataggtgtagttaaattgaaatcacacattgaaattgtgtaagccaaaatgtgttgtgtttttatataatatattattgaaaaagtgtaaaaaatttaaatataattaaatttcagataaaaattagtattataactaatcaaaatgactgaaatttataaaaatatgttaacgtttaacatgaaaataaaatggcctaattactttgtggttgttgaaaaaatataacataatatatttatgttgtccattgaacaattttcttatacatttatttgtaaaaagttgttttttcatctagaaataaattaataactattaaaataacaatataaacttattattcacaaggacgggtgtgttacgataacgtaattaaatcagttttatattctaggacataacatattttcttttaatttattttaatttacagtatattattatttatttctatgaataaatttattgtcctctcagatttttacgcttatgtgattcataaatgacacgttgtgttgcatatgacttttgttagcagatgtcgctttcacgcgtattagaaaaagttaaaatattaataagtaaaataatgtagcactgatcgattaccaattactcaataaatcccataatattgatccgacggctatggatatatttcgtaacttaggcaaaagttactctttcgtactcctagcctccaccggttttgaatggggaaaagattattggtacctatggtttcagaaagtacttaattaaatgtatttgtcaaataaggtgccatgactacacgcagtcgtgttcatgatgggggaccgtttggacagagtggtggaccagcctcatcaccgtacacgtgtacaatgaatgggtttgaagaagaaatagaacacgtactcgtacgcacgatcacaaaagttaagcacagaatatcagagagagaagatggtgccatgtgcgaccctgcaatgcaagcgggtttatcaagtgtgccgatccctatttctccatccgtacaccccacaataaaaatgttgttttgttttcttgttttgccttgagaaaatataataatataaaaaagaaaggggatttgcattttcaggaagcaaacacaggctacgtgtcgtgcatcatcttattggctgttcgtggggttgctttctcttactttatttttttcataatcataatattattttaagaattcttcttcttttaaataaggagtgcattgaccccgatgcgtatgctttgatcctacttgatagaaaatcgaaaaatactgtgtgttgggggattttttatttttattttcagcttttaaccttttaacacaaaagtgaaggatgtttaatttacgaagccgatccaatcatacggcacagctttttagggacgttctctttaatcatattttgcctttttcttttttagcatcaaatttgattaaagtggtagtataggtcgtaaaggaaacacaaacatacctactagtactactggctcccaaaatctcatgcacgactcttagatgccaaattggacaacatttcgattaataataaagtagttcaaatccttctctatcgaagtaatccttaaatttataatattgatttattgattactacagttcatacaattataaaaaaaaactgtcactttaaagttttgaaatatctaatataatattcataggtgatgaccattttggtctttaaagatttatattaaattaatcaatattttaaatatttaacaaatattttttttaataatcgagattgcaactacattgtctcaagtttgaaaatgttaaagtgggatgaactcaatagatcaacccaagtaacccataaaatacgttgggttgaatgattcaatgtatataatttaactcacataacctatcaatctaatgagttaaggaacttattggattgagttagattgatttgctggactcatacttttttggttagatttttttatagactgtttagttaaacatttaatttattggataaaaaaattatatgaagtgttgtaaatttcatgttattttgttactttactttacatttatttaacttaggatgatagtttccaaaaagatttgtgttaagataaacttgtaaagtttttatgattgtaatattatgtttatatttatttatttatgtgataaatcaacttagttattcattttaatgagttaaaaggtaaattaaattaggttgagttgggttagattgacccatttgatatcctatatcaagctaatcagcaccagccaaggcaatctaattcatattgtgttgtatgtgtttacctatttggttgcattgatacattatacttatgtataccacaattgaatgatccaatatttccggacacgtattataatctgtatgtttgtggttgtttgcatgctaagggtttggtgacgtttaattgatagcatgaacatggatcatcggatttccgagctcctttcccaagagaggctaaccaagtactgaccgagagggtcgacatgatgcaagtataaataaaactaaaacatattaatgtaggaatttcggtcaaatgaaaaattaattaaatattaaatattcttttattaaagttcacaagaataaaatagaacataagaaaattattataaaaagggtaagaataatgcataatagaaatttatatttttttattttctatttaagatcaatgtatataataaagtatatttagtttataataattaataagatattaattggaatttttgtttgccttgaaaaataatgattgaaaataaaaattaaaagattaaaaataaaaaatgaataaaaggagtgaattttaaaaaaatgaaataatagtctaataaatataatgagacagttgtaatggaagtttcacattataagtagatagaacaaaattggctaattataagctctgcaaattaaggatacacttgaaaaattatttattccaagaatcttgtttataaaattaaaaaactatctctgtataacttaatgaaaaacctcaaacaagttttttgaattttcgtttttatatttcatattttctcttgattttgaaaaaaaaaattaaatcttgccgctttcctttaaaaactctttaatatattaatattttcgtttttcatatatagttattctaataaaaaaacttgtttgtagtgaaaactggttggataagagggataacacatagtagttgatgctagagctacctacagatgcttatggaacttagtttatcctttgtagtgttgctgataaagatagtgtgggtggggagcaaaaaacgtcaccaaggctttcatctagtagtgttggtgaaggtgacggaatattcttcgcttcataattttcatcagcatctaaattctcttccgctagctttgtttgtgcatgagatgtgaagttcatcaattataaaaggtttggtgaattttaaggtgagggatgaaataaatactttcttattcacgtgacttaaaaacaatagttagatatattattaaattactgacataattgaatcattctcgtatgtattatagccgtttataaaattaacttgatgggttagaattatgagaggtttaagagttaaaaggagagagatgaaatttgaatttaaattcttccatattttaacaaaaactaataattaatattaaccaataaaaaattatttttaataatatatttaacgaatatttatggtccctcataagtgacagacttttttattcttcaccttagaattcacatttgtcaactttatttcaaacttcaaaggtattttaaatttttaaaaataatttaaaaaatagataaaacccagacagatgattattccctttaacaaagtttggtcaagtgttctatctcggttaattggataggatgtataaattattataaatatcatcctcaattcttatataagaaaaaaataaacaattgatattaaaacttaattttaacaattggtataatttgatactctttcgtgtgtgtaatttaaattttataaaaaaaaaactaaaagttttaatgtaaatattattttttgtaaaagtcaaacttttttttttaatattttgtaaacattagccttataaaatcagtattttatttatttattaattttccatgcttatgtgatgtacatatttagtgaattgcacttttaatctcactacaatttttaatgttcgattgtagtcccttttgataactaattttaaaacactttattattaattttaagactttagataataaaatgaaatgcaaacacccctattattagttctgaaatttcatttgaaaatcttttgatagtaaagtttaaaaagtgaatgttgaccatatcaataatcgtagcaagagagagaaaaaaaacttcagaatttcgcttacacaaaatatatatatatatatatatatatatatatatatatatatgattttttagctacctgttaattttaatttaatattaattttacactacaaattaaattattttattataaatccaaaatataattgataaattgctaaaaacacaattaaacctatcaataataagttattatacttttgggatagttggttattatattgttatagcaggtgatccaagtcgtagaatcactagaagcatggtaaaaaaacttgtttaatgtcttctaaaaagtgttagcagtagcaaagtggttctaagcaaattaaatattaatatattaaagaaagcattaagaaggaaataatttattactaataaagctttcatgagtaaacctgaatatagaaaaaaatttaagaagaaaatcctttaacatcattagccaattttcatatatgtaatacacgcacacaatattatttacttttacttattatttttatatagaaaaatattacaattgtcatcgcgactgaaccaatgaaccattatggaaaaaaagtttttttacaaatatttaacatagttccatatcaaacaatcaataatatttattttattagatatattttttgtttttaaattttcatcatataacatttgaaaattttaaactctttttatttaattcaattgttacgattaccagcataaaaacacgcaaaattttactttcatctacacctataatttacctgtgcgtccaataatgaccctgttacgacacaacaaatatatttagatatatagtttacctaatgattcatgccaataaatacttgaagtcaaatgaaatggttcaatatatatatatatatttacatttaatgaaaaattgaaatttttaaacttttttttattagattcaattgttattataatcatcataataacattaattaatttatttattgaaaattaattgtgtaattctttattattaacggagcgtagcggagcgcgacccgtgcatccgcacgggtcctagttagataataaaatgaaatgcaaacacccctattattagttctgaaatttcatttgaaaatcttttgatagtaaagtttaaaaagtgaatgttgaccatatcaataatcgtagcaagagagagaaaaaaaacttcagaatttcgcttacacaatatatatatatatatatatatatatatatatatgattttttagctacctgttaattttaatttaatattaattttacactacaaattaaattattttattataaatccaaaatataattgataaattgctaaaaacacaattatacctttttttgtacaaaaatatagagagccacaaagtgtctcttttactaatttattataattattataaatatcaaacttgtgtattatacatgctaaaataataattaagcacaaatcattgtttttttctacataataattatttacctagaaggacaaagtcaagtgttaaagtgaaaacttatcattctttttattttatcattgagacttttctaaaggtaaaagttatactttaaaggattaaaaaatactagtaacatgttatttaacatatactttttaaattcacagttaaaatttattaaaaactataaaagtgtgtgggtctcactctttatttatctattttcacttatgattttgtagctttcaaaataataaaaaattaaaaaataagcgtaattaaaaagtgtgttattactaccccttaaatatagtatatttttaaagatcaacaactaaaaattgtgataaaatataaattaatgtacaataaactttaaactattataaatttaaccaccttaatgttataattatacttaatcttttccctctttttctatacaaatgaaataaaaataaatgctaatggaagtattagatttttacttttttttttcaagttaaaaaaattgaaggagtgaagttatttttttatttaccattcttcaacaggattgaaatacgaaaaattatctttttcttttttcatttttatttttgaataaaatcaaataaattttatttattaaattattattttggtctctctctcgttcttgatctgcatctttgttatctttatttgttatgctatttttttccaaaatttttgtcccgcattttagaaaatatgctatttttgtccaattgttaattttgcatatgttttttttagtccaatcaaatcctaacaaatttatttaatatattataaagaaataatttaattgattaaaatgtacaaaataaaagaaaaaatgaatgcaaaattgatgattagatcgaaattgtaaaatttgtaaaatataggaacttaaatcatgaaaaatataggaggataaaaatcacaaatcaaaattataatttagcccatatttttttaaactagcaattttatgttggaaagtacttgggtaaaatatcatgttttaattagtacaaaaatattttcatccttatttttttcactattttttccactcataaacaaacaataaacaaaattgttcactccattattggtttaattatttttttgtccttatagttgtggtaactttcactttccttccagtctttatagtttagagcatcctattttggttccaaaagttgcatttctttactcatttgattatcgttatcaagtatcgattaaagtcattttaaacgaatataacatgacccatttaattcacattcatcgcaaataaaattaaacaactttagattacaaggatcaaaatagtaaaaaacatgatgactattgagttcaatatgagatgtttttaactataaaactaaaaaaaatgttataaatatagataccaaaaaagtaatatttaaatattcattctttctttatctgaattttttctattttttgaacatttacaacggattttttactattgagggacaatttttttgagaaattacccattgggggtactttttgaaaaattatccaatcagggataagtcatgattgccatacacaactctctggttaaagtcgaacatgttcttgcgaattctgaaatgttttttttttttttttttttttcatgtagaagtagtaaatataggtacaactcttatttattttttgaagtcatttaaaagattgtgactttagttatttttaagtcgttaatataggtacaactcatttattttttgaaatcgtttaaaagactatggctttttgaagaattatccgattaggaataaatcatgattgtcatgcacgactttctcattaaaattgaacacattcttatgacttctaaaatgcttttattttttatatttttccatgttgaagtcatatatataagtacaactcttatttatgttttgaagttgtttaaaaggttattttcttagttatttttatttttatgtcataaatagaggtaagacttttaaagtaattattattcatttatttttatcgaagagttgtttgtttcatttcgtttttttaatattttgttttaaagttttctttataatactatttttaatttattaaaaaagtgatgaattattttttaatttctaatataatcatttattatttgtatttttttagttctttatttttttattgttttcaaatattttagttaccatgattatgaccttctgttttacacaaataataattaataatatttgaaataaaaaataattcactacttttaatataaattaaaaatagtattataaagaaaattttaaaacaaaatatttttcttaaatgaaatgaaacaaacaactataaagtagaaataaatgaataatgaacacacttcagaagtcatacctatatttatgggaaaaaaaactaaagttataatcttttgaacgactttatgaaaataaaggagagtggtacctatatttattacttctacacaaaaaaaggaaaacaaaaacatttcagaagtagtaagaatgtgcttgactttaatcacaaagtcgtgagagactctcacaacttactattaatcggataattttttaaaaagtaactcaaattagtaatttcttaaaaaaattgccccccaaataacaaaacagcctacatcaacctttctcgtagaagaacataatgacacaatgtgatgtttttacgatatacaggagtagaaaaaatagattagatgtgtaatttcacaaaatcttaagaatatttacgtataatttactatatatttaaaatgatttcaacaacacatttttacttttctatttttcctgtttctcagtcctataattcatttatgcccttaaagtatttagtgtacataaaacttaaagtcaagttaaataaagtcaaatcacaaatacaattctttaaatacttttaatatgccaataaaaaaaaaatctctctatagtttacaaaataagtttttgcaataaatattaatataagttatcaaaataaaattcaagttgtgattaaaaaataatatataaacagttaaccgcatgtaaataatatttaaaatgccataaatatttaattccaatatgaaaaacttagatttttgataaaagaaattaatctagatataaaaatacaaaagccgataaaactggtgagagatagaaagaaaggtggaagcagaggtgaattgtggattttttacagcattactcactagatagaacttaattacgacctaatcattattattattcataaattaccccccttttcccgcacggccgagagattgatgatgatgattactacccccgtttatttatcgtcatcaacctctcatatccgaccccacgccatgcgtgcttcagcccccctctcctttctctcaagctcttcaatttccctctcttcttcaatccttgaccatttcatttttacaaagtttctctctccatccaattactatacaccctgcaaaatgctctcaattaattaagcttcttcttcttcctcttaactccattcctctgaacagtaccactgcagagttggtgcttggtcatccgagaagaaattgcaggcctcgtcggcgctgagaaaattgtgctcctccatcttcacgtactgcgtcgacgtctggtactgtttctggaactggaaacagttgttcatcgacgaagaagaaggcgacgacaaaagccagtgactttgcagaaccccacacgacgaaatcgccgcgttgctgttggggctgtggttgttgttctcctcgttcaagatcgcgcttgagtcgctatcagaagacccatctttgaaatccacagggaatacagaaccccctcccacctcatcactcttgttgaaacactcgtaactcaactccttcgagtccgatccaggaatggcggcttcaccgagcgggttactatcctgcagagtggttatcatctcttccttcaccgaaacatcgctttcagtgttgttgtcgttctcttcttgcaccagcctcgatttcaattcctttatctgccaacaaaacaatcaaacaaactttcaatacttgttgaagatcccatatcgaccagtgatgagatcaaaatagtatatatatatatatataaatatatatatatatatacacatcttaagctaccagtgtaaaaattacctctttgagtaaggcttcgttgtcttgttggagggtgtcaaagttaagtttaagtgatccgtaattggctttgaggacaccgtaatctctttccaattgctttgttttccatctggcgcggcggttctggaaccaaaccgcaacttgtcttggttgcaagccgagttcttgcgcgagcttcacctttcggtcaggttcgagtttgttctctacttcgaagttcttctccaaggccttcacctgatccacgcttagtcgtcgtttcttctcagagtggtgccctggttcttccacgcatccttcttcgtcgagtccttccagcatggactggaactccttcccatacacgtggttgttcctcggactgtgttcgtctgttcaaatcaagacataatcatggttagtgtaactgtaactgttgttgtctcttgaaacaaaccaacacagagcataattcaacatgatgatgagttgtgatgcaatacacacacaaaaaaaaaacagaataaggaattttagtataaaaataggaaaggtttgagtaattgggatggttgatcgtgaaaaaagttgagacaagacaaggcacaaacatgaaacacgcatcatggaaacagagttaaaagccgaagtttcaattttttcaattaacctgttggtggacaaatcgtcatgagagcaccccgagtatccgaactgccaagtctcttcatgagtagtacaaacaaaagcacggatcttattagatcaaggaacttaaatttgatccctttatttttcttttagtcaatgtatattaagatctcaagaagaaaagctgagagagaagacgtttttgttttgatgtttctttttttcacttaaaaggaggcatggaacaggaattctggtgtcttaaacggcgccaatttgcacagcaactactaaacgaccactcatttccataaactcccatgtgttgttgttccttatctcttgacacctcttctccctcttcacccatcaacaaattccaacacacagaacaaaacaaagccacacaagaagtgaccaatctctttcttcctgcacactggtctctttttattctctatctacatcatcacacacagaagaagggtcgtaagggaaaagagaaagggagtgttttggaaggagcgtgagaagtaaggagaaggggaagggtgaacaagttcacaggccaggggttgatgagagtttgtgtctttaaataaaccaaggcgggttagaatctgaccggggttaggtgactgctactgcggttggttatgaaatgaacccaaatttaacccagatgcaactttttggggtaccgggttagccggttaggcttcagttttttcgaccgtttcctcgaggagcgcacagtgtggacagatgaaaatggaaacggcgtggctttcggcagcttgcgtccactatttaagccggcttaaggtttgcgttacgtcagcgtagtaataatactattatactactatcacgcgctgctctagccagtgaatcacacaagtctcctttccttacgttagcatgtattttcattcattcatttaatattttgttagattaaatatatttttagattttataaatataacaaattttgactttagacttaaaaaacaattgttatttcattttttaaaatcatcaccatcgctatgtaataattatgtaacatatatttatatattttacattttttacatttaggaatccaattcaaatatcataaatttataataatttgtggatattgataaatgaattgagttagacatatttgaaaaaaaaattctaaaataagtgttatatttggtttttaatggaattttaattgtttttttctactaatacttctaataagtgtcatttagttatttaatataatattaatactaaggttaattttatagaattattattatcttttatatacttattagtttttttatttataaaaaaaacttcttctctcttagatgtgcgacatagattaatcaaacaaacgagaatgcatttatcttcttctctcttagatctcaagcttagtaaaccactccataattcactattccacatagtaaaacagttaaataacataatttactttgctaatttttttcatgaaaagtaattaaaaggtgaataagttagcacatcgcaattgacaggcgccaatgaaaaccttcaacaaccatgcaaccctttttgtcacgaagcttaagtttaccagttgaaccgaccctcgctattttccttcatttctctaaaggtccatgttcatatgatctaaataaataaacaactcacaaatcataaggtatttgacgttttccccgtacatggcacatttattccctttgaaaaaagagtactccattggtatttatataaatttaattcaatttataaaaacgatcgttatattttaatttggagtctatttatatacattggcaattccttacaaaaatgatcataacttggcaccagacagcaccttcttcaattcaagaatctagagagtatcatgaagaacatatggcaatgggaaatcctcctgaataagaattttttacatggcaaatggaaagctagctaggcatatatggtgataaatgttgcgaaagcaaagtgcaagagatccccacactttcccctaaacatatggcagatgtggtaaattgtgtggtgtgtccagcattgtactaatgtgctcctttctacgcaatttcaggccctttcaaagcagttaccgaccagtgacaggcaagcatgaatagaatgggagaaagcgagttttggcacaaaagtatgcccatcactccttgggccctactcccatagtaaaaaacaaaaatcaaaaagaaaatatgcatactttatgtccaaaatgggacccagttttgtaaaatggtagcaacacgtgtgtggtgggccatggcatagataaccccacgggaacggaaactgttgtgacttgtgaggacttcatcgggttgaaagcgtgagaaccagctttgcgatttacaataagttttttggggttatcaagatcgcatttgacactcttttatttgttttttcattcatagaaattataaatagtgttaaaaatttataataatttataaatttcatttaattaattgagttagattttattgatattcatttgtattaaaactggagagtgaacaattcagttcaattttacctgccttaattttgacttcatttttttaccttcaatttacattgtgggtgagtttagatccttaaattttttaatattttgctttgatgtaggtatataacaagttaacaacttctagttgaaatgtgatccacaactcatttgtatgttaatgttcttgttcctaaaatttgatataaatttaatgaattttgaatgatttagtagaatgtcaaattaagatcagaagagcgagaaaatattatatatattttttatttagggcacctttggaattttgattaataccttttagtgaaagaaagtttaaaacaatttaataataacaatttgagaagtttttgactaaaaatgaaaatttaaaaatttaaataaaaaaataatggagagataatgtaaaaaatatttacaccgtcaatatattttaattaagtttttaaaaaatattcacagtttgagcttcttttatgaaatgttaaaataaatattgagcaggcaggccgatagtgacccaacccagcatggcagtgaattaaataacgaggtagaaacataacaaacaaaataaccgttttacaagctgatccggcccatacaatgttttcaagtttccagcattttatctcacattaaattcggggtaatattcaacaaaaatgttcgagagataattactgcaaatacttcggcctcatagacatacagacttcgaagttgaaccatgggttcatcatgtgcgagattatgaatcgttaggaatttatataaatgtaagtatttgtttgggtgagatagcaaaaaattaattttaaatgaccttaattttacaattaaactgtaaatgctaaatctaaatattaaatttgaaataaaatactttatttaaaaaataagtttataattgtttcaaacacaacctagtcttggtcaaattcagttcaataaacccaaaacacctgaaaagtctaaaactagaattcaggcaagttaagggtgaagaactgataacagataacagatattcctcattttttttcttatcacatcattagaaagacatgcaaagatgacctaatagcaagcaatatatgacctcaaccttaattgtctcttaactctacctctacccctcacggatttaagcgtccaaatcttcataaatagtattcttaagtttcaacatctaccttagagatccaattttgagacacacaaacattggctcaggcttttgtgggaggcacattatcatctatcttggatttaagctcttttaatattaattattttgaaaaatgctgacaacatttttttaacacatttaactaaaatttattataaattaaaattatgatggatctcacttctaaatcactaagaaagtgtaagaaaattaatgttactagcatttctcgattatttatcagggcaaagggctaactcagtaactcataagctactcctagttaaaccatccaaattacaattgttttttttttttttttccctaactaaatcatgttacacatgctcaaacgcgggtttgggtgtagcaatcctaatgcagaaccaaacatagccacaagaatagattgcagggagctcaaaaccttggatggggggaacagacatgtccaatttgtagacaactataggagaactttgcttccgaagcaatatgtttcgtgaacctaagatttaggcaaacacaatataagaacagagaaacagagcatttccgacaaggggcatcatttttgtgaatacaatgacatgtctatatgtcatgaatccatgtgcccagatagaacgtgaaccctatcctaagattgcgtaagaataagcctgcatggtcactgggacataattattcgtgtcgctgacttgttcaaaagcatctgggtaaggcactgtttgttttcaaacactaataatttttaatggatatctgacgaatcccacttctccagctgggtttaacttcccgatttggttgttaagcactctcctaatacaagctggaaaaaaaataaaaaaataaaaccacgattctatcatttttttatatgaaaatgttcttattatatactctgctcttgtcaacaaaacccataacgtagaggttataggtatggaactccgaactctcactttcagcaaacgaataattgtgtcgggtgacaatttagtccatttttttactaactattctattcatccatatataaatttaaccaatccgtccaattataaaaaaaataaaatagattagcaagactagatcactatatttaattggatgaatacgcataaaaataaaataaaattggatgaatgatgaatcatttaacatatttttataatacattaggttaagtaattcaaagttcattggtcgagcataggactttaagggacaaatcctagactttacaacatttagatacatgaatgtgtttaactaattttttataaataaaagacaatatactttaaacgggatggatttttatttaattgtttattcaatgagtcatgcatagattaaatttttaatacatttttcacatattagtctataaataggagttaacacatatagaactcacactatccatgacttgggttcaatgtttaaacatttttttattaaatgagtcatgcatagactacatttttaatacattttccacataatagtgtgtatgggttaacacatctagaactcacactatcaaagacttgggttcaattttcaaacttttaatgttgatagacaatatgtaaatttcattatataaaatctggttaaagttgacggtcttttctaacttcgcaagagggtgcgttttctcttaatctatttttttttcttcacaagaaaaaaatattttttacagattatgaatatattttttcttttatctagactacaacttttcttcaagagaaacaatgactctcgaactttgtaaaattattataggtaagaaacttcctcctattatatattagtataattcaatttaaaatctatccaatgcattcgtttgacgcttgatatatatatatatatatatatatatatatataaagtaatactaacaatattttccataaactagaagaagcagccaaacgtttatcacgtttcctagccaaatttcatcaaaattaaaattctgctatcaaacaatatcagacatttgatcataagtggaaaaaagtggtgtgcccaattaggtagataaaacgccatcgtgggtagaactgcaaaaagcggaacacttgcaagtagagagttctttctacaaagtcagaatctgtgatttaagatttgtttaggaagcaaaagctagttctagtctagggtgcatgattttcatttttcaacactgcatgggctgtattcacaccttgcaaaattcaaacataattgatgtccaaaatctagactcctagcaaaatctttggccgccatattagtctcaacttcttctataagacagtaaacttaggacccacacaacctttgctaatgcgtaaaaacgttgccccccgtcccttgtctgatcgtacaaacaagaacacataagacagtgtaagtttaagctgtggagagacaaaatttgaggttgcatggaggaagagggaaactttgaatttgcaacttgcaagggcatgatgatcaatgaatatgaaattttttttgggggggggggggggaaacaaagctaacaccaccttagttaactagtgaattacaccgatccaacaaatgatcaatcagccaatcacatggttttcattaaagtgattttgattagttccaatgctttagaaagtaagaaagagagaggcctttttggtttggtaagggcctaccagttactgtgcatggaatacaacaaagatacacaacgaagagaaaaacaaaggagaaattaatagatgaatccccccaccaccaaagaaaaagaaggcttgattttgattaggtgagaggctttgtcggacagcgcataacacctagtggtaagcaactttgttctcttttctaacttgtgagtgctatccaaatcaaagaaagaataagcaaaagttacgggaaagaaaacagaatcttgacgaggagggcttcctttttcataagagtgatattattattgtttttttctctctctttcttccaagacaattgaaaacaactattcataaacataagcattaatgttaagttaaagtatcgtctcaaattcactattgtgatttgttcgatttttcattgatgaaaatctggcccgtatttaccctttcgtttcccaacatttggttaataaacctttcaatttgggtcgatatgctttactatgacaaccaaatgatcacctcaaaacatttaacagctttcggataccagaaatattgtcctttgtagcttttggattgagttgagagattcttacaaagttttactctatacttccttttggaatagcttttttctaacataaatcaattcatttcaattttaattttaagcaaaatcaattttgtaaaatcaagatttataaaactaattcttgatcacatcagtagcagtcaactcattaagccttgactctgtcatcataagacaaaaaaatcattgcagaacaaaaacatacaaatggaactagtatgatgggagaaaaagtatcagttaaaaataacatcaccacataacattattaacggaatgaaaaagtcaataacttaaaataaaatgcagaagccatagcaacaacattaaaacaatattgagattcaagtgttcaagaatcagagcagttatccctttactaatacattgaactaaaaggaagaaagtttgtattgcactaattaagggttttaaagaataacatgatggatctcctaccaaccatttgtcattcgtttctgcaaagcaaaacaatgaacataaataaacgaaatgaatctgatacctatagccactatgatccatttatgaaatgcaaaatgtataattaatgaaatccgtacacaataaggcagagtaccaagacatccatttttttcccatcaaccatagtcctttccttatttggatgttatatttacatttcaagctcattccaccaatgatcattcctttgtcttggtgtttatatagactagtgaaaatgatccttaatcccattatctgttttatcctcttaacaaaattactgattatgtgaggaaaatttgtttaaatttatttgttaaaataaatatttattttaataaaaaaagcaaccttttatatttttaatatgtctatataaattacttttacttaaaatagttttatacttattttaagaagcgacttactaaaaaaatattttttaaaaaattctttttctaaatttaaacaaactaatacatccatttgaaattttgaacaagttgggtaacagtcttgtaggggaacacaaacaagacattccatatttgattatattgctaatttaggaagatgatgagcctaggtggaacaataaggtttcagccttgtgatctcatgattacgagttcttctctactcttggagataaggccgcatgcatttgatcctccacacttgaaatgtcgttttttatattgctgattcaggagacattcacattataaaacatgtaaggaaataaaaccacatactttaatccttatttcaggtctacgatgctagacaggatgctttgtttcataaaaatggcacacgccacatatgcaccaaggtcaataagccaaaaagacagaaaaatacttttggagaatatttcaggtagcatctgttgtataaccaattagtgcgtgtttggatttctggtgtaaacctaagtttgagccaacctccatttccaagaagcatccatgaccctttattttgcaaaacgaaatttgtgggccattatatttactttggaattcatgcaccacatcttgaacagacattcaaacatacctttattcttcttcctctattcaactgcttttctcattgtctaaagtatttgatttcaagaaaatgaacttaaacaaacaagagtaacagcaaagctgaaatggacttgatttcaagattaaaaaaaaaggtagtgtattttctgataatacatttctactttgtatccaagtcatatgaaatgttcagtgacagtgattgtgacattttacaataacaccaagacaaggttcataatttacatgtctagatattcatcacaacttttgatagttctcagttgtcatacctgaacactacagttgaattactttaatacaattgcccaaatgccgaaataaggcatgatcttttacaacgattatctatgtaagtttgagcttatgcagttcctaatccgaatcagcatctcattgggcatgagctcaccgagggggaaaataatcaaatattaaattatcagtgccagaaatttcaacttataaaatttacctaaagttgagaaaaaaaacaaaattatcctcatatatgaaaatgaagtaatatgcatctcaaaatggacaattatgcatgtctataaaagagaacgataagaatgttacacaaagtttgaattctgttgcagttaacatgttagtaccacggagttataacttggtgatagaaggagaaaaaagggaggaaaagatagtgagtttgattctttcactaacaaaaaaaaattaacaattaacaactaacatttgtcaataaaaaaatgttagtactactactgccaagacctgaaacataaacataagttgagcgtcatatgaaagttgtttgaaatcaacagaaagttacaaacattactctggtgcaggtaaattaacgcaatcctgaagaccggtgaggcatggcatgctgtaatttgcattttctaatgtccaagttatgcatttcctgtaaatctctaactctaaagcattggcttggacaaatgtaaatgattctaggaataaactatgtatgattctaagagagtgctaaattggaaatatttaaccatagtctcacggcattcgggaatttaaatgtcctaaagtcgtaccaagaaaaattcaatatatatttacaattggcaatggtatggaatttaactagggtggtcattccataaccactgacattgcccttctcagaggcggaaatggcatttatactaacctcggttgcctttctaggtagttaggggtaggactcaggatatgacaatgagatcaccacatcaattgaaaaactttttttttgcctccccattaagctctagtgaaaatctcaacatccaagttataatattggaaatatcaagtgtgtatatttttgttgaatacctttttttttttataaaaaaaactgataatttttttattaaatataaaaaaggatcagtgaaagaatattataagaaaatatgttattgaagactaatataaacacctgaatttgtctttgatgaatctgataatatgaaaattacatattaatgggtacttgtatatttgattgaaataattaatgcttgattttctttgaataagatgtcaaacatgagtattgtgaaccactaaatgtgtggatgaacttaagttgtttcagtttaaacaggatgacctctagatacctgtggttgaacaaaaaacaaacagtgactattgtgaacgaaaaagaatatagtagacccgctaattcctatcatgacaatgattttctttgtaaaccaaagcaaatttttacattttcacattcctgcttaccaaaggtcacgtagaaaattcttcttcaggaaagaacgtaaaaagtataaacaaacaaggcaattggatttgtaagtgtaactggttatgaagagacaagtggtacctcagcagagctaccaatatatatacataaaccaatcgcggaaccatatcttgcagatgaacgaatctctggtgttcgctcttcttatcttacgtacctttgtccgtatctatcagacactgaatggctttcgtcaattttcattgctcttccatgtccctgcacacattttccaagtgagctttcagcctttcattaattaccattgtttttatgtatattctcttttttaatttctttccatgccatgtccaggcatacattccacttatgccacatgtaaagacgtaccctacatcactttatatatatagtgttgttcatatattcatatatagaaaacattaattgggatttatatgaaaatgaatcaaatggattacaagtcctacattaatctataacattgaatatgtacactataattagagagtaagagtgagtctggcgcaagttcaaagtagtacctgcagatttcgaaatccatctggttaatattgaattttgggattgtgtgtgcctggaatttttatacagtttttattgtaataatgtaaataaaacggagattccttgcattttattgaaacatgggtaatgtcaatatttgcatgcatgtaaaataaaacgttggcttgtcattttttctctccatatgttgaatccaagtgtccttaggcagaaagaaggaaggaaggtaggtagataagatggtgattttcccagtacagcagagtgcgagaatgcattccagtgcacaagttcccaagttagaggtaggaggtttctatgtgaggtgaaggataaattatattatttgggaaaacgcaagtcccacattgactagagataatgctaaaataaagtatataagtgggaacgatcctcatcctttgaatttgctctgggagttgagttaggtccaaactcttataagatgatattaaagtctatcctagatcataacggaccacccaccatattattcacgtatcaagcccaaacgtgatagagtatatatcctaggtccaaacttttgatcattttattaattggtaataggagattaatttactttaggtttgtgggaaacaactctagttcagccaagtatcctataatggatatattgagcttattactaggtgaaaatttattcactctaatgtcctttaagaattgttgtcactttattctgcttcttctactacttgtgtaattggatggttgcttcttctgtttagaaggcagtgtattgtcagtggcacacctccactcaataccagcggatacaaatctgatttcatgttggctagtcccattagaaaagtgaaattcagtttcaaggttgataaagtgagggttgtaatatctggagaaggagatctgctatctcatcctaacaactataccagtccaagacaaatagacaaactggcagaagaaccaattaaaattagacagcaacttggttacccctcggaagatgacaagtatgtggaattgcagttacctgttgattctagggagtacggtattggagcacaggtactatttggtttgaaattaactatacacatgcattgaaaagtttcctccactattactgttcgctcagaaatttaatcaacttctgagaaaatgagttattctactgtttaaataagtaattaaaagaatacaaagtggtaatctatatcagtaaagtcaaatttgagatcagcaaatgataaatttactagtaataatggaagtgtgtaatacaaaatattagattccatcttaaaaccaactgaaatgtactacatgttccgattctatcttgaaatcaattcatattaagtttataagttagtccacaggtgtagaaagtgcatcctagttggggtaggcaatatgacacttcacgatagaacaaagattaaaggtgaaagatggcaaatggatgtaacttttaaaagtaccatatatatcatgagtatcgaaagttaattggtggcatgtgttgaaaatgataaattgaataaaaatgtattaaaagcagtaacttatgcttggaagttgagagtaaaagctaaagaatgcaagttaatcaaagcatggaatttgatgactatctgatgaaaatatgaagaaaattgacaatgaaatctacagaaaatgatcctttattaaaaatattagaatggaagatatacttaaccaatgtcagaagctgagatgcataagtatttagattaagatcatggtgtttcccgggtgatttctgataaacttctgataactaacattttgaatttcaaactcttgatatttgaattccaaatcttgcactttctcaaaacttccacaaccttaaattcttggatgattattgattattcttgtcatctttaatacatagttatcttgagtcgtcatttcctaattaatcaagaaatctttatcttttggatactataacaatagtatttataaaattttgacatatcttgtcttagtatctgacttcaattttcttaccatttcatccagaacaagaaatcaaaataaatataatttagtgtctctttatccctgttaaccgtcatatatgtacggaacaatttattttcgctcatgcatgtttcatcgtaaattattgtttcattttggcagcataagcattatttttcaactaattgaatgataaatctctgacagatactacgagatcttggagttcaaacaataaggttaatgacaaaatatcctgctgagtacgacgggctcaaagcttatggcttagcaattgcaggaaaagttcctcttttgacaccactaactgggcaccgccaagacagatcatgagatacttgaaaattaaacatttaaatttgacaggtattcgatttcaacaatcatatatgatttataaatacagcattattacgaaaaaaaaatgaaataatggtcaattttgggtaaacttttacttgtgtaacatatcatattcttgatctatcaacagtcataaagcgatgctcttatttgattactgttatgacgtgcagatttgtttttaagttgactatatgtttttggtttcgtcctgcattatttgatcctgatagaagaaaacggggattaagcgggaagggctgcggggttttgaaggagagatttaaggtagtattttttttatgggtaggaatttaaaacaaagtgaaagaatttattgtaaattatatatggagttacattctttgatgaatttaaagtagtatttaaagatctaactgataaatttggtagttgaaaattgataagctaacttatttaattaaatgtatttggttgatttattccttaagtaagatataatcttataagatgaattttttttatagtattcttcttatacaactttctttttcgtttcactcttttatattaatttgtagttcttttaaggtataaataataaaattatttgataatttaagaaatttttttatctctcatttttttaataatttttatgaattaattttttattcgctattaacataaaaagtttcacactattaatcaattaaaaactagggatgagtaaaacctaaccaccgaggttgatttggatggattaaagttttgaaaataaacactgtgtgttttattagaatcaatttaggttgtggttcgggtcgtcctagtttggtttaccattaatgtctcttaaaaatgtataattctttttaataattatgtgttgataatgttttgtataatataatattaaatttataataattttttattgtaaactatatattataaaatttaccttaatttacctttatacttttttttatgttttaactatatatataatgttaaaatcgatatattatattaaaaaattagattgacctagtttcgttccatatatctcaggttttactcactggattcatatataaataaatgatttgagtcaaaatttcaggttagataggaataaaaataaacctattataccccgacccttattcagccttgtgaaaaacgatgtcgggatgagttgtaaggtgataattacgaaaataaaaaaatttattttatattttaatagttttgcattaaaagagtaaatatttatatatgtattttaataactaagaatgttatctttatatgtataaaagaaaataggtgaaggtagttttggaatataaaaggaagtaagcgggggtaattttggaaaaataatttgcaacgatgttaaaaaaacaataagctttaattgatcgaaacacaaaatatggttattaaaaccatgcttaattctatttagtgaacgatatgaatttgcaaggttaaccttttagtaactatcattataatggtaatgactactaataatattttttatggtagaatatcaatagaatgtctataaataataattgttggtccttaagcttcacacttaaaaaaaaaaaaactaatacatcatctatggtgagaatgagagtttcgaagaattaagaattacaactcttcttgcttgcaatggttggagataatttcaattcaatttaaatttaaataatattaactatttttctatactaacgtgtttaaattttagtttcaatataatgttataggccatgtgattgagaaggacaagataaatacaagttcgaaaaaaattattgatatcacccttaaagattttgagtattttttaaataaattcttctttttccatagtttttaatatttaaaatgacatatattaaattattaactaattaaattacatttttctatcaaatagaggtaataggatcatatgtgcaatgtgggataaatttgctattgacattgattcccatcttttaaacaacctttcaaacaatccaattgtgattatactacaatggtgtatagtgaaaagttttcaaagtgagtagataaatcttttttaataatatctattttgtgacataaaataagacatcgaatacaactaattaattttttttaaaaaaattatcaagtatgatgggtatttcaaattctttctttaacacaagattgactatagatgctaatgtaaagaaattgttgagtatagttgtataaaaaaggtatataaatatagtcgaatttgtatttatttttatgttaaattaaaaaggttttattcacatgtgatttatgctgttatagactaaaaaatggagatatatttacgtcacaagtaattacttaaatgtcgggttaatctactatttatatcatgtctttagctaatgaactttaatgagataacgaataacgtacaaaataataattcaaattttgaatttttataagaataagttttttacattacttttatatattatgcatgggaatggtctttttctatatattggttttgtttttcttatttatttttattgcatagaaaaacgttaattaatgacaaaaattatgttattgtgtaaaaaagatattcttatatgagaatgatttatttatttataataacaaattatgtaatttacttatagttatacaactctactatttaatataaaatcaccttaaaattacacaaataacttgtttagtcaaaaactattttttaaaaaaataaaataaagcgagaaccaaaaatgtcctattttttttatttatgaaaaaacaaaaaagagaaagtttggttgatgaaaaggattgtagattacaagaatctggtaacgccccaccaccattaaagctaacgcggaaaccatcacaaagtccatggacttggaaaaaaaagaaagcactaagtaaattcgcgagtgagtctgagtctccaatagaaaatgaaatggtcccatcccatcaaaataagcccgaatttctcatgttaccatttaatcattccacactctatgcaacaatattttccacatccatagaatattagaatacttgacccctgcttctacctctgttccgttaatggctcctcttcctaagaatggaacccaacaacaccatgatcgtaccccacatcctaaattcacgataccttcccttaaagaacatcacagaaatgtttttcaactctcgatgattgtcatggcatgcatggttggcgtcatcatatttctctgcaccgtgtccgtactcataaggtacttctactcaagaagatatagccgcaataaccaaaacagaagagtcgacggccccatattgctcgatttgaacggagattctcctccgagttcggataacgatgatgacgtggaggagttggcggttgtccacccgatatggtacatccgtacggtgggtctccaacagtccctcatagactctatcacggtattcaaatacaagaaaggcgaaggcatcatagacggcaccgagtgttcggtttgcctcggagagttcgaacacgacgagagtctgaggttgttgcccaagtgcagccacgccttccacatcccttgcattgacacgtggctccggtctcacaaaaattgccccttgtgtcgtgcacctgtgctacgcgacgaaactggcggcgcgcatgtgatcagagccgttgatcagaataatcacacggtttcaaacgtttctgatcatcaagaggcccgcgtgcagagttctgatcatgagagggttgaagatgatgtgtcttcggcagtggaagtggaagaggaaacacatcctctgagaagatcggtttccatggattcttcttctgcttattcaatggtgttatttcgtgatgtggtggtggatttagatacccatcattgtggtgaaaaagtgaattattcaagtaacaaggatatgagtgttgttgctgatgagaagcatggtagtgggagttcaacttcaacaactactattaataacaagttggcttcaattggacgtgcgttgccaaagaggccggtctccgtctcaatgaaaatgagaagatctttttcacataacaccaagtttttgttctccagacactctaggagtcagagttcaactcttccattgtaaagcactaatttaggaggatgaaaggtccactttaaagatcaagggctgttgatggaggatgaacgtttgtttatccaaagcaaagcagtgatgcctctactccacatatgtctctgtctgtcttcccttacagcaattatctatatgctttacgtatatagtgatacaaatcatacaattatatgaaaagtttgggaaatttgaccactgttttgtatgtttcaacatgagtttgcggatatgaatatggatgctctctcttttattctataacccctccctctttttttgcctaatcatgcatcaaacttggttggctatgtttggttaacttgtatgaaacatgatgccatccaatggatttataatactcagattgtgcattgaacttgttttcataaaacattatacttgtcaaaaaaaaaaaacttgtattaaacatcatttactatttttcaattacacccatcatgtaagtagatttattgacttttataataacaatcttataaattatactaaaattgatgactaatttttttttttttacaatacatccatattaaacgctaaatccatttcctctatctatattttatgtgtctctttcttagaattactagctagtggatcccaaatatttgtcctttcatgaaactccatacatttttaaggtttattaacaagtatttcaaccatataaaacttaaaatttcatccttagacttacgtgggtcactgtattaatcttttaatttgtttttactaagcgaaataaaaatactatcattttagtcttcttaaaaaattatcaccaaattagttttgtaaagatttaatttatcattaaattagttcctcaaagttttaaaatataatcatgttagtctttgagagaagagatgttaaatttcaccaaagggatcctgtgaataatgactaaagtggtgaataaaatctttgatgagcgactaaataaatcttcaaaggatatattcatacgataacaatcttttcaaggattaaagcagtgacaaaatttttgagggatttatattctacacttcaacgtaaaaaaaacctttatttttgtatagtgactcaatatatgtaataaaataaaggttcgggatttatgaaacaatgattctatatttaaatgtagcatgctataaaaacaaaggttcgggatttaattatagcatatttttataaaatgagaggtttatgtaaaaactacaaaataaaaggaaggcttgaacaatttactctaaagattataactttacttctcacaaaaaaattaaagcgcaactaaatggcttctactcttttttttttttttaattagttttcttgtcgtgctactcaaatttaatactgctgttttttacaatgtcctcttttactttttatatttatttttgttgaaacctattttatcatttacttcattgttttaattgattgcaatattattctcaacgtttcctcttcttactttgttttttttccccacaaaatctaaagtagattttctattgacaaaatgttagtggggaatggggatcaacattttgctaaaaattttacatttttactcctttcaaaaagttttattcttttaaatagcgaaatcagcacatcataaggaagaaagtggatctattaaaaaataaataaacgaatagttagagtgacaatgttcatatgctttttgcatggatctcaaattctttttctattggctgcatcttttttttaagacactattatcatcttgtatttgttataatcataggaaatatatagcacacggttctatggtgtagtggttagcactctggactttgaatccagcgacctgggttcgactcccggtaggaccttttcctacattttatgaatgttttttcttgttcaacgttctaagtaatttagcctaattttttaaattctatctgaataatctctagtacataattttagtgactaacaaactaaattttcttatcaaatagtacatactaaaccggttttgttaattaatacatggcctgggacaatatgcaactcatacaaatgcagacaagtaaaagatttcaaatgttccacatgttttgatagatgcttattgtctgaaggtgataagcggatcaagaactgatagcacaaatagaaaaatgacaggaagcactggaatttcggacggaacataaacaactatctgaaattagctaaatatagtatacaaaattttaatgcacgtattattcattcatgaatgtaattcctattgttttgaaatttgtagggtacgattacagcaatgttggatgtgtttgatgacacgaaaagtttctacttgatattgactttataacagtagcattttatgcgactaaacagatgaatgttttgatattcaaagccatctcttataaaccaatatgtaaagtctcttaaccacctggccaactgtaaaataccccagaaaaagaagcaccaaaaatccgaaatatgagagaggtataagtgagaatcccatgaccttcccaatgggtgtgaatggaagtgcaattccaattgcagatgtcacaacagtggagaaaatcacaggccaagatgcaacatcctgtatgaaagggattttctctgtccttatcaagtggatggggagggtctgcaataggagaccttcaatgaaccaagctgaatggaaaaacttctgagtcacatcagtgtaagccttgtaataaaaccaaagaaacaaaagtgttgccacatcacaaagggtgcacactggtgcattccacaacatgaacatggacaagcctctctctgatgacttgtgaggtgtctttacatactcttcatccatcttgtcccaagcaagggcaatctgtcccacactgtagatgaaattctgagtaagaagctgtctagaagttaagggctcatacttgaataacagtgttgctatgaggagtgaaatgacacttcccaagttagatatcactgacatcttaacatacttcattgtgttgccaaaactgagtctaccatgctctactcctgcaacaagcacgttgaggtctttctcaagtaagataatatcagccatgtctttggcaatggctacacctgactccacagaaatgcttacattggcagcatctaaagctagtgaatcattcactccatctcctaagaacccaacaacatggtttccaattgattgcaaggattgcaccactcgttgtttctgaattggggtgagacgagcaagtactgtggctctttggactgtctcatggaaagtattttggtcaagttgttctagttcaggacctgttattacatgagtggtgcttatgccaacttccctgcacacccttgttgtcaaggagagggagtcaccagttaaaaccttagccttcactcccttctcggacaaacgccacagtgcttgctttgctgagtcctttggtgggtcgaaaaacgttatgaggccgatgaacaccatgtctctttcaatatcctcttcttctctcttgcttccattacttgtttcgcatatttgcggctgcaatgtcacacgtaaattgaaattgaaagtgagtcagccacagctaatgaggtgctccttattctcttatcctctcgtattgaatttttacataaccttgtgtggaaactttgtttctaactatctccattaatattcacaaatactaataagattccgcctatttaatgcttatgatgagagagatagacacgtgttgtcatgtaaaaaatcaacatgagaggaccgttccctacaataataagaagttattgtatagtttacaactgctaagtatctatagtttagctaatttccccttgacacgtagctgaatttattaactctttttcgttaattgaaaaaataaaaaaccttagttatgtgttatataaagattgaccaggactacaaataagtggtggtcatgaaccataaaataatttcacctaagagaataattttgacaatgtgatctttttagtgagtgttctatctaaaatatatgaagagaaatgtacgcccaatttggatgatgcaagaagaaaagacacaccatttccagcttccttatagctactgctataacccttaatccctcattgctcaaatcttctgagagatttaaaatctgctgataatcatctgaagagaagggagagatttcatctttatcgaaattctcaataaaagaacaaactttcaatacttctaacagtgctccttttgttaccaggaacctgccaaagaattgtgagtgtccgccttctgtttctaagatgacagatactcttcttcttatgaagtcaaaaggaatctcatctatcttcctccacttagatggctgaaacctgaatccatttgaatatacaaatgctagaatagcatcatccagaggatacttctgatcactcttaaagtaagagttgagaaaggcatagcgtaaaactttttcttggggtaaacccctgcagtcaagatgattaaccatgattgcatgattcattgtaagggagcctgtcttatcaatacaaagaatatccctgcaacatttaaaaatataagtacgcagaaaaagaatttgctagaaagatgcatatttggattaaaacaagacatatattccttgcaatatttttggaccttatgttttcattcattgttaatgatgcagttgcatcaataattgatatactagaagtttagcaccacgtatacaattagccaaattgattagaagttagaacacaatttagaccgacttatcaatttctctgtttattactacaagttcatatttattcataatgtttctaatacataattcctatatttatgtcttgataattgttaagaacgtgccttgctgatctttctttattcaaaattaatcaacaataatgatagatttttacattctggtttccactagtttaatctgcaaaattaaaacgcatgctgatctaatcattaattgtaggttccaattctctttttccctttctttgattttgatggtagagacaggggaaagcgtagttaaagctgggtaagaatggaaacttgaattcatattttattataagttggttcaaatgtgtgcaactgcatatgaatttagtgtccaagtcatcaatcagttgattttcaatgtgaatttatacttacattgatcccatgtcgcgtatagatgttaaactttttactatacatctgtctttagccatagcaagtgctccttttgcaagacatgtgttaatgatgaggggaagcatctgaggattgagggcagatgcaactgagatggcaaaaagaacactttggctcaagttaagagatgtagtgtaatttatcacaaacatgatgataacaactgctagaatgacagaaataagcaagtaaaatatccgtctgagacccttttcaaattcatctggtggtttcttcttcccaacttttgaaaacatggtgctcatgtaagtattggatccagtggaaatcactaggccagttccagtaccagataccacgtttgtgccctgtgatgttaataactaatcatttctcagcaaaattctccattcaatcagactatctctgatcggaaatttaatatttttgatggctacatcttaaaatgaagctataacttcaacggaaacaaaatacaaaatagggaattgtgttactaactcaccataaagcagatgttctttaaatccaataaaggagtgctgtgatcttctctgatttcagcagttttgtcagttgtccaagattccccagttagtgatgcctggctgttaacagggtatgaaatcaccatgtgataatttagttagctgaaaaggcaatgggaagaatacaagtgttcactaatctctaatctactaaaccagaagattttccggttgacataacacaccttacaacaagttgtttagaagataacaatctgatatctccaggaaagaggtcaccaggttcaaaaatcacaatgtcacctggaactacatccctctgatcaacttgaactacaagttctttctgaacaactctaccagcgcatctttgaacttttattggacattttacaaattccgaaagcttcatcgctgcttttgagctgctatattcctaatagacacaaacaaaggtcggaattagagtgaagtgaagggaagagaagtactaattccactgtttcaatgcaaccaactaattaatgtagaaaaacctgatagaaacgaagggtgacactgatgaaaaccaatatgagcatgataaatccatttggactgtcgcaggtaatgaatgacagaactgacaaaacaatcagaatgataatgaaaggatggaaaagagcgttccatagaagatgccaccatcttggaaaggaatactcaagtggaacatttggcccattttccctcagtctcctatcggcttctgtgaaacttaagcctgcacagaattgaaaaatactacctttcatatggcacaaaactagagggtggtatttaattcagtgatcacaattcacagaaatgaaaagctgaaaacactggaccctgcagtctagtttacatgcaaccaagacccactagcatcaacttaatggattttggatagtttgtatgaactacgtagttataagttctaactttagagcgacaacacataaaataaaatataaataagttaaacataatcatataacacatggataagattgtcttatatggtcggaaagtagacatttttttcagtatcaatgtagaattcacaaggtactgcagagtgcagatacttgcctctctcagtggacctaacgtactcgaaaaccaggtttttgtctgactgggccaaggtgtataaccaagagtagactttctcctcttccttagtttttgagtctacatctacttttcctacaatgcaattgaactcaacccggataagtagaaaaccaaaaaaaaaataaaaataaaaatacttcagtatataagataacagtaactaataactagctagagagaagtgtgaatgaaaatggaagaagatatggtaaggaatacttgaacgaataaggcgccgcaataattcaaagggtgaaaaggggaaccggtctttgtgggtatttggcctgtttacaagagtttgtcgtatggtgttggaataaggaagcatgtaattgttgttgtggttattggcaaagagggtggagactttggttcttcccataggagcattgaaaaaatgaaagaggaagagaagcacaatagttgagaaaaaattgaggagcatgtacgtacatgttgttcgatcgatggttggagatttgaatagaaggtgaacatagcacgcattttttttgccaatctaaggttagttcccgctcatgcttctaactaacgaaccagagacgaaagttaggtgcttcagtaccgttaagtgtttgcttgagtgatgaatcactatgcacgcatcattaaaagaagttattacatggttttcttcattctgtctcgttaatctctatttgacacggtattaaatatattaatatttttatacaaaatgaaaattttcattagaggttctccaaagtaaaaccaacgttaattgacaagtttataacagattgacttgacactgcattgtttaagtgagtgtttatatacacaatcattgtttaatttattattattaattaaagaaccattttttaattacaaaagttaattgagatcatgaaaatgtaaaaataaaaaattatttaataatttctctacaacattacatacaagaatgacaaatgttaaccagtatttttagaatattaattaagaaactaaaaagaaaaagatttttattgggatatacaaattacattggtagtgacttttgtttaccttttcttatgatttttacaataaatatttttttttaaatttcttaaccaatgttgtaagagcattgattattcagatcctacaagagtttcattttatattctttatttcttattgttttaataaaaaaaagtgacatttttttttggatgcttaggatatcttctaatcatgcgtcagttttttttagaatatgaatatctatttaggagattggtgttttctaataaatattttttcatatacaaatagaaagattaaacctcaaacttaagcacatatcatgtagcgcttaagcaagacagcctaactcacgcttaattagcgctatggtctacctcacgtttaagagagctgaaattagcgcttgagtgcaagtgtgtcacatgtgtttttttaaaaaggcacatgtcagatcctatttaaggacaggatacgaggatttgaccaaatttacattagagaacatttctcttgaagttgggacctgttgtgaagctttttccatgactctctcttcaagaccttgcctcccttcttcatgttttgagattttcatgtctctctctagctaaattctcctagtatttggggttggaatgtaatgaccctgaacatcttgcattttttttatattaatatatttttcatttctcaatcttctttcttattctctttctctctattttagttgtggcatgataaaccacatatttttggcttttattgcattggaatttggaaaatgttactaaaacctatacctagggtaagataactaggggtttgacactaggaatggtgtatgcatgaatacttagccatcttgcaaaccatgtgcttaatgcaaatttcattattgatttacttagggaataggaattaataatgagatttagtctttaaccactaagggattagatttctagtgacttttatggttgaggattgattgttgaatttgaagttttttagttatcattaatacaagtaggtaaagtggcatgaaatccaaccccgggcacattttatcttgatattgttgaaaatcataattattgtattctaagtgtgtgtgaaaaatcctaaaaagagtttttaaaaaacgcatataattattaattacatcttatataagtgaacgaaaaataaacgttcgtttttttcggattttacattatggattcgataagaaaaaaatacagggatgatcaagttgaaaactacatacatagttagaatgcagtacaagtccaaagtttaactttttcaacataaaagatatagataaaataatatcgaacatgaccacatatatatgttttagttataaacacgggtattagttaattagcccgaaaacaaaataccggttacaattgataactagagtgttgcttcctgcacctctctagcaacccattacatttcagaatgtccactccaaaatataattctatattatagaatctaatggggtatctgaagtaaaaattgaagctaccgaaagtttcactctaataactaatgtgtaattgggctttaaacatattcatttaattttatgtggtttaagacttgtgtcttagtattgggcttaagttagctctttttgtttaaattaggagtaggtcatgtgtaaatgtatgatttttttaagtgagagaggagaatgttaaaaaaaatgtagaattattcagtcgttcacagatgacgacgaccggacaataacttttgtatatatataaactaagagaacctttgttcttgaagaaaaacttttactctcctcttcaaaacaaatatttactcttttctatcatgtaataggttagaacatcattgaatagaagttgtttatatccttatctaaatatacacgactaatttgattttcttattaattgttgcaatgaaaagatggatttaccgccattatgttgcataagtaaatatataagtcatgatctcttattcaattagggtttatttggataagattttcttttaagtatttataggggggaaattaataaataaataaataaataaatttttcataaactaaaattaatatatttataagttaaaactcattttttggaaaaaaaataattctacaaattaacttatgcatcaagtaaattatattcattatctctggcatcaaaatttgtctgctcatagcatcaaaattcgtactgaatatctaggaaagctgaaaaaatatggaagatcaagttttttcctgtgacagtcttcgatacccgacaaataagcgaaaggaaatgggaggacaagagtggagcaaccaggctagaaagctaaacacatccaattttttttagcctccacacaacacgctttgcctccaaagttcatctcacatgctatatgcaaaataatacatgagaataagatttagtgctagttttgtgggtctgctataataagtccgacacattgttttattctcttttattttggtgaggcaggtcttatcattgatgaaaagtataaaaagatgctcgtgtgtgtgtgtagagcaaattaaataagagttgaacagtgtgtatgaatttggagttttatggtccgaaatctatttgcctaatgattgaatgatagtgaattggtgggttatgactgtacggaaatctctccgaaattttctgcatttttcaatggctgaaatcaaagtttaatctcacaaaaataaagagaaaagaaagaagacacctaatatttacatattaattattttcagacatagctgctccagcgtgctacaggtacttttgtccacaaacgaaaagaaacctcaaataataaataagagaaatattttaaattagaaaaactgggaacaggagctatccactgagcgtgtgcatgagttgtttcagaatcaagcaacggggctgcattagataacccttttagttggcagcccaaaaatgttgaacccgattggccaattccacactattcgacacatgtcgctgtgatccgtgaatttgtggatttcttttgaacaagtgtgcatgaggtcaaccgttgaatattaaaatcaaaaaacgaaaaggacaaccattttttatatatatcttgtaaaatatttattcatttttggttatcacaataacataaaatgagatctaactaatattattgggaagaaaaggtactctttttatttgatctaatgaaaaacttgagtattaatatctctttagtatatataccagattgcatgtaattttactgaaaataattttgttactaagtcatataatatttctttcaaatatttcatccaattacatataagaattcaaattcaaaaatactaattaatctaaaataatctcatattaattgatcaacatctttaattataaatttgttttattataccaatatatactaacaatattttataccaacaaacattattatatttatcataaatttattttttattaaataaaaattatattaacttaaggttaactagtagtatattttttagcgtattttacatcatccatgtattatataaacaaaccctaaaccatgctgaagaggtagctataaactgaaacaatagcgacattaagttagatctacatggccagtggcgtgactacagtggactgcgagaaacaagttagatcatggaggctgctacgttctctcatgcaactactaatccccacatgtaactgcgccaccattatagaagaagaccaagatgaaacaacaagaacaaacgagaccctccgaaacacaagcaaatatatttattcaccatcattgtcactgatgagctccaccaccaatatcacaggcacgatcttcggatatcgcagaggaaaagtgagtttttgcattcaggcaaacgccaactccaccaatccaattctcctcctagagttggcagttccaacaaccatcttggccaaggaaatgagaggaggaaccctccgaatcgccctagagagcggcaacaacgacgacgacggcgatggcgaaatagacacacttttgtccacgcctttgtggactatgtactgcaatgggaggaaggtggggtatgccgttaagcgcaggccctccaacactgatttcgaagcgctgaggttgatgcgttcggtggttgtcggaactggggttatgaagtgcaaggagttagtgaacaaagaagatgatcaacttatgtaccttagagctagctttcagagggttcgtggctcagacaactgtgaatctttccacttgattgatccagagggagacattgatcaggaactcagtgttttcttttttaggtccaggtgacattttgttttatttttatttttccaccactttccttagctttttgagctgtgcttaatcattgtggtcaaccagaccagagctgctagcatggctttaattgtccttcgaactgtttcattttattcgccctcgtagttgtgtaggacatcgtggccagattgtgatggtttcggaggagaacggcacgctgataccgttttttgtttttgtttttgtttttgtttttgtttttgttttctttccctgaaaatattaactacttggttttacttttgttgattcccgtttagcagaatcaaaatgaattgcgttttgtctcaaatctgaacagtattattaagttttagaagaatgagttttaaatacaaattaagttgagttgggaaaaaataaattatcagtttgatatttaataggtcgcacttatacagtttttgataaatttaactaatatatagtgtagaatgtattaaaataagtacgttgccagcaaattttttaccattgactttaatttaaaataactgcaggattggtttttcaacgctcaaagtcaaattagaagataactgattttgtatgcatgagcaaacatatcgttagctcatggtcaaatcaatagtcacatcaagttttgtcaaccataatttaattaaagttttatttatttttaattattttgtgtgcacaaagaaactgataaagaacttggttcttcgtggaatccatctatctgatcaagattccatgatttaatcaaagaatcttcgactttcttaattttttttactaccattaatatatatatatatatatatatattacattggacatttaactaatctctaggttgagctgaatgaaattactagaggtgaaaaaaaaattaacttctaaactactaatataatttaattcttatatagagatttaaatttgaaatacactactacataaagcaacacgggttaaaagtcggttgccacgaaacaacaaattaaagtttcactcgttttgtatctctgtatttaaatttacatttttattaagaaacaatctttcatcaattgaatttaatattttatcattttcaattcatattttatatttcatttaatatatgtataatgtagaatatttggtaaattttgtaaacattttgtcgacctatatgcccgacaaatgtcttctgataactaatcaactttaatttaaaagtttatgttgtaaagttatacatataaaactggagcatcgttttagtccaatcgtcagtgagaataatcaggatccaaaagcatttttacgcgtaattgacagctcatcatattctccttgttactaatattgcgcaaaagcaatcttacagaaataattctatccatgtttacagctttagcacttcatatttaaaacaggatctgaaagacatgcatggagtagaatccatgagttactgattttgaaacgagagtagaatcaatgagtttgagacaagtagattattaatttatataagtactagtatttcttttgcgacaattaattttaaaaggccaaaatcttggatcattggatgtagatattgagagaaaaaacgtttaagaagggaacatttactaggagccgatgtggggcattttccttcttcaaaatgtgtatctaattgcatttgtttctgattcattatgtcgaacttcgtaatcattataactcaggtaatggcttgtcaatttataatttgcccccaacaacctgttttggacaatataaaagaataaaaaaactttctggactttcactttccttagggggcgcaggaagcaattcccattctggcttttctatattttaaatcaagaatgttgcttcctacaccgttcgtttttctaatacaccattttcgtaacagtgaaatttccaaaatatccttcactattttatgccttttgcttcatacagattcgcataattcatacggattggcaaatccatttattgtattgtattttgtcaacgaaattatttgtcaacttcaaatcaatctcatttaaatatatattttttgatttttttataaaaaaaaatactgatataaggcatatgaattacctaatccatatgactcttacggattggtcaatccatgagtcatgtgtattagataatctatacgactcatacggattggtcaatccatataagtcatacgaattaggtaatccatatgagtcatatggattggtcaatccgtatgaattatatggattggccaatccgtatgagttatatggattacctaatccatatgaatcatacggattgaccaattcgtaagaatcatacggattacctaattcgtagcatccatacggattatcgaatccgtacgatagcagacaccacccatctttgcacactttgacgacgagttcgccgctccggcaaccacccacaactccaaccaaatgaaccaaaatggcaccaaaaatcaccaatgcttctcaaatgcaactgaggcgaaccaaaaatcaacaacaaacaagaagcaaaaatggtgcttagctcaactaaaataagtgtccaaagcagcagaggtattttcgggtttttgaaaaattaatggccttgtagaatttttaaatggtgtatgaagcaccattcttagaaatttatatattccccggcccttcacattaccagattagtgcatgggcttcaacagcttgtgtatatactatatagtagatacacggcaattgcttcctgcacttccattttgttttctgtacctttttaatcttctggaaagtataatttaaattgtaattttacatttagtattagccttttcgaaatgtaacccagaatgcaattcggaatggctaattgaaacatactaacatgtatccaaagatagaagcaattatgggatgcaggaagcaaagccagaggggcaggaagcaattgcctacatacacaaatgatataagaatgcgctgtccattgaaacattttaacatgtatccaaagaagaagaaaacgttgataaaaacattagtcattgtatgttcttgtacacccttacttgctatcaattacaattccataaccgtatatgcttgttttggggagggtcaagggtgatgataagcatatgctttctttttggttgaaggtaattaagcttaaaccaaaattaaaactaaactctgaaaataattttttaatctgtaaattaaaataattcttgtgcccgtaaagggacatatatgacaatttacaccacatcatatccacttaactcaatctcatgtgtgcaagtctttgtttcttactttgttgtctaaaagtccttaaaacaaattgatatataaacactatagaaaaaagtattaaactaagtaatatgggatatgagccttttgaaatactccaaaaatcccaacttaataaactctcttgctactagtctaattttttttttttatggaattagtctaaaattattagaaaatacaaaatcatagattaatgagtgaaactcattcaatgagatgcaataccaaaaaaatcgtatttttaacttcaattgaataaaattactaaaatttaaaatcaaattaattcaatgataaaaataaaataataccaataaaattgaattaaagtaactctttcaacgtaatccaattgaacagatgaccctttcaattggcactgcttgtgtatatttggtacgtagcatatggacaatcaatcgttattcttccaatccgtttaaaagtctacgattattagattagttttagaagaaagtcaagaaactactggtcaactgtttctctttcctcgttacattttttttaatctactatccaatatccaattttcaatatcaaaatcaacaggtcataaatttcaataccaaagcaatacaataacatattacgtactgtgtgacctctcgaagctgcatggtaaatgttgttaaaaaaataatattagactcgtggcaattttttccccagaaactcatggcaagttatggaaagatagaaaagaaaataaaaggcaaatatacccgttatggacctgtaaactctggaggaagttgggaagcaagttatttaatttgggatgttaatttagaaagtactattattgtagagtaatcatcaatttagtttcagaaattataatattgttcgttttaattgtttcctaaaaattataaaacgagaagataacatctaaaattctaagttctaattaatttaattcataaaattaaaacaattggtcaaatactttcaaaattatcactcgcaattataattcttaaaaaagcatttacaattataataatcataaatattaatcattaatttattattatttaatttatttgtttttaactagtgtgatctaacacggttaaaaagaatggttgaattcataagctaagtgtgtaaatgataggtaaccaaacacgtatatgtagttaactcattaattttaagtattttgcattggatttttatctatacattatgcacggttacttactagttcctaaaaaaaacaatagtgctaataattaagtatcctatcaaaacatgtcaaaaaaaaagtatcccgttaaaaaagaaaatcactatccccatttatcaaaaagagaaaaaaaagacgactataaatatttaaaatatatattcgaaacatataagtaataaatatgtttaatttaaatataaataaatttttaactaattttatcatatttaatattatcattcttaaaatatcattcatatgattttaattctatttttaatataaaaaaaatattcatgataaaaaatattttaaaaataattttatttttttactgagattaaaaaattaaataatatcaattaaatttcttaattgatatgatattagttatttttgtttatatataagtttaaaagaagtaataaatttaattataaaaagtaaaaattaatattcaatataatatgtatgtaagtaattaagtgattgaatacaagtaatttttgttaaaattaattttgaattagactatatttattttctaattaaattttgtattaatgatgattcatttatcgatcgagggttaagaaaaagaaaatggaaaacttaagtgtgtatatatgcactgttctagagccatcaagtcatcaaccactcgattgaacatgcgcaaatttgaacaacgcataaaaataaaataaaaatctggctgggcattatagctgagaaggcaacatcatttcataatcatatatcccactagggccaagccaagacagctgactagattgggttgggctttaattccagtttccaccataaaaattttcatgcgcgagtagtgtctgtgtaaatgtgtttatctttaagcacgccacataaacatgacaaaactcacgcatctaattgggaaaatcaaggacaaagcatcgcagagcaaggcggcgttgttatccaaacgcaccacgctctccctcctacgcgccacgagccacgattcctccacgccccccacgcgcaagcacctggccacgctcctctccttgggcgacggctcacgcgccaccgcctcggccgccgtggaggtcctgatggaccggcttcaggggaccaacaacgctgccgtggccctgaagtgcctgatcgccgtccaccacatcatccaccacggcagcttcatcctccaggaccagctctccgtgtacccctccgctgggggcagaaactacctcaacctctccaacttccgacacaacaccgacccgacatcatgggaactctcgtcctgggtcagatggttcgcgcagcacatcgagcagctcttatgcacttccaggatcctgggattcttcctcggaacctcgaccgacagcgaagacagggtgtcgggtctggccaacgtggacttgttgaccgattttgactccttggtgactttggtggaagggatttgcaagaggcccgagcccaacgggaacaggttagtggaggagattgtgaacctggcgcgtgaggattggggcgtggtgcaagttgaggtgcgcgtgagggtgagtgagtttaaggagaggttgggagggtttaagtttggggaagcggtggaattgatttgttgtttgaagaggttggagcagtgccaagagatgatggatggggcaagagaacttagattgtgggatttggttagagaggttaaggacaaagcagggattcaggtgtatagagaagagggtaagttgcgaagggaaactataaaattaagggtcagtgaatcggatcgcttttctgctcggcttctcaattctcgtgactttctcagcttttcctccgggaggttgatttaacatttttatgtcaatgtaattaggaatacgggggggttggggataggttttttgtaattaggattgcatgtgattttaattattgtaaggtttgtgataaggaactgaattgctgccttgtgttgtgttcaatcaaaataatacatatagaggaaaatgataagtagtagtattcgagaggaatctttcattgggagccgcaggtgcactctagatccaaagatatcttcttgtttttaattgattagaaggggcataacatgagttgagttgtgagttgtgactaccaacttgttaacgtaagcctaacaaaatgagttgtaacttcaggaaccccgcaatatgcaacgaaccagtataaataaataaaaataactatacattcgtgcatttatcagtttctttatatcttatttttctttttatctctatcgtaatatcacattattaattatattttcatcttttaatttttctttctcccttctactccgtatgccttgaaggtgaggttgtatctatcttttaaattgtcataaataaataggctaccccagctgaaaaataaagacaatagcacagcacaacatgactggtgttagctagtgtgttataccattcagatggttatgaaataaataggcattataaagtgccaccaaccataattccatggaccatgcttcatgggcgtggtcgaagtgttcaagatataggattggtccgattggatatgttatacggaatataccagaatctggccattgaacagtgaacactattgaggcctaaaagaagctagggcgacgagacgtgtgtgcgttgtgtttatattaagagttttgaacatctgttaaaaagtacagctgaaagattattttgtttgatttagattcgagtctgactgtaaactgagtttttcttcaattttaccttcaaactcagtttaaaggagaaggaaatgaaagtatactttacaaattttaaaccaaacatattcttcgtaatcataattagactgcacaagattccaataagcaaagatgttaagttatcactcacaccatcattagttttaagcatgttaaatgtacggataacaaatacaaaaaactgtagccaaaacatgcgtgatatgttatttattagggcattaataagaattcactttccatctattaagcaaagatcaatatgcaagccacatttgtgaggatacatatccggctccccgttatttattcgaaagcatccacggagttaggaatgtgacttactagttagcccgttcatttgtaggcccattctatacagtgaaatggagctatctgcaaaccatcaaaagcatatcgatggagcccatctagctccatggaacctcttgtacgtgattgtcataataaagatacatccgtttacaataaaaataataattaataatacgttgtcctttaatatatttttttcatcacatggttcttatcctaaaataatcacattaagagcctagttcacacactgtattagataagataaaataaattaatataatatactacgattttagtatccatttaatgttcaaattgtaaaaagggaggtgagaaaggagatgttgccttaaaaattgacataaataaggcatatgatcgccttgactggaactatctctgtgatatgcttcttaaactgggtttcaattctatatttgtttaatggaataaccattttgaaatatctgttcttgaacgctaattaacagattatttaaatcttgaaatagatttatttatatattttttaaaacttttcaggttcttttaaattttatttaagattatttctcacaattatttttttttgtggattcaaatttgaataacttccattcatctggataaaagaagacacatattatttataacatcattctctaattgtcatttttctttgttgtgacagcttgttttattagtacctttaatttttttttatttgtaatgttgtcaataatattttagtgcaatcactctcttctctcaaaatgattacaatgttcattgtagttgttttaattcttatccaaaaataactttttttatttattattcatatccatgtcaacttcaaccaacatcttttgttgaagtaatcatcttccatacaaactaaaactataaaataacaaatcaaatttaattatctattaaacagctagaaggaccattccgtatccaaaaaatgatttcagaatagcattttcataagcatgaaaaggtatttaagaaagtctttcccggaagcaacaagtacattctagaacaggctttctggaaaggataagcttttagaaaacctttttacaaaacggtcattttgaaagcaaaaattttaggaatgagatatacaaaaagggtgttttggaaggtattactgggcttatgaaaagcccactctagaagaaacaagtgcactttggaacaggatttctggaatggttttttggcttttggtaaggtgttcctgacagggcatttttggatgaaaaaaaaaatccaaaataagctttttggaaaggaattgcttccataataggtgttttggaaaacctttttccgaatggttattttgaaaacaaaaaaaccgttccaaaaagccagctctggaaaaatgtccacaacggtgatgttgaaatgtacctggcgtggagagttgaaggaggggatggacttctgcgctagaacctatggtgtcgagagttggaagaagaattcggttggagaagaagagaagaactgttaagcgagtgcaccgcgggaagaagagaagaacaaatagaagagtttgcgtgagaaagaaaaggaataagggggagaaaatagaaagggtaggctggggattttttaaaaatggaagatgcaagatgcaattaagaacgcatagaatataagtgtcatatgtaagtcgtgatgggttaaatacaaatattaatggtccatcaaaatgaaaggttttgtttaatgggtatcgataaatatacccttgtaactaataatatatcccttttatattattttttgtcacgagcttttaaaaaaaccttttttaattaaataggtaaggccataaacttaaaaagaaaacttattaagcttgatggattgagcctaattagcaacaatattattttaataaagatattattattattaatatgatataatatcataattatttcaaaaaaattacaaaattattttagtgatttgatgattgaatttaatgtttggtatagattaattgctatatgcatatatgggtagcagaaatagagattatttttttttggtggggcttaaaaagttttgatgacattcatgtgtaatatttataggcattagataagtttttgtcacatcttttagtttaaaattattttattatttttaatgaaatttacaactttgttaaataaacaaaaagtaaatggaaataacatataaatagttggttcacactttaatagtttaacgtttaataattttattattatacaataattttttttttatactttttaacatgaaacatgcatttaaataagctaatagattaaattagacttatagagagattaggactagaccaaaaaaacaaatccatgacaaataataaatccaagattaacttataaaagtataaagtagatcagatcagacttaaataagattcgacatagtccaatctattcactcctaatcatatccctaaagaacataaataataataaaatcatgaaaaaattatagttgaaaatccaaaaaatgtattgaaacacaaagtgaaataaaatcctaacactagcttaaaaaacacaaattacacactaaatttttttggataaaaacctttaaccctagaatattttggataaacaacctttgaccccagacaaggaagcttatatcctcactcataaagtataccatcaagcttatttcctcactcataaagtataccatcaatgttgaaccaactcaatgatcatttaaatattgtaaatagagctattcaaatcagtaagttgttccgatattgatcgtggtagactcgttaattgtcaattcgctaggtggaatcgttccacggtttcccacatgtatagtgtataattgttatgccatttgcattgtcggatatctgaaggggatgatattggaatataatacgcagtccgttaatactattatacaagtgctgtaaagttattaatccactgggtaagctatatgctattaataaatagttgggttacaattaatcggtaaaaaagaagagaagagtgtaccgcaaatgatgtaatattttcgtctataaaacttatatttctaactcattaatatattttttttcctttagcctcgcattcaagtggctcaacatgttaatttctatatcgacatcatggatgagaccaacaataacgtgcctatatgttataagttcaagaataagatttttgtttacaagtgccaaacaaatccatataatttgtaagttgtttcatccttacccaatttggaaggataaaagtaaacatagggtgtagtttaaaacataatttaattaaaatatattgatttagtaaatattttttgatttttatttaattataaatggtcacgagattaaaaattattaaataagttgatttattttcgataaaatataagatgatttctaacacgtgacaagtacaaaactgttaaattttgagtcttagttggtaattagtagcttgtaatagagctccattttttttaaattatttttagtgacaatattttattgttgatgaactttttatagagcagttttaatttatttattgacgtgatactttattgtacaaatatgtaaatattttcgttaaacattatatgtgaaggccactcttttttaaaacaaagggagaccaaattgcaaaacgacaatgaaaaggaaaaaaaatatacaatttaggaaagatattctagtttagatagaatttagttgttttttttttttgcagttgattaagatattctgcatcaatgattcttgtgtattttttgggaatcacattggtaattctcgataataataataataaagtattgggccttttgcaagaagacgtcggttggttaaagcgtactgtgacttggctggcggttcgagggcaagcctactttcgaacgaagcaaaccaaatggtaagatcttgctaaataagcctccctaatttctaagcaagcccccctttcttctaattaaaattcttattacccattatacccttgtccatgcccctacaaataggaatggaaataggtcaggctcgattaggcctaaccttggccttatttaaaaacatcaagcctgcctaatctatttacctgttagaggctttttttttttttaggcttggtctagtctatttaaaaatctgacttgacctacaagcctattaaaaagtctattttacaataaatattatatattagtgaaactttgagaattcgcataatactttttttaatttaatataaagaaatacacacattgacatacttcccttttaatttgtgggtgaaaaaaattaaaattaattagagcactctaatatgagattaaaattcactaatcacaacaaactcagttaaagattgatttatatattttttagttttaatatatatatatatatagataaataaatattaaaattaaaaagatttgaaatctttgtagtaggtttgtaaaaaaaaaaatatgtataaactaacatgacaggcctaataggctttttgtaaagcttgaatccgacctttttatttaaatagacttttcaaaaaatctaagtctgatctttataataaataagttaaacctaggccttaaacaggtcagaccaaagacccctaatagatgacctggcttatttctatccctacccacaaatgtgttattctttaaacgtcttcactcttttgctgttgcttatgctttcaaccagagagaactgaatcataccaagaacccacatcaactgaaaatcaatagatcattactcattttcactaataaataaaaaatcaactgaattatgtttgataactatagaaagatatactatgtctgtagcaaaccacccccactctgaacctctgcaaaatctcaaatccatcgtcaaccagacacaccatggacctcaacaaatcgcccttacctccaaaccactgtgaatcccttaatattcgtcgcctctactccctcttgcaacctcaatcagacttgcaaacagacccaaaatccaaacaacaaattgagatccaaaatcaaaacccctaaaatagaaaacacgactttctcgccgattaggtgcagccgttgttgtcattgtcactgtcgctggcgacggcaacagtatattgggtcccaattcgtattgaataggactgcctttggccatgctctagacccaaaccctaacctacaagaccaagggctcccctttctcatccatggcgtccttaatcctgttttccatcggtgcctcgccgttgcaataaccttcacctcgcttcttaaagacaatgacaccatcgagattccctatagtatgcgctagtttcgtgaaggtgagggtcggggcagaggaggagatagaggcactagtagaagaaggtgtcaacggcaacgccgttgacgataatgtggaaagcttcacacgctgatcgaagcttggtgagggctttgtcgggggtgttttgatggctccaacaacagtgatgtgggggtggaaggtgggctcaccgaactcaaatcggagggcgatcatgctcttggaaaggaggctagagaagaagactttggacaagttgaggcagttagtctcagcccagtgttgagcattgtagtgtgaatgtttgggttaaaggaagaatacattagttaacatgtccatgttataccatccgaagttaaaagtaatttttgagagtttttgttatgatttttttttttttttttatatttctcataaaaaactatcaaacagttatatctaaacagacataatgaataataataattttattagaaaaaagggaggcttgcttaaaaactagcgagacgggccaacggcgacaagctcgtggtgggggcccatatcattgctaaacgggcccactcctaacgtggtcctcttccccatacataattgtcattagtcattaattaattatagttagcttaacttaatgctcccaaataaaacatctttaatatcatcacaaccttcatggtggcagtgttgtattggactgttccagcacacactaaacaataacataacaaaaaatcgacctttgccgctttcttttacaacctcctctaacaatactctttgttttgatcatcaagtgtaatgtaaccaagacatatgtcgcttgtatactttcttcattctttcgagtttcgaatataacacctttttcattattttttcttacaattttgtatttttttcttttagaattattgcaaaattattttttgtttttagtacttaaaacattttaaataggaatttgatcaataaaaaaactatctgaaacatcacaggaatgaaaaacagaaaaatatatctataaaaattaaaaacaaaaacataattttacaggaactaaatgtaagaaatcgttaaattacaaaaaactaaaaaaatatttaagttattattttttatatgtaaaaatctattcatgaaatgacaattcatatatgaataaagagatgtatttgcatcccttatttttaaaaattacatataaatatttaaatatctatattttgatttctcaattttatatatttaaatttcgtgtccttaatttttttttatacttttttcatgataataattaataatcttattttttttaaatgattgtcttttctaacttaggattctagtaccacatctagataaacatcttagtgcctttttttttaattatttcacatatattaaaacaactcattatgaaaattataaaataattaaaattatttttattaaaagtaatgaaataattttaaaaatagtcttgagatcaataaatctgtaagaaaagacctatatggttgatggtattaaaattattaaaaattacataatttacaggtttctttttttatataataaaatttaagtaaattgagcctgtcaactcattaagaaacgaccaccaacaactaagtccgtaacaagattttgttggcaagttttactttatattaagagttatgtatttttttttatataaattttaataattaacaataaatagtatgattggaaaagttgtagcaacaaaaacaatgtataaaaaagaagtgaaacagagaaagtgttttatttttttggatactgagaaagtgtttgtttgtgtaacgaatattttgtgttgaatataaaaaagcaaaaccgggcacacattcgctggctgccacgtgtagtgtggtatggaaaatatgaaaatgccaagcgaataaataccctcttgtttccgtaatagattagatgaaataataacacgtattagcagagaactgaaccagttgtcgcgagcgagtcaatactcaatacacacaacaacgcgtggagaagagagactcagtaaaagtagaggtcaagactttatttattagttaagttataaagaaagaaattgggatagagaaagtggaatcaccaatcttgtaacggaactttttctctctctcttttttttttttatcagttccatagctagctgtgtggagacgacaactgccacccattccaacatacagagaggctatttactaattacttttcctcgttgtttgttccgtcctatactctcttcgtgtgaataaacatataaaccacctcggattttgtttcctctgctgtgttttaacgacaacgtgtttctttgcttaacactaaaatttcaaacgccgattcgttttgcgactttgtgttcacgatctggttttgttttgattcattcgtacgttggactgtgaaagacacgccgaaatgtggtggatgatgagcgagactggaggcaattactgttctaagaagagcgatgatttgtgctccaatgtctgtggtcaggtatatcatccataatatttttttattaaatgttacttttccgtttatgtggtgtcgatgtaagttaatctttcagctgtggcttcaattcgcctatttaatttgtggatttcgttattttggagaaaaaaaaaagtcattttgaatggtttttccatagaaaactgttgatgtggtttgtcatgtaatctatcactggattgtgatgaaacttttgtcctagatttgctctttttaggtgttgtttgttgtgtgctatttttaatttttttttttggtgtgtgaacgagattttcgagatctgaatttaggtatgggataaggttgcgttttttatgttgttattattattattattattattattattttctctaattttaggaaacccgctgagctattttttttggcttgtaagtgaacgcaaacgaagacacctttttttttttctttccttcttgttcctattttttgggggattcatttgggagggaaaggggtttcgtttatgttgtagccataattggatttgaatgggtgcaaggtttctcgcatgaagagcttgcaatttggggttttttgggggcatggtttcttttctcttcatgatacagcttttggctttatgattacaattggggatttaagttatatgatgcttgaaaattttcatcaatagagagaggagcattgggtttttgataagattgtgtatgatttaatgaagctgcatatgatatttatttcatgatttttcattcttgaagctggatttttacagtttacttatatgtttgttccttaattttgcaggaatcaagtcaagtatcaggcatgtcacgaattcgctgcattctgcgtggtctggatgtgaaaacctatatattcatgtttgctattatcccaatgtgtgtctttggattctatatacatgggcaaaagatctcctactttctgcggccactatgggaaaaagcacccaagcctttcaatgtcatccctcattactataacgaaaatgtcaccatggagaatctttgcaggcttcatggatggggagtccgggagtaccctcgacgtgtttatgatgctgtgttgtttagcaatgagttggaaatactaaccttgcgctggaaagaattgtacccttacataactgaatttgttgtccttgagtcaaattccaccttcaccggattgcctaagcctctggttttcagtagcaacagggagcagttcaaatttgttgagccgcggttaacttatgggaccattggtgggagatttaagaaaggagaaaacccatttgttgaagaggcatatcagcgtgtagcattggaccagctcctgaagatagctggtattactgatgatgacttgttgattatgtctgatgtggatgagataccaagtgctcacactattaacctcctgaggtggtgtgatgaagtaccctcaatccttcatctgcagctgaaaaattatctctattcatttgaatttcatgtggatgataagagctggagggcttcaattcacaggtatgagactggtaagacgaggtatgcacattatcgccagtctgatgacatattggcagatgctggctggcattgtagcttttgcttccgccaaatccgtgatttcattttcaagatgaaagcctacagccattatgatagagtcaggttctctcactatttaaatcctgaaagaattcagaaggtaatctgcaaagggaccgatttatttgatatgctgccggaggagtacactttcagggatatcattggtaaaatgggaccaataccccattcctattctgcagttcatcttcctgcttttcttctggaaaattctgagaagtataaatttcttttacctggaaattgcaagagagagagatgatctaggaaagtcatttatgatactgcattgtttctgagcttgtagcttgtacagctcaagtgactctcctctctcggaggtttttaactgaggttgtgatgattgtgtgtcactcgtatagctgtatcattgtccagtgagatattctttgggaattatttaatttcagataaattctttgatctagggggagttctgtatataatttagagctggagtttcattcaaggggagcaacatctctacttatgaggactgaaactgctattttgagaacgggtttgccttcatgaaatgtgtttatttggtattagtgtgattgatccccgatatacgagagtagtttaaaattccccactttttcctgtttgggaagttttgttctgcagaccaatttattttcttattattctttatttatgctaaatatctaatccgattggggttggtctatattcataacagtgctgactcagttctttgcattacataaatttagtttggttactttcaattggatgccgttccaatatgtgatattaatcgggcgcgacatatgttgctttattttatcttatttccgtttccctctgtagaatggtaatttcctatttggaatctgttggaatctgccaacattgattttgctctataaaattatttgactgatttagacaatatgcaataaagcgtggggatgtgctatttactgaggtctttcgttagacgatggtttagatagcttgtgatttagcgcttattcatgttatcttctaattctaaagtccttctattagactaattttaaccagttaacaataagacatgtgcatgtatcatcaatgaagttcttttgttgaaaaccaaatcgtgtcggacttgatattggttcagtttcccttaggctttgtttgggagttaggaggggaaggaaaggaaagagattcaaggggaagggaggggaaggaaagggaggaaaatgagggaagttccattcttcttgtttgggagttaaaaatatattaagagagggaatagagagttaataagaaatttttataattttttccttatttaaaaaattaatacattctatattttacactgactaaggtaggataataattttattaacactgctggtataaaataataattttagttacttttccttctaaaaacctcccaaataggggggattataatttctaagcattggagggttttggaggagtttcaaaaatccccaaatcctttccctcaaaaattataactcacaaacaaggagattactccagctaaacccttcctttccctccccttccctctaaaacccctctcccaaacaaacccttagggttcttttcattttatatagggtcgatggtaagtttcctattacaattttctaaagaagggaaaaagcgaatattaagtatgtttgattgagagtggggagggtgacaatttcactttctaagatgagttctttaactcatattataagagaaaattaattatatttatttcattaatataatttataattaaataatgagtttgttgtaccaaagaaaagaaacaaatgtaccaaaaaggtaatgagtttgttatacgaatagaagttataattaataggttaactattgatttaagccatgtttataaaactagactagctattgaattagacaattagtgaaggattcaatagtgatccaaccattgtctattcttccgagctccttaatatgaagcccaaataggcattcttcgatccctaagaatataggacattcaatcactcttagatcttgggaaccataagctctacaacattcacacacaacatgattcagctactgaaatcttcttcctcccattcccataaaacctctttcattcttcattgatttctttggtcaacatatgactcatgtcacttagccaacgtccactagcatttatcctccattatcctctaaaggaacctaaaagcttgcctctatcagagtttaggaaaaggttttactttggaatttggatagaagaataaaattgatgaaccccagttctggtcaattttcacattcattgactagttcactgattatttggctagttttatgaggactaattccaagggtcattctggccagatgagggaccaattgtccaactggtcaaaccaactagtttaatctggcttttactagtccatttaggtgcaacacttttgaatatatttttcagaactaaggaggggttaaggcccaacacaaaagctaacaagaagattaaccaattacgggtccaacccaaatgctttgtagttgagaaaaggaatattaatatgccatttaatttcctccgcaaattaggaatcaaatttaactttttttcttccactcctttcgtggtgaatatagaaatggagattaatagtgacgttctaatatgactttaaaagaaaattacattcatgattcatagataactttgttgccttgtgattataggctttgatccttgactgcttaataaaaattgaataattaacgaaatacatcaaactgatcaactttccacattttcaaaaaagtgaaagactatttacttttatatatttacagttagttaaaaattattttatcctttcattattattttttaattaagtcatcctttttttttgacgttgttaagtcgtcctctatagattaggagcatctccaattattatacaattgcatgagatcttatctctacacgtttttactatgttttatatatacactttttattttcttttcagttttttttaaagtaaaatattgagattaaaactctttttcttagcttcttttttatcccactctatcttttcaacaaaaaattataaggaatataaccagagagatacatgactgtggacattgaataactattttgtttcaatttataattaacttagatctgcaaggtgttaataaataatgaactattacagacgtcagtttctgaagtgttggtcatgccactaaaataaaattccaaattgcacatgaaagcgggatatatatatatatataaacttttgtacgaatcgaatttcatccgagttgcgctatctaggaacaaattaaagttggttaaatgatggtggcgttggaatctttgaacaataagaaaaataccgaattggatgctagctccatgcacaaatatcaaataaatctcctcctccgaatatccttttgcatgccgaagagagagaagaattaaattctttcttatcatcatggaataataaaaactataaatattagctgaaattaagatgaagcaacaccacaacctagctcaacaccctcaaagttataattagaaatggcataccaaaactacaataggaacaacaacaaagggtggcgattcccctctgacgagtaccaagtgtacgaccccccagtggaggctacatatcatagtcctaggcatcatcatcacaagaagggtcatatggcattcagaaccaactatgagcaggactctatggccgaagtagaatccaacgttgaggctcgtgaacaaggttacgaaagtaccaggttatggaatcatagtgcttacaaaagtgtggaccaagaagctgaggcatttattcagtctgagcatacgaggatggaattagccaggctcatgtcaacaaggggtgcctgatgagcctctgttgtatataaatagctatttctattattatatcataggggcattatgtgcattgttacatattgtgtatggttaatttggggtacccttaaaatggttaaaagattttggggtgagacttttataataaagttttacgaataattcatccctcaatttttgtagctccccttttaaaatggcatcaaattgactcgtagccatattacccacatctcatatcataaatcataaataatctacaactgaagtactactactcaggggttttactgtttttttctttttatttcacctaaataaatgcaccaaggcctcacactcatatggcgtgttgtatttgtttcagtcctctcctttcaattttcttatagtgataatgggttgttgctatagatttccccctatttcagtacatgttatgtagaaagaatgcaaaacaagcaatgatacgttatataaaattgtgttctaaataaattccaagtacaattggttctaaataattaattaggacctgtttgaaaatttcagctcaacagaatgtatatatgttcagtgtttagattttaattagtttatcatgtttggtatcattagaccgaaatacgccaatcttcagttttttttttttaccagtcttcagatttcgaaatatattttaaggaaacagtgttctctaacatattcatacgtgttgtttatgatatgttatttttctcgtagatccctaaccatgcaatatgttatgatgccatctgcatcagttatagtaattgcacaatatatattaaaatctgaacttgctggcaagagtaatttttcaacccaagaacaaaggaagggagaagaggagttttggaaaagtgaattgtttttagataaagatgttctatgtgaggcatattatcgcattacatcaagccccacaaggcccaaattaatatatgggagtcccgtacttttactggccactttaaaattcttaaaaacaaattgaaacataaacaaataaataaataatgtataactagataatgtaagactcttgcctttggaatacggaatacccactgaattacaacacttgcttggataaatagttgaattaaatatttagtacttttctttgtggactatattgtactttcttttattgcttaaaatcgttcaaggaaaggaaagcaaagtgttattgcgaactttctgcgtcatcattctatttaaaaaatccatcttttaatatgttcaaagatggagtatcattgaagaaaagaaaatttttattcaaggaatatggctggcttgtaatcgaacataaagttatagtatttgaacttattgataataatggtagaaatgataaataaataaatgaatcatttgtcacagcccacagcaaccatgggagttgggaaatgaatctagaaatttccccggacataaacatgatgtgttgttgatggcttaaatgtatccacacgaaaagaatagaaaagtccatataacctaagcacaagattttgtattggatatttccgggaaaaaaaaaagaagaaagattttgtaatagacaagttaacaatttacgattagttaattgtgtaaaaaaaatctgttttttttaaataaatccttcgtttatcttaattgtttttgtcttcttctgtttattgaataatttatccaaactttatcttacaagattaataaaacaatatatgtcaaaataatcatctcgaaaacataaacaacggtggcgatgtatgtataagaatttggtggtgtccccctaattatgaacgagcaaattagaaaaatcaattcctttggacttgtaatatcccttttccgcgttagtcaacctaccctggaacatcctccactccatgccacacctctccttcacctgccaccaataccacatatttaagaatcaaagcccattaagaaaaacaaaacattattacactgcttcttgatcaatgtaggtaacagtttctaatgtgagaaaaaaaaagaagcaaaaagctatgtggtcaagaaagaggatcctaaacaactactaaaagaataatattagcaacacattctttacaactcaaatttattagaaattaggtataattttgtaggttgtcccatccttcatttaatgggtcttttgattttgtagattttaataaattttaatcaataataaaaaatacgttaaaaaggatgtgctaatgatcttcattatatgaaagatacataacttaccgctcgccatgccggtttttcagttgtttgtgcttctccctaccaaccacacaggataacaaaaacaaataaatattatatatacagttgcatttgagtgaaataattagaattaaattaaacataataggaataatgataatggaaaaataattacctgattccctagtgagggaataccttggtgcacaatccactgagcatcaacaactccaatcttctcatgggcaggctataacataggaagtatcagtttaatattccatatagcatatcagttccataggaagtaatatcaggtaataggcttacctcaacacattttctaaaggcaaaatcaagaccccatccatggacaaattcattctgcaatgagcagtgtgttacaatcataacttattttggaaaccatcaacaattaagtatgagcaattggttactagacacaaccaaatcaaaatctcaaaacacgttaaaataacaatctaaaattatttcaatgtcatgctgatatttttatgaggtatgaagtgctcatacaagaattgttctcaataactaatgagatatttgaaaaaaaatcaatagagtaaccattgaacctgaatcatatgccacacacagcgccatgcatttcgtgaaaacactggagccataatctcaacaaacctgcatgttacagaatggtggaatcagctaattaaagatgggaaaatattgtaacccccctcccaaaaaaaaaataaaataaaaaattctttaacagttacttacgctgcacaaggaggcagaagagggtacttacactttcctggttcctttgcttctctagtcgaaatcaaagaaatacccagtcaacacactcacattaaaacacagcacaagaaaagtagttctcttacttgtgaatttcactatgctctcttctccttgtcatattccaacacaccgctttggtacttttactaggttccaaggcaggttgtgatatctccaagccatgctttctcaccagttttaggtatctgcgattggaattagtggggaagtgaaacttccttaacaagcaaaaattaaagaaaatacacatacatcatatatctaagactcactcttcagcattgaaattctcaacccccaggtcttcatcccacatgaaaatatagtcatatggtgccacaatgtctggatgtagaaacctcttggcataccacctaagaggaaaaagaaataacaaaccatttaaagtttggtaaacaatattaactgaaaatatgccatcatgaaaatttaagcatagaatttttaccatttggtttgtttgtgaacactgacatgaatggcctgttttgaccactcaaattcatcccattccgttgttcggccatcataatgaaagaggaggattgtgaagtcctttgaaaactgttcaagtggcatatctagtttaaacacgcgtccaaaaacctatgcagagaaagataggaagagaaagggagagaacctttttcacagctgcatcgatattctttttctgctcatacccaacagtgaaagtcacaagatactttggcttaaaggttaaatcctgcaagtggaaattttatcaaactctctgtatatggagaacctcacacaacaaaaatatcggaggcactcctagtccaagtaaataaagaacagaataaagaaaaaacagaaaataatgctagaaagaaaaatatcacatgtgtcaagctaaattttttgttacttttaataagagtttaatgtctatgcactgacattgtcatttaatcataaattatagtttgaattacttaaataattaatttaaaagtcaatatacttacaatatatggtggattgcgattggatgattgtatagaactttttacattttcagtgcatgatcctttttctctttaaataaccttagcataatgtttaacagcacattaatctgtgtttagctgcatttttcttattacattcgaagggtgtagctacattgagcacataaataaactctcgtagtagacttcacctcactgggaagaccccataatctgcgcaaaaataagtctgattctgcattgactatcccaggaggtaatctttctgcacctcttggatttgttggaacccaaatctgcagacaatcatgaaaacaagtagcaaatgtcttatcatcatatatacagaccttaacatgtcatattttcaaatattacataatgtgaaatcatggttaaatcctttgacaattatgttttataattgattaacaaataagaagaggatggagaggaaaagaagaggcaagaggctttatggatctcacgctgctatatttaattttccttttcactcttgtcagataaccacataaaattctaataatatcttgttttcttccatatatattctgacaatcatttgatttgatcaattattaaccaacgctgtttctgttcacaaggcattctgctttcaataacagtgtttaatgatcatacttaagctctaaatgggagtaaacatctctaatctctaattccttccaaattaaagtcaatcacttttgaagcatgatgctcaattataagctgctgaacctttcttgactttatgggttttactccaactatataattgaataaaatatgtttttcccctaactttcttgaatcactgtacaccctacaattttcaagtccttctcatggatgacaagaagagatgcatacctttgttgcatcacttggaaactgatcttgggatgcggtgctgctatctatatatttttcctgtacacaagagagatgaagcaggccgtatggtagattcagctgcaaattgttaagcaccattagagttccattataaagttaaataacatcaactacatgaataaatatgaaatatgctctcaagcataaggtacaccaggaataagatgttcaatctctgcacctttgttattgagagtggtggaagtgataatcctacaattaagccaaaaaatcctccaacaaaaagtaacacaatatgcctcatactttcattcggtttcctaatagtaagattgcaggcaacaaaatgcaaaattatgttagtttaagggatttgtggacttaaattatagcatatacaaaatttcttaagaacaaacataataatcaacacgaagtatctatcgccaaatattatacctgcgagtagctttcaccattatatccaagcttttctgattgtttcctccatataagaaactgagatgctaattaaatgaatagagccctgtttaaagtcgaaagaagaaagctaaatggtttaataaatggaaccagattaccattcagaagaacaaaaggaaaacacacacatacatgctatgagagaaagagatcatactttggaaaataacaccccaaatatttatatagtgggattaacaaatgaaattagttatgcttccacaatgaaggtgttcgttccacttccacaatccaagtggaaaagtaaaatatcatcacgagatagttttttccaacatataaagtgacaattgggaaagtctgaacacctataaagcacgccttataagtgtgacccaagaaataacacaaggttgaaactgctgaaccgttactaagtaacgcatgtgctttccgcccaaataacctccgcaagtaacttaagcggtttctttgacaaaaggatatatatctacagcttagagcttagcaattaaaaaactaagtgcactttctttctaataagaaatatacttaaaccttgctgtaaagtggcagaactaagaccctgagtcagtgggtgtaatttatttaaaaaataaaaatttataattatcattatattatagaataattagattcagatacaaatataagaggtacaaaatataatattttaagataaatattaatatttattaaaataagagggtacatttacttatttttatatgtgaacttggtaaagagattcaaatacataaaattaagggatacaaaatataaaattactaaatataaaatataatattttaggacaaatactaatgatttcattgaaatgagaggtgcatctacccatcctcatggccatatagatcccttggtgttgatggatcctctcccttgaggtatcaactcacaattttttcaagacgatatttattattattaagtgaaatttacaatagccttcctaaataactactaaatttgtgagttctatatgaatttcatccaatatgaaaaatgtattaaaaaggttgtattacagttatatataagatatagatagagattgtattacatttttatcgggtaaaaatgtttagtgacatcaggaactacattaaaaaaaaagtaccatcaggaattccacgaacaaattcaactggttaatcatttttttcaacccgatttctagtctttttcaactttacaaaaggtaacattgtattcgtacaacttcggatggcgattgctactgtttatctactaatcatctaatttattcatgtataaattcaaccaatccattaaatcataagaataaaacttaacgacttgaataaattatgtcaacattaccagattgttaataaaacttaactaatcatccatcatattttttaaaatatattcatatacatacatatattaattacgtcaacccttatatattaattttgagtacaattgttgatggagaggactttttttttttttttctttttcacaatgggcttctcttacatatactattgtatacagtattttttgataatccactaaaatatgagacagcagaaacacgaaagccacatttgagggtatatgctgtttcttattttcatgtctagcttatgacgtgtatagtttttttttttattttaataatcgacgtgtatagtttttcttatagaagttccgttgtgacgatatctacgttatttccaagtgcttgtttgagaaatctttcaaggaaagcagggtgtggttacattgcaaaggcagctaaaatgtgcgccaactcgtgattgagaaatctgcctccttaatattggcaaacttggaggaccattgaagcaaagaaaagtaccattcaaggaacctcgttgacttgtcacctaccataatgtaacaagttagttgaattgagaaataaatattaactaataatgattcaaaaaggcacacaccaggaaatcacaccacacccaaaagaataatccatggccacaacaatcacaagaaaaggtagaatactattttctgttcaaattccacacgaaatagtggaaaagcacttggcgactcatttgagaataaaacagagaaaaaaaatggaatagaaatatcaatttttaattatttatttgagaaaaaaatgaaaaagaagatttacttgttcactctggtatatgagaaaacttctaggttgtcatcaaaagttggcaatagaattttacagttttatctaattataaattattatttatgataagctttttaacttttacatttaccttaagaatcatatttatcataatttttttttattaattgacaatatcaaaacttttatgctttgttatacataataattagactcaattatttacattaccttttttattttggcttttaataaataattttttattgcaaaataataattctatgtttagaaaagaattataaaataaaaaatttaatttttttaattaatataatttgtatacaatttatttattttcactaatctaaataagaaaaagaaaaatttccactttttcatttatttctatccatttaaataacacatcttttctattaattttttttatcttttcattttaattttttccattctgttttacttctaatttgataatatattttttcaacttgatttgttagaggtttaacgaagatgtgaagccgttccaataggtatatggcttccttgtcacatccaaattgtttatacctggcattgcattcatatttcctgcaaggtcctcaaagaatattataatcaaatacactacttacacagtaagttttatttacctatatattatctaattctctatcagcactggaatcccacattgaactgttgttttgtccttagctaggactctcaattataagtgcaagtaactagtgccacaaacttaagtaacaaaaataaaataaaattatacatcatgcaaaatcgaactatggtgatggctgtgtacaagtcaacttccgtcgttgtccccactaaggagtagtcgagttaaacatatcaactcccacggccttgtaatatgcgtcttctgcatttgccaaccgactctggaacattgtccactcccttttacacctctccctcacctgccaccaacaccatgcatggttcatcaacagacatgcatatttagtagtcaaagtatttgcataaactaacagctccatccattgtaatacagcttctcgataaattaaatcaagagttataatgttaaacaactatgcaagaaaaatgttatatataggcctattcatggttcggtacagcatagaaaacttgtatatatgaatttttgagagacgaatcaaactgtatgaaacatgcataacattaacataccccttgccatggcgctttcccagattgtgattctccctacaaagtaaagaaaaacatcatatcttacatcggcaatatgagtaaaactatttaaatctaacattaataatcatggaaaacaaattacctgattccctagtgagggaacactttgatgaataatccactgagaatcaacaactccaattttctcatgggcaggctacatgatagtgagagatattagtttaatgttctatagcatagcaattgcaattaaaaaattgaaattagatgaatttaagtaatgagaccacaaactcacctcaacacattttctaagagcaaaatcaaggccccagccatggaccaaatcattctgaaatgcccagaatggtacaatcataattaattgttagactctaacgagtgcataaacagacattaaacaactaaccaatggatatttaaaaaagaataaagagtaaacatttaacctgaatcatatgccacacacaacgccaagcatctcgtgaaaacactggagccataatctcaacaaatctgcatgcataacataattcgatacagtttggtatgggttgataagacaaaaataatgcttcaactgatacttacgctgcacaaggaggcagatgggggtcactgcaccatcctggtttctcctctgtttctctaatagaaatcacaaaaataaacagttagtacacattctttaacaaaataagtgccagaagaaaactaacactggattattgtcttacttgtgaacttcacgatcacctcttctctttgtcatttgccatgtcaatcctttattaggttccaaaccaggctgtgaaatctccaacccatgcttcttcaccagttttaagtatctgtgattgaaattagagcatatcaaacttcatgagtaaaattaaaaaaaaaatccttacgtatataaatatacattttatttatttattttgatccactatcaattatggaagtttctaacactatcatctaatcacatcttgtattaccacattggacaagttagatgatgacaaactaacttaaaagtcaaaatcttgtaatgaggaattatcaaataattggatgatagtgtaaaactttacatggatatcaaaattaaactgtgtattgtatcataataaatactcactcttctgcattaaaatgttcaacacccaggtcttcatcccatataaaaatatagtcatatggtgccagaatgtcaggatgcagaaaccgcttggcataccacctaggagggaaaacaattaaatgcttaatatcataacatagatgaattagcagaacacttttgattttagttaggcaaacaataataatggtaaaagttgcaaggaaaatttgtcatccaagatcgagcgcaatggattcttaccatttggtctgtttgcggacactcacatgaattgcccgctttgaccactcaaactcatcccattcagttgtttggccatcataatgaaatagaactattgtaaagttctctgagaactgttacaagtaatggagctagtttaaagacccatgcagtcatacacaagcttatgcatcagaaagaaaaagaaactaagagatgacctttttcacatttgcatcaatgttatatctctgattataaccaacagtgaaagtcacaaggtactttggctttgatgttaaatcctgcaagcagcaacttaatcaaatactctgtatatagatgatataccacaataaaaacatcagaggcctctccagtccaaaaatttacagattggcctaataacacaaacagaaaaaaaaatcaagctagaagaaaaaatgcacgtggcaagcaacataagttttctatgtcactatcctttcccaaattatatcaatcttggatttggggtgttatatttagtttatttcatcgaaacaaagaatctgatgaaagcatgtaagtcttctttaacaagtttattaacaacattagcaggaccataatttgtatttagatgtatttttctatgcatgcaaaaagaacatgttttctatgtttcaacccccagatgctcccaaaaatagaatgaaaaaaaaaaagaaataacaaaattgttttaggatacacacctcactgggctgaccccacaatctacgcaaatataagtctgtctcagcttcaataatctcaggaggtaatctttctgcacctcttggatttgatggaacccatatctgcaatgcagagaatcaagaaaataggcagcaattgttattgagcctttaacaaaccattttcccaatattaaataaacaaaatcatactcaaaagctgttaacaaaagaagcatgagtctttctgattctgattgttgctatgtgcttgatcttattttatttttccaattttttaacatcaccctagcagtaatttcttactctcttccttacatttgagtcaatattttatcaattaataaaagcaccctgtttctgttcataaggaattttggtttctacatttcaacttctctagattgttgatggtgaaatagtttgtgtgtgtaaaaacaagagagagagacagagagctttacaatttatgaatttaataaaattactcaatgcttgatgataaatttaggctcagaactgttgcatgactgaaactgaaaggaagatctaggtaaaagaaagccagccaattttactctagtttgttactacagcagtatttcctttggaaaaaataaataaataaaagggaagcagaagactaacaacagaaatgaataactccagcacctcatttcctcaaaaactcaagtttccatctacttaatcttaagggcctatccactacaacccattaaagcatggttcttaaaaccttaaaattgtaaactaacatcaattgataaaatatacttcattcatctggcccacttactcatcccactttctttaccatccttcattcaacaaataatgtgcatgaatctttgatgagattatgaaacctcttccaactatattattccattaaatctttttccttctcaatgaaagaagttatacagaaattaacttgaatccagcaactttaatatcgttcacaaggctgacatgagatgtgtaccttcaatgtatcatttattaattgatgctttgatgagatgctgttattattcttcacaaaagacggtgcattgacacctgcatatttctcttgaaggtaagaaatatcaatggcgggaagcaggccggatgggagattcaactgcaaattgttaaagcaccattagagttccattattaagtccaacaacattttatcaccaattgccaaggcacaaggtatgcctaacaagaagatgctaaaagtcagcacctttgtagtcaatgatggaaatgatactcctataaagaagccaaaaactattccaacaaaagttgtcacaataagcctcatactatcacttggttttctattggtagaactgcagccaacaagatgcaaatgtcaatcgatcagactttctgatgttaaatagcagataaaatttttcttaataaaaaaacagcataaacaaagttagccatctctgaagaatagaccttcgagaactgatccccattatatccaaggttttccaattgtatgctcataaaacgatacacaagggttgttcttcttcgctagtcagccagtggcatgtaccctccttataagaagcaaagatacttgttataagaaaacagtccctgtacaaagtacaaagaacaactaaacatgttaataatggaacaagaaaatggttcaaaaaaaaaaaaaaaagaggaggaaaatacaccattgtatgagataaaaaatattttgtaataaatgtgtttagaatcagatttgaataaaatctgaattattattagataggctattcattgcttcctgatttgtttcctcatcacagcagatttctattcctctttgtgtatatatgagtagctgtattattcaaacatcagagaaataaaaatattgttgggccagagcctatcctagatctattgttgggccacttgcatttgctatgctccaggccggtatccctgaacatgaggaggagtgttgaaaaactgccttaattgcagtcatctctggcccaccttagttgtggcctctttggggctgccttaaatgcaaacttattttacccctgttggctatgcttccctacaactggggtgtgttctcttccaaccacgagctgttttcaagccatatttagtattcaaggtttttgaattttgaatctctagaattcttgaagtatgaagagcttcccaatgttgtttctaattaatttggagagcttatgccttgaagtgtataattgtttgtcaagaaatttctgcagcacctctttccatcagtttcccttcctccttggccatgcaacattctgaccagctcttcagactgccaagtgtcaacaacccccagtcatcatgttttgttgtttctcttcagacctgtcaagtgtttgctatgatgtctttcctgcctctcttcagtactattcatgatagagaaaacattaaatttttatgattgtcttttggtgtgcttatttgtaacagacgaagatcttagtgagcatcaacttgaagggaagcgttagaaatcaaaactattactgttttagtcttactacattagtactacgtgacctacattaattgtgcagggatttgttaagtttagaaccgtaagtaaggagttatgttccttaatgagaaaatagattcaaacagcttcataatttgttataaatcatgtggatgcattttgtcacaatctaaacacgtcagtggcatcaatttttccttttctcatataacccagaatttcaacagttagtcaacttgaatctcctattatagaggcattttcattcacacaccccaaattgttggaaaaataaaataaacaataagcaagaaaaacacacacgtgcttttctcctaataatcaccgcaagcgacgtataagcaaccagggaggggatatccccaaaatgctccactattaagaaaacatgtgacattttcatgaaatacggagaacaccaaacgaaaattaaattaatgcaaatggcagggtaatatataaaactgaattctaaaaaccgtaaaagataacagaagaggggagaaagagaagcgcgcacctggaacgactggaagcaagatctggcgaagagagtggattttgagaagaaaaagtgaaaaacaacactcggggaagttgctggtggtagtgatctgagttcttggaggagaggaacaaaggtgaaaaagaagagatttagcagcaggcacaaaattgtcctatggaatcttctctcttaggtttgggtttgtagccaaaatacggatttgttttgcttttggtacttttggttttgatgcaacttccttctgggaaaaaatagtgataaaaaatatataaacggacacgaaaatttgaatttgtgaatactactgttgcagtaatttgttattggatttcgcctgcttctgttgcacgataagatctgttcggataattgtcggacccttttcaactgcagtgcagggtatgcagtcttcatctaacggaccaaaatttttcaagttatattttgtttttatatttaatgtataatttaatttttatggccagaatttgaagcagtcacaaaaatgtgattgcagagaattcccatcgataattgtcagtgcgggaattgaagcggaataatgttaggtgactctttccaactgattttctttaatgtgtcttttaccggttttacggctacttgaaaattcatattacacagttttctcctcattcatgaaaaaaaaaagttgacttattgctttattagtaactaggtgtgggttaacaatcagaataagaaaaaaaaaaagtaaaagaaagaaaaataggttagcactgtcagcaccaacacatgccaaggtgttggatagttttaatatatatgtagattagtagtaaaaataataaattagaaatgcaaaaaatgcatctaactttttttaaaaaaatatcttaaaagttaatttaattaatgatatatttgtaacaaataataataatgatcgtcaaataataataataatttacaaagtcaaacatctcattatacttgatgtaaattaaggaatgtgagtattgaataaataattaagaaaactaactttttctttgactggataactaattaaaattattaatttgatttgatgcaaaaattcaaataaattaagaaagataactgcatgactacaaaagaaagaaattaaatataaaagttatttcattttcataaacagtgaccagatgaataagactattttaactattcattaaacgaaaagtataatggtataattatttaaataacacagtgattaaataataatgtcaataataataaaaaaaaaaaaaactttatagtcctgtgacaaagaatagaaactaatttaagaactatatatcagtacatgtaaattaaagaaatattaaaactggtctgttcaaaaggggttatgggcctaatgcggatcagcctaaagtggatcaaatacaaattgtaacctatgataataggtaggccttatcctccggcacccgaaaaacttatcctacactcccttctcactaaaaatttaggtatcacttctaaaatacccctcattgtttatttttgatggcttgttgcgtaattattttttaataaattacaaaatagacttttctagaagtttgatattttagttatagaataagtgttattaaagaattacacctatctgtatggtattttagaatacttatattgatatcccaaaagtacgatactttggttatggaataggtgttatggatgaataataactatcctaaggtgtttaggaatatatacttttaattacttttgaatgtattacgaaatagacatttcaaaagtataatattttagttacgaaatagatatctagaagaacgataccattcataatatgaaagtataagatacacttaaaatttgcggcatgaaaatatttaatttttacacatactttaatgaaatcatttgatttttaattatattgattgaaacacacggcggcaaaactcctcaattaattttaagatttatgaaaccgtaagagagaaaatgagcacagaatttttaaagttcttcgcatgtgtgaaaacacgtctagtaactgtatggtgttttttaactatgattatgttaaaataattaacaaatgttaattctaaattgataaaaaaaaaatctaaatttaaactataaagtactaatttaatttttttaaaagataagaaatcaaattaagataaaagactaaatatataatttagcctaaattgtataaaaatgctatcagaactttaaaaattgtgtaagaggttgcatttgtccttacatattttataccattttttgctccaaatcaagagtaaaggtgaaattgttccctaaatttataacccactatattctagtcccaaaatttaaaaagttaaaaagaagtccccaaaaattgatgaactcactcaaattggtcactacctccactttgttacttaacaccgtccaacgacattgcgccatggctcatggatcctcctcacccccaaatgcgaaaggcttgaaactaggagggaggatagagacaaaagaatttaaagttggatgcgaatccacattaaccatcgacgtgttttttctttttcttttgttaatgcacgaagagaaaataattaaaagttgaaaaggaagatttttctcttctttattttttccgtccctgaaatccacgagggaggtatctaacatactccactttggagattatttttttagtagggagtctgattaatctgaagtggtaagtaaaatttaattaataattatctcaattaagaatcaaatttaaatattatttgaatgagttaggaactaatttgagcaattaacatcaatataaggaactttttttttaatttcgttaaatataaagactaaaatgaaagttgattatgtcatttacccccaaataaacttacacattttcttttgtcttttttaatctatccaaaagtgcttacggtatatggaagatgtgaaggttcaagtattattgactttacccgatataataggtttaacataaaactggcaaaaaattaatcctgcggttatatcccttaatgaaagatatgaaggtggatgcattctttaatttatccgatataataagtgaagcagaaatttggcaaaaatttctcacacacatgttgtgtgccacagtgcgattacgtaccgattaaacgtaagacgtctatatcctacattcctactcatgataacgtgtttgggttagtttcactatcctcacaaatcttttatgaatagcctactcattatgtgtgtagattagtttcatgattgatgtatattgacaaagaatatggtgtcgaaggatcaacattacagatatatctgaaaaatgttaataatatattattgttagatgaactttataacaattttattaaatacttttgcatcattttttattataaattaatacgactaataagaaaaataaatattaacgggtttttttaggaatgttaataaaaaattaaaaataaggtgtttagtaaaaatgaaagtttgtcatataaaaaattataattcgttatttatatttgatacttattttttgaaataatacatgcatattatgctaacatttacacaaaatccgtaaagtatttatctggtaataactaataattaatattattttcatgtatttgaaactagagacgtgttaggacttaggaagtacaagtggtcaatccctcccacttttctcaattgcttcatgttaagtggttataaaaatacaaggacaacttgtgtaacctagctattttacaatatccatttaaacgttttgtttagagagaaacacacatatgtacactttattaaaacaacctttttactgtcaataaattaagataaaccttgggtagcattcacctatttatagttacgtcatctatatggtgcaaattcaactgattatttatttatacttggtgtgaatttgttcgggcgaattattttaatttaatcaattttgagtttgaattttatatatataattacattaaatacttacagaaaaaatataatatgctattgaaactttgatattaattctatatgattcaaataggaatattacctgtagctgcatatataatttgtgttaaatatttaaagagagtttatcattctatgatgatgattttctcatataaaaattgtttattagttttcttataaaataaatataattttattaataataatcttagaaagaattctaattcaattaattaaacagaattcattaattattataatttttttataaaatctttaattcctacttataaaaaaaactctcacatacacaagatgtatataccattttgagttagaaagagaagatgtgggtaactaacaagcagcaacaaaaccggctgcactatttgcatgagctctctaagtgcgtgttttcttcacaatgcaacaaatctccctaattttgcatttctaaatttgtgagacccctatgtttcttgaactaaccaaaaggaaaataaaaccagtaatcctcataaaataaaataacctgcaacttattcaattaagctagtagcctttaagcatgtatctcaacaattcattattttttccttcaggaagctttgtgtatgattgagattcctatagccatgattttaaaaatcgatcagatgaaattaaaatactatgtcactaaactaacgatcgaactaataagtttctaattgatccacattatttgtcaatatttaaaaaataaaaagtttatacatctcttaccataaaatccaaaaaaattactactcataaataaaattacaatatcaagtatctaaaacagttaacataaataattgcttaaacacatcatatttaacaaataatatgaaaaccaaatcaacaatcacattacaacaacaaaatcaaatgtacaaccaaaaaggaaacataaaatgaagaaatcatgactgacaacaaattaataagaaaacatcataattcataagctttaaggtggtgggaggaaatgttgttgacgccaaagattaatcttttaaagttttcgaaggagtgagacacttaaatgcaagcatgccttttctttctttattattttagtcattaatgataaaatgacgtttgaagtaatttttttcttcaaaaaaacgctacatgaccccaacctgggtcaatgattcagccccatcaggatcaggacactggttcaaccttgcttagttagcaggttacactaggttgcacctaattgactacataactattcttctatctaatccgactcgaccaaattatcaattcacgatcaaaccaatcaatatggattttaaaattatggccataggagtattgataacttttgctcgccctcctaatccctagctcaccaacttgctatttgatagtttcactaattaatgtttgtgcattagttagaaaattaaaaagagaaagtatttattatgaacaatataggaaaatgtaaaaaaaaattatagatatataacataattttatgtatcccaataatttttttccttctaattctttaaccaatgatgttaagacattcattaaaatttatcttatttaattaatgataacctattttatagcttctgtacaaagcttaaacgtgtgtcaatttaatttgcacaataataatcccattgccggaattgatcataaccaacgaagtcaattaataacattagatgataattaaacctttttttaaagcatgtgataattaagctttaaaaatattaggtaaaataaattatatgataaagatagatacttggacaccaagatattttgttatataaataaaaaagataaataatgtgacatagaatatgaaaggtgaaaaaagaatgtttcattttaggaaaaagaacgtgacgaagagaataaaataattacttaaatctatatttggtttaaagttataaaaagtagtttacaaattttaatattaaactgtatattttaatgaaagaaaaaaattattacatatggaacaaaaatatttttcaattctcccaattttaatccaaacaaaaatgcactaaattggtaaaaaaaattcattccaagttaatcctcaacatattcacaaattacacgcacctaccacatttcttacatgattaaatgttttttttttaatattatgtatatatttaataaaacaactgaagattgatgacctagacaaaaaaacttcctttgtctcttcctataaatagtttctcattattatcacttttgatttccaagctgagacatgacttctgtactacacccactcgtgttgctcctgttgcttggagtggtggttctcactactccagtgctagccaatttcaagccatcattttttgagtttgccccagaccatgatcttgagaaaccactcaccaccactaagttcatgccttcatcaagagcccccccaaaatccaccactgaattcatgccttcatccagagcacccccaaaaatcaccactgaattcatgccatcatccaaagcacccccaaaatcaaccactgaaatcatgtcttcattcaaagcagtaccccccaaatccactactgaattcatttcatcatccaaagcacccccaaaatcaaccactgaaatcatgtcttcattcaaagcagtaccccccaaatccactactggattcatttcatcatcaagagcaccccacagtccgtaatgattcacatatgagcacttacgaatactaccacaaccatttcataatatataagccccaaccacccttcatatgagaagctaccggtttaagatggaaagtacaatttgtcctttgcctgcaatagttcttcaaaataaaagctctatatatgcctctctggaataactttaatttccctttcagcaactatatattgtaatgtcaattatatattaataatggctttatctatgcatgactacgatatgtttatttttctttgtgcttaaatcttctcgctttatacgttaaaataataaaaattaaacatatataattttatctgtacttgtttaaattaatctaacagtgacatatgtgcatattcttcacatgcatggcacattcaactaaggttttaaattgcattcattcgtgcacggtcgcataccgttttttcaaatcttgggggtgcaactttacaaaatcaaattaagactgattagcatacatataagttcggccttaagggccctccatgtataaaaaaaaagcatatataagttcccacccaagaatatcttgcttaattttgatccgaggcaaaattttcaaacatgctgtcggaagcatcttcctgcatgtgtaagagaatttgtgtgcaaaaaggttatttgatccaatttgattcagatatataatttgaaaaattagtagtctaatttatatgtaagttcaagtagtcctgcctactggaaatctttttgtccaagatgtctctgaaaaagaacccaaactttcacatttaacattttaaaaataatagggtattgagtttttaaaagaaaagaatttgtccaaaagtatattgtattttatcgcaatgcttttcatttgaatttttttggtgacggttggtggagaggtatactgtactttcacataacgtcttgaagttttatgttaaatgtagagtccatattatttgtatgatttgaattgtttgatcttagcttgttgatggcaattcccattgtgttttagcactcctagaatgacttaattaagaatagacataatatcttaaaatttagactgcttcataaagattagatacaatatctttaaattattctctcaatgtatttttaaataatttatttttgaaacaatagatatatgaaagtgccaataaagtaacatttttgctctctattttaacatgaaaaaaccctcaaaatgtataagaaaaaaatgacagataaaattaaaaaaatatttttactaagtaaaagaaaattacatgtatctaaaaaaaagaaaaattacattacaatctctctaaatatacaaaaatagaataattacacagtgtctttcttataaataagagaatacacatatctatataagaaataggccaagagaaacaccagaataactctcttatttttctctcttgggggctacacaatatccttgaaatatgtacacctacttatttttagaaacgtacgcctatgctgtagtaagagacaaggtcgattcgaaaaccgactttgtatggtccaaataaccgaccttgaatgcctatgctgtagtagtgacgtaaataatttttaaaaaaatgtttaataaaataaagtttattatataatttttattaactgtttggtatatacttatattttgaaataataatatcactaaaatttatacaaaatccataaaatttctacttaagaggaaaataatcccacataaaaagtagtaaatactttatctgctaagaatataatttttatgcatttgaaaccagaaacgagttagcaagtacaagtgctcaatcccacccacttatctccattgcttcatgtgtaatggttataaatacaaatgcaacctattttacaatatccatttatataaaaaaaaattttaaaaaaaaaaattctgtatatataactaagaagtttaatctttctcccaccaagtcagtaaattttttaagtaaagtgatatctccggtttttatccatgtccaagtcagaaattgaatccaaattttaatgaaaaaactcaaatatcaaatcacttgtgttaacaacatttggttatataaacgcttttatccaaagagagacacacaaattaaacttaccaacaattacatttttatcgagttgggggattttaatattatgcataaaataaaacaacaaaattaattaattaagattgataaacttgacatgcaagaaaatttggcatgtctctctctataaatagttttccattgttaccatgtcagtaaccgttaagatatcaaagttatttttaacggttggaaccaaaatgaaactaaaagaatttatatggagactaaaacaaattattttttatgtaaggattaaaaagtaaaatttacacaattacaaagaccaaatgaagatatataaatatttgtatatagcttattttaaagtttaaacagaccaaccaatcaacgataacatagtatcacctcgtattgcatagaagaagcgtggcttcaaattggctagcacaggagtggtaattttcaccactccaagcagcagcaacacgagtagggagtgttgtactgaagtcatgcctcagcttgtgctgatgaaaagtgataaacaattggaaattatttataggggaataaagagtaaaatttgtcttgaaagtgagatgaaataaaaaattgatcacatgaaaaatataaatttaatttttaaaaatttaaaaagtgtgacaaattaatcatattattttgtgagacaattttatcattaagttataatgttcaaagactaatttaataataaataatattttttaaaaataatttgacattaaattataaaatttagaaaataatttttatttatttatttataatattaatttattacaaagtatattaaaaaattaaatttatatttttcatctatcaacaatcaatttatctacacattacatttttgtggacggatttagttatttagccatttactcgagagagtagagacgtgtgaagtttttctatccagattatcaatctttagttattttatcataatatatacgtaatactaaaatcctcaagtcatgtaaaaaaatatgcatgcgttagagtagagataaacatattactccatttttaggtgtacgagtgaaaataagagagataaaagagaaaaataaaagagtgagaaaactataaatttgatgaaaaaaaaaggttctagagaaaaatgagatgggacgtacgataaaagtatatgtatgttaattattgtgcaaaactcacgcgttgaagttttctacgcagaaattcaaataatgactgtgtaactgtaaacaggttatctaaaatatctttttaacacaaatatcaaagttgaatttgcatcatatagacaatggaaattaaggtaaatgttgcccaatgtttatcttgattattgacagcaaagaagttgttttaatattaaagtgtgtgtgtgtgtgtgttttctattttttatgtgaatcgaatcgtaaaatgtagaatgatgatgatgaactaataatctagctaaacaaaatggcctatatgaatggatcttgtaaaataggttgcactagttgtccttgtatctgtaaaaatagacaagaagcaaagcaatggagataagcgggagggattgagcatacagttgcacctgcaaacaagtctgtattagatgagcttggtggttaaaaaaaagaggcttaaggaaggatgaagaaagaagaagagaaaagataatgggcttaaatttttttactgatatttttaacaaaaaatataaactaacatttgttttgttgataaaaacaaaatctacaatagataaaaagataactattaattcgcagagaaaatatttattgatttttaagtgggatacttccccacctagctaggtagcaattttatggattttgtgtaaaatttaactataagtattatttaaggaaacatgattagaacaagttttatttttttttatataataaactatatttttaattttttaattaatgctcctataaacctgttaatatttattatcttaatagtcatgttaattctataaaaaatgattccagatgatttaataaagttgtaagtttgatcaatcaataatttattaccaacatttctcaactctctaatcaccctcaacattttttttttcataacacaaatcatttgcagaattttacttggtaaaagagtatttaatcatatcctaaaccatactcctttttacaaatatatataccctaaaaattttagtttggtttaattaatcaagaagattaagtttactgccaagaagataaagtttaggacttaggagcattgatattattttccttaaaaaaaaaatatcaagtttctttcagcaacatgaagtatgagttccaccgccacagcttcaaattatagaggcctaagcttctgtcacttgtattagctttttaaaaaaaagttggtaatagttagcaattaaaggcgtttcttactttggcgtaactcacaagtataatttttggattaccatattattatattatatggaatattcaattacttttattgatgactaatatcgaaaaacataagtgacaagtatataaggtcataaatcataatcgtctggagcttctgttgtggtgaaaagaaattccaaaactaagcaattttgtgtggaatgaaatttatatttaatgtgccacaggcccttgctacgtaggccaaatttggatttataagttttcagggtcaaatttgagcacagtatttccaacgcatcaaagttgatgtatctagatcaattcttatgaaaaagattttactgaatatatcttctttgatgctcttttcatttcagaaggaactaatttttttataatgggctgaaacttcaattctttatttcatacttgctatagcctcaccaaaactttagcatattgccacatttagatgcatgtatgttttgtcggagaaagtgatatgttaactaatctttgaaaatgattggagcaatacgcaatcctcaaaaataaataaataaataaataaataaattggaggatgtatagataggcttgcttgttagcgaaaggtcaagaaactgttattagccaccactattcactggaatctagcagaacacacattaacgataaataagatattaatatgtgaatgggatggtcttttagagcctatcatatgcagcagtagtcggatataaatttaatttgttttttaaaatgtaaaattgatttaaaggaaaaaaaatgtaatatcatcagaatttaatttaaatgtaaataattttatattattattcaatcacatattatcattcagtttgttgatttttatgaaaagatatttaatggtgatttttgattagttaaaggaataacttttttagactttttttttttggtatggagactaacaatgtatgacagattgacagtattactttaattattaattaaaaataatgatattaattgcttgaaattgtcacaattacacatataataaattattaaattgttaaaatgcattttgatattttaatattgtatatgtgaatgaatttattatattttaaattattaattttctgattaacaattattatgcattctatcatctaaagtctaaagaagtccgggctccggggaatccatgtcattttgattgaaatgaatagttgaaatttaaacaactaaataattatatatatatatatatatctattaattttatttaataacgattattctttatttatggtggttgaaagactctttttagtcttctacctaaattttgttgttttaacaaagggaagattgtccgactgaagtttagtttactcaaagaggtcaatctcttttcgtttatttatattggattaaggggattcgcatggtacaaatgctgaagcttcagataagtggtctcttgtaaaaacccaacaagttttcctgtcatataatatgcatacactgtttattatgttattgtttacatggtgacacacagcaaagtcataaaataaactctactaaagaaatttttacgagctatatacagaaccggatacttatatttagcaacaacgaagaaagaactagtaatatctaccactcctgaatttcacaatctttatatactggccaagtgctacaatgtagaattgtatgagaaggaaactatttatcttcaatggaacttcaaactcatgctatacctcttgggcgtggctactcaaatcagacagtacaattgatgaaggaagccagagttccacacgagttcccccagctccaagaggagcatctttaatacgaggtgaaacaatgcggacgacgcagccataactctctagtatctcacgagcaacagtcaacccagcaacaaagttccaagtcatattgtcttcaatcatattatcagacaacagttctcgtccataaggggtgagtgagtgcatctgagtctgcaggcaagttcataaccaacaattagtttccattttcacaaaattcaattccctaggcataaagcactcaatcgaagaattgtttgaatagaagaagcaaggaagtgcttgaaagatgtcatattttatgaatcaagtgctatgtgtaccacaaaggaagtcttcgaatatcaacaatataatggtaattttatggagggctccacatttctatagacttacagacatgtcactatgattatgaatcatgcaaattatacgttgggaaaagctgcactaattccctcacaaaatggcatcaatgcgctgtttgccaagtccaaagcattaaatgttcccaagtttcccatggagatgcttcaaatttgcaaattacatgcataaaacaatttccagcttgtccaaaagaaaaatgagtaagcacagcagggagtgggagtgggctgaagttaccatatagtgcatatcaggtccatcatcatcaataagtacaagggtaccaccggctggtgctgccgtagatacaatttcaacctttcctccaacatgtgtgcgtagtaaagcaccttcaataagattgctgaaagcctggcgcaatgcaggttcttctacagcagctagcaaaggtgatgatgagagttcaattagttctactacacgtttttgaccccgggcaagtggtctcactgaatcaaccaagtctgccaatacttcagaaacattgcatggtcttcctgacattaatgaaaagcataagcaaaataaatgcagaaaaaatttaactgttgaaaggtaaaagaaataaatatctaaaagctaatgaaagaaacaaactatataagatattattgattgttgatgcaacaaaaagtgcaagttaggagtttattattatgggatataacagaatcaagagaatatattatatagaagatatggggataagtcatgacactatgaaaagaagcataagcattaaccaaccaatgaaacctacctgattccatgttgcaatggagcaagggccaaaggtggtagtggcatctctatatcctggacagcagcacttagagaaagtgactcactagatttttccattttatttgcagagacatcacctggattgctatctaacaactgagatcttgatgattcagcaagtatgtgagtagaaccattcattttcttgattgcttcttcattgtagcgcactatatttgtctacatattggacaaaaattgaacatcagaggcactggtttctatcagtgtttgctttccttttttgtttatttcaataacatttaatttttaaacgttttcactttaggaacctgtgttttatgaatttcaaaggggtccttgtttttgttctttatggattgtttaatgaattcttgctttatttagtatatcttttgaacatgagtaactaaatccataactgggagttacttaacgttaatataatttgtatttttcctttttcaattgggtttaaattattgtacttgttgtatgttaggaattggccattattaatgacttgagttaattgataggttgatgacaatgcacagttaattaacagatttataggataaattaggttaaatgtatgtttgattgggattaattttgaggaaatcattgtttttcataagttctcaagctagcaaaaataagcagttatttctccaaaataagttgaatcaaacatgcacttagaattgttgcatgaccaaacctcaattcttgaattccaattggttattattattaaattaacaggtcacttggttcattatgcttttcttgttttgtgccttacatgaccaaacttggtattttgacaagggaaataatataacagttcatgaccacagattgttaataggttagaagaggtgattcacaactgataagagaacacataagtatagagaaattagaatgcaagtgaggccagagccctagccaattttaattctttgggaattaaattcttaattcatgttctttgggaattaaattcttaattcatcttctttgggaattaaattcctaattcatcttcctcttttaattcttttgcagtagtccctttttgatagtttgaatagcaaaaggtttaaaagaatttactaattcaataaacatgaattgaattaatcccttgaatatgatacttaggactcaaatccctttattacttttgtgacaaggcacattgcctataagtgtatttttgcatgcaaaattatatagaggaagagtcaagagacaacaagtgatgaagattcaagatcttccaaccaacgtacattgaaattcaataagtcattaattgattgtaggtatacaaaatgtatttgcatgtatgcatgattataagtacaagagaaagaagtacctttgtcaaataaacagcatcctgtagttgttggaggacatccctcagacgatcaccttgcaccaagaggtcttcaacaatgtcatatgaaatctgtgcaattaccaattataagacatttttgacattcaataactataagttatggataactatagtttagattcaacatcctttgagattgaactctttatttccttttgcagcatgttcactctaattttctggatagatctatatttatttagtaatatttttaccaaacacctatatccttgcatttaaaactatgatagaactcgattcaaggcatcatgaataagatagctactaatcaccaactcactaagttagcacattcagtacacataaagtgcatgctgaaataaagacttttcagaatattaaatccacctaaaaaagtaatttaatgatgctttaaaaaggtgcattgtagagtcagagactagacatgatcatgtgtcagttcagctgggactttgtccaacccagctattgggttcccctattacagaaatgtaagtgcatgtgaattatcaggtacaatttagacaattttcaaacctgagttctctttgtctgtgtagacaggattttacttaaggtttgaatacttgaaagtggaccgcggatctgtataaattaaaaaaaaaaaattagaataggatgaaaatgagagattaaaggaatgcaacaacagtcaataactcatacttgctcaaccagattacccatcctgacattattttgccatgttgattgctgaagtaacattgctttctgtaaaagtagcataaccatgagctagaaatttaggcccatacaaggtgtcaaagctattcttataacagccgtgaaaccatacataaaagttaaagagaaataaattaaaagacttgcattgcaatctaaaaactaacagttactcagtcttactcgagtgatggattaaataattgtgaacttcaatgcaacaacttgcaaagcacacattcaagtaccaaatgttatgaaatgcaaatttcaaggcaactcccacaaagtttgagtagcgtcaaactttctagcatttcatatttgaatagtgatgcgttaatgtaatggtttttcttctctcttttttttcaggggaaaaagatgcagtatataaacctgatccatgacatatgccatagctagagactgtgaaatgttgacagcatttgatctttgctcagaagtgaagttatgcataccaactgcctcattcttgacctgaagattctgaatttcccttgacttcttatctaaatccaaaaagggaggaaatgaataaggttcctcaacagacatgaggttttctggtccatcaatttgagatttctgacactgttcctgctccaccaacggaagctcagcaaccaagaaaccaacaacaaatgggtgtttcaccatcggaagaaccacagccttacattcagggacaacattaacctacaattaacattcaaacctatattaacattcatcctacccaacaagaataatcaagcacggtggaacagaagagaagcacattgtgtgctcaaggtattcaacacacttgcgaattggaaagcgtggcctcagcagcacgcaagcctgcaggaatattaaaatgacccacaagaatgacaatgccttctgcctccgcatctccagggtacagtgcaacccgccgcagctccaaccgatccatcacataactaccagctggtctaacatacacctgaacaaagcaaacaaaatagctccttaaccacatcactcagttcaaatttaagaaagcagacattttagtgcttacttaggaatgtaaatttaatcccaaaattgagtaaaacatcaaattagtttctaaatttgtcaataacagccaactcggtcataaatattacaaaaagaaaaaaaaaaaaaaaagaaatttagtccctgtctctattaacaatctgtcgatcaatttgatccatgaaattggatcaatatccaatttggtccctaacattaccaaattagccaatctagtgcctaacatctgctagttaatttggttaaagccatgagggacccaattgactgactaatctgcacatacacgaagacccaacaaaattggccaaattcaagactaaattgatggcaaggttttataaaacactctgcaaccgcgatttcagccaccacatcgaggcttttgttgtctttgggactgaaattgcaattatatcaactgcattttccctcaaatttctgcaatataaatggattacaacaaaacctaaacggggatggcaacttaaaaccttgattgatggatgatactaatttaaagaagcagattagagtttgtttgacttatatcgaatgaatcatcaattcggtcccccccccccccccccccccggccaccccaaagtattattctctctccacagtaatccctcaagtattgaatatccattagtttgatctatagaaaattgatatattttaataatagtccgggatcaatttgaagagtttttcaatatttgaaagagtacttagcacgatttctaagacttgttatttgttggtagagaggataatacttgagagatgaaattgatggtatatttaagcgacttgaattgaagctaacaaggatgcatgcagatgagataattaaaaaaataggagaaaggaaatgagaatcggaaccgagaggagggtttcgggaatgattctgcgaaggagatgaagctggtggaggcagagtcggtggaagtcggtgctgggaagcaccagtccgctctggcgctggttctcgagctgctgggtgaattggacgggggaggtggaggctttgcgaatggaggcggcgactgcggcggcggaaggaacggtgaggcggagggcgtcatcggaatcggaggtagggttggcgttgatggtttggaggaagcacgaaggggtgtgtgttgagaaaaatgggcggtgggatttggagttgaaggggcagaaagtgtgagtgacacctgagacaagcatttgccttagctacacctaacttacaacaacttacaaaccaatcacaaattctgccaactcttaactaaattttggcgtagcaggacagttcgttccttgcaacaagtgtggagataagtcaattcctctcattctaccattcatctacagggaagtatgttatcccagcacaacaactcttcaatctaaaaaactactattttttttatctcatcctcattttaattcttaaatgtctaaaaatttgctatagttacatttttcttataactcagtttaatgacaatttttgttctttcaataattaaattgtcctgatttttacacatttaagaataaaacaaatatttatcttatatttattgtatattatccaggaatctaattgagtaaatagttatataaatctattgtaatttttttttatatagtcttttgattcttatcaataaaaaaatgtaaaaaataaagaacaaaaggaatttatcgccatcatttattgttttctttaacatcccattataaattatgtattttgttcttttctttcctttttcagactctttgttccaaatttttgttttattttttaaattattgtcttagttttttttatacctaacttaattttaaatgtattttcattcttgttttctgaatggaaagataaaaaaactaattattttttattctttttctctagttaacataaaaataaaaaggacaagcaaatacaaggaagaggaaaatttaaatttcgttctttagtacaaaaagaaaggatcaacaaaataaaagaaaaaggcaaagctgagtgtttacattttttatttttggttattaattacgtatttacataaagaccaaacataaatagagtgaccaaaaggttaattaaattgtctacataaaattataaaatgttacatggttgcgaaaaaatgactcgttaatcagaaacaatcatgaatcgcccaaaatactaattttgaaagaataaaaatcagaataaattttaaaaaaataggagcaatcaaaactcacaagaataaaggaaataaaaaaaaaaaaaattatagtattgattatatttctcttttttgtttcataaggtctatgaattattttctttgcaaggtgtatatgttaaaatcttaatttagcacgttaataagaccctgtttaacacgtaataataataattaacatgctaaatgtcattaaatatacatcaatgataaataaaatttgccaaacataattcgttaaacactaaataagacctgtcagtttaagcacatggatcgaaattcactcttacaagaacatgaatttatgtgtcctaatggattaatcgctgtggatggatgatttaccataacaagtcctttttaaagagttaggtggatctgaaaaggagccattgactatttgttggaagatccatttattagcagcttcggtgcaatggactccgtcccaaataatcctcacacttggatctttgcatgaaattgggtatgatctctgttccattcaccctcttggttgctccacatctctctgtattattgaagttgtattaagaaaagagattcaattaagtatatctatcttatctactccgacttctcaccatgtccaaagcatgctatcaccccctcctcaaaacctttccattcaaaacattgcatgttgagtatttcattacattttccacgtttaaatatgcaacaacaacaaaagaaaatttcataaccctatgcatgtggtattttttgttgcttaccgtatttttgggcatggctaaattaatgagtgtgtacttcaagtatactcataaactatatcaaaatattttattattattattatgtatttattcagggataagagaaaatacaatcttggaataatttagtctatataattcaaaaattataaattgcttttcttctcaatattcaaggaaaaataaaaatatgagaagaaaaatattagtctctttgtttatttttcttcattttcctccacatttttaaatcaaataaggtataaaaaattaaacaattatcctatccctccttcattttcctccaactaggaatgttcatgacgcatttcgttccaccaatctggcctatctttagggaacttttgacaaatttgggtttaagaaattagaccaatgtatttaaagactgattcaagttaataagttgtcctaatttggtccaatgttatacattcttaaaaggcatagttttctatgcattaatattaaaagtttctgacttaataaataatgttttgtttaacatgatattatatacttttttttttatagttgtatactttttaaattctataatttagctattaagactaatatatcatgtcagcaaattgaattagcttcatcttgtcccaaatgttggatcttgatcgagctaggtactgatataaattaacacatatcccaaacctatgaacatccccccccccccccccccccgagaaaacatagagatgataagaaaattttacaaaactttcttgtttagttcaaaattttagagacaatgaaagtaaaccaaaaatcctctatatccattcttgcatttcatctaaatataaaagatatttgaagagaatgaaaaatattaaattttattcgtggtacttactaataataagtttgaaaatttcaattgcttgaacttatgattttatttgtatactattaaaacattaataagctaaattttaaattctcctattttaaaatctaaacaagaagcgctagtcttaaaatctcccgcccctcttgagtctcttccccttcctttgaaccacaggccgtcagaaatcatccagctgaacgacgttaagcttcccatctttgaccaccgttgatgaaaagaaccactaacacctcaacttttcaagtaggtatgaagatgcatatttaaactaaccaatgaaacaatgttacggaaccagtttatggaaaagcaaacacaacactagacgtgactataactattaactttttgtcatagagatggcaaatatcactctttaaaactttttcccaaggttggtgatatcagattcagcagataaacttaaaaactcttaggggttgtttgatccagtaataaaatcataacttagcatgcacttttcatcccattctccaaaccatagtcaaggacctttagggagtaaaaggtactttccaatattaaggatagcacaggataatacataaatactgggatatccattttcaaacaaaaatatgatactaaaactggccaatgttacaagtagaggatagcggctttaagctaccaatcttacggcactaaactggacaataccgtgcagacgcaaaattgaagaaaaatcattttatatcagaaaattcagaacattatcacattaacattaactagtaagtttcaagattctcaataaaaattttgtcctaataaaattacaggctttctgccttcatccagacacccaaaaaattaccagaagggggaaaacaaatttacaatgtttcgagatgcaataacagattaggcaaaagttttagtgccattactcaatgattgttgctccaattgcctggagtaaaatgagcaaaacgattagaaagacaagtaataaaatagtagtattaggttctggtcatcaaaagttgaagataactcttaatccacacaaaactgctgttcaccatctatctcttgacgttgacctgtaggacaacaaatatcaacattctcaaacactttttcccaaaatgtaaaagctatatatgccaaataatacaagagaataaacaaaattgaattcaaaatcaaccagttgccataaataatgtatgaataacacttattactcacctatttaggtctctgctgccagaaaaccatcccctttccctgctaccttgaaactgtcttctgtcatcactaggatgcatccacatatctcctgtaccacgagatcgaggtctgtctgtaaaatccacacttctagaatcctcaaaggagccagatctagaatgtggcctatcagaaaaagtagaagactttcccgccgatgaacctggcctttcaatggctttctgcccaaaacgaactttgtcatccaaatcacggataagaagttccagctccttttctttcagttgtaatattgcacgtgtactggtttgatctccaccagcctcatccgcagattccttgtttgaatttattgtagactctttctcaagttccttctttaaattatcaatttcttcttttaataatttttcctccattgtctcgggcctgaaataactcaggagtcaacaaggtaactagaacttttgaaagacaacaattcacaattaattacacaaaattatgtagcaatgttgtgcataatctggcaagacgaacaaaataaacaaagagatgatagagatttatgaaagcaagtcctgattaatgccaaactattaggagtaaatgatatagaacaatgattaaactattagcaattcacctgttggaaatataaggttcaggtaaggaagaagaaaaagatagaaagataaccaatatactgaaattgatacatatctgccatacaataccacaatccaatacttctatttacactagaaattgtgtctagtactggtacaactactacaagcccaaggcaaataacactgaaacttagtaatcctaggacagctttcaataacagaatgcagccagaaaaacagccagttagcgatagccagcaggttatctcacccaggctgaccaaaagtgacttgcaaacaccagcaaccaccctttggtcacttaaacagtagggcaccagccaaggttgattctgccgtgtttaggacacgaacttaggtcacaacaaggattggagacttaaaaatataatataaaaaatcatagatcagaaaacacaactttgacaagctcagtgaagcaaaaaagacagatccttatcaataaggaagatacagatctaatatcatgttggaattataggttaagaattagaagagaaagaataataataaataaataaaaaaaccattgcccggaggttccacgctatgcacaagtaagggggagggatattgtacgcaaccttacccttgcacatgcaaagaggttgtttccggattcgaagaaaaagaatggggaaaataaattaacaaacagtagtaaccaaccaaaaataagtctgatacactatttataccaataacttgaagaagtactacttgagggtgagtcttgacacagcggtaaagttgtatgttggtgatttgttggtcagggttcgaatttggaaatagcctctttgcatatgcaagggtaagactgcatacaatattcctcttccttaccttcgcatagcgaggaacctctgaacaatgagatacgtagttttttttttaacttgaagaagtactacttctgcaagtacaatctcaactctacaacactagaactaaataaaacaacaatcaagccttttcccactaatcagctacaaggatcaaatgacaacacaattttctataataaatcatgtctctatagacaaaccattaacctctaaatccttcttaatggtttctcgtatagttttctcagtttccttttgtctctagtgattaggatcccctcatctaatctactctcctaatagggtcttctccacacatgcccaaataaacaacctaaagcaagattctcctaaaaagtatgtttatttaaacaagagcaatcgacaatgtgaatccaaagcatgtctcaacatcccaaacttctatttatttcctctcgactcttcaattacgattataacatttgcaaaaagtgttcatcatccaacacatgcccctaatattctaacaccaacagatatttatttctcaactcatttctgttttgaaagaatatcaatggatatatttgcttcattctgtccctaagatatagaaggtggggctaggtatcactcccttggatgacctagtattcactacaaataaaccccagaatttatactagaagccaactataaaaacctttcaatgataatcaaaagtgagaggtatacatataccaacataaaatcccaggcataattttcacatggattccacacatgattgttgtggtgcatctaccatgggcattgtcctcattcaataaattttcaataactaaagaaatgaggcaataattattttacagataccaagtcttttacaggcatgataaaacttgactgggaagtcagaagttctctatggcatccataattcatgtatcatcctaagaaggtttgatttctttcataagatttaactgaaataacaacaaatagctttacaaaccatatagttctgaatttaacagagaaaaatagaaggaagcttcattaacgtagtaatttattacatggatacctatcttatttttcataaccactatatgacactcacaattagctcttgatctaggaatagaatatatattatatagtaaccatttactattaaatcataaaaaataatgatgttcacactcttctcttactcccattaaaatcttactaattagaggagtaaaaaaacgaccaccgtctaattagagtagtaaccatagaacaatacatgaactatataaaacaacacgaccaaaatctctaccaaaagcatttccaactctaaataaaccgttcccaaccatttattgatcagtctaatgaaatgtcattgctttaatccaatcctagtgtacactcttgattaaattttacctacaaatcatgcccatatgatatgcctaatctgtaaatattcccataaatcaaactaattcaacacaccacaacaatccacccttaagcacatttatggtcattgcataatggggacaaaagctcttttggtatgcaactattgaataatgcgagcaaatccggtatgatcagacacaaattcaagttcaaacaaaaagcctagaggccaatctaagaccattaccaatcatccactacaaacaaagcaacatttacaagttcaaaaaacagatcaaagaagaaatataaaagcatcaattgacaaaaacaaacaaaacaaaacctgtcaacagagcgatgctccaattcaagatcaattttcctccaatccatgcctcgctcgcccagcacagcctccctaggcttggcatccccaaaggggttcaccttgggcctcgatttcaccacagcatcggttccctgcaacccgggaccctcagaacgattggactgagcactggaaggcctgctagagtgcgaactcgggggacggctcgtcttcttcgtctcaatctccgaatccatctttttccaatccaaacccttctcagccaacacctgctcccgcggcctcgctgcgccaaacggattcgccttattcgatgccttcgccggggactcgttcaccacaccatcgcctcgcggcggatccaacaccagcctcggtcgctccgtccggtcaacctcacgaggcggaccgcctctcgtccaccgatcaggctccactcccgaatcgcgaaaaccagaaccgaaattggaagatctaacaggaacaggcttcttaccaaccgcccaattgtccacatcatcagccctagacgcaccaccaaaaccgccgccgcctccgccgcctccaccagtaccgccaccaaaaccgccaccaccaccaaaaccgccgccaccaaagcgattctggcgaccggaatcgaaggcagggagagatttcttcacagacgcccaactttcaacctcatcagccctggacggctgatcgagttccgaaaccctaggattcggacccctgcgctcctcgtcgaatccgctgtaggatcttctgcctcctccgccccacgaaccttcgttgttgccgccgtcgcggtcgcgcgagcgaccgccggagcggtcataggagttgaaaccgccgccaaggcggtttaactgcatttcctcggcggaacgctccttgggaccggtgggaagggcgagcatctcgtcgcgcgtaaggccctggtcgaaacctccacggttgaactcggaaagcgtgatggtggttcccttcttcttcttgggcttggagttcacggcctccttgaggctgggaaagctttggggctcgaccgccgtggccgcagcctgggcctcagcctcctcggcctcggcccgctcggaatcggcggcccaggctccgatgttgccccagggtttcgacatttcgagatctcgaaagggaagagaaaatggagtttagttttttgtttttgttttcgcaaatgggtttgaactgagccggggctccgctagtggagccggagctccgagaacatgcaaaggaagaggaagaggaaggggattaggagagcgtccgtgcgtgcgttgatgcgaattgagaatgagaatgggaaggaagggaacattagtgtgtgtttcatttgggagcgtgggcgcgtgggtttgggaattgctcacgcgcggatgaggggttcacggcctcattccaattgggtattcatggccctggagcaatgcgtcgtcgtgttacccaccttctttttagttaatgttttattttaggcaatttttcagtgcaaaaggccatagatatttttagcattttttttaatttaattataaatagagtttcataaattaattttatattataaaatacagtagtagattcgctcgtacgctagaaccctagttgaagcacttgccgtcgcagctatcacactttaatttattttttcgttttgactttctttttctgtgtactttactaccttaccagttatgttttgacctctgtttttttccttcttctgtagcttattgttatttatagagtaaaatttcacaactatttttatgtaaatgaaataaataaaaatttaaaaaataaatactatgttaaaaaaattatttttataaaaatatgtaaataatattactctttttgttgtattcttccatttcaatttttttcgtgcatcatttcaatttactttacatattcgtttacatgaaaaataatactccctctattgtcctaaattatttgatacaggctaaaaataataataaatggataaaaaatttataaaaataatcttataccattattaatttatttataaattttgttattcatcattatttaagtttaaaattggttaattaaaatgacaattatttttggataattttttttctcatatacacaataattataatagatggatgaagtaatagttcttttttcatttaaagttatgcttcttaaatttcgatcttttaaaattcaaatcaatcatcaaaatgatgaaagtattaattcaaactttattaggaaagtaataataaagaccattaaataatatttagtctaaaaaaacatatgtttatttcaaataatagcacacagattaagaaataatcaatatttttatttatattaaaatatttttaacatcataataaatctttcattcactgttgctgtatttaccataaacgtataaaacataaagaaaaatattactagcatttgaggaaagaatcaaaagtagagtttctatttatttatttttacgtaaaaaaaactaagctaagaccaagtggttgcgatcagtggtgttgggataggcatctcgaggtcttgatagatggtgcagatgtatgggcgatgaagtccttgttggtatttctcgaggttatgtggataaacttgctgatttttgttctgcgggtatattcacatttggataatcattattcatgtgttgtataatcagtaatagtgattaacctctgttcgtgggagaatacttttctatagttatgggtgggttgtatttgctgcaaacttataggtgtccatgcctggtacactatattttgcacagcttgtgctttctctatatataattattatacttttgccgattaaaaaaataagtgattatactgatgtgaattaggttgacaccatacaggcctcaatagcaaagcccaaattcatagaaagaacacggcaagataacttggaggacatgaagcctgacccaaggtaaccaaaacaaaaattataatcaaagttgggatatgattccactaggaaaatcatccgttcaagtgtgaaaaatactttgaagtggactagttctaattttttggtcagtcaagttcaatgaaccctcggatcaatttatttaacccactttaaattttttgtctatatttatataaatctaaaaaaaataaatcaaaatatattcgattgaattcgaaattttgtttattgagtctaacttggcctaaattggcctcccataaaggtcgtccgttgttttggtccctctctatgtccatcgtctatttaatgtcaaaactaaatcattattgactacttaattcttgttaatctaattagcgaatgattagcataacacatcataaactatgattttctactttggtggcactcaactaacttattagtacttgtctctaaatatctacatgtttgggattggttgaaaagactttgtcaagtaattgcaatgtaatgcttcacgcgcaaagaaagatttcaacctttttatataaaaaaaaaagatttcaacctttcatcaagaaaggacattcgaatattattgtaaataacaataataatgtcttaagtacacgctatttttttatatcagagtctatgtctaatataagtacacactattctcaattaaatggtacagcgagtttaaatttgaataataatagcattgtcaaagtaattttgctttcttttataagtttgattttaatgcattattagtgtagttcattttttttccttcacaatatcaatcaattggctaatactctatgtttgtttttgaaaggagtgatagaaaatgttaaccatttttgtttttaagaacttaacaattcttgatttcttgaacacgtgtattctatttttcatactacaattgcatttctattatatcattctttcacactaaaaaaattagatccttcttttattaaaaaagttatgtttgtttaacatttttttcacaatgttatgtttctgattgaccatgagtctaggcaatgagtcagttgctggcaaaattcttgttattcttctccgcaagaatttctgctctagctcagtgaatggggatttgtggaagaagctgtggacagttcctacagttcctaagtgcttcaacttggcattgaggacttgccaaaatatactcagtcgtcattgttatgaaccacatgtggctgggccttgaaactgcaacggacctccttttataatctgtccggtatgaatctgattgcaaaagactcgtggatgcttcgaataataaccgttttcatgacaacaactactttgcaggtgtgattcaagactgagctctgttgctgaatagaacaaattttgctttgtaaatagagttgagaataaagcgacagattgtgtagcccaccttacttttatagaacatgatatatctttgattgatgacattcctcaccaattgcccaatgttgttcctgatgatgtacgacctttgagccttccttctgattaaaaatacaccatccttataagaatataagaagaaacaatgtaaattgtataattcaaataaatagttaaaattaaaactaacaatcttaactattcgtatattgtatgatcaatatttatttgatactgtttatattatcatttatttatacgttatatatttagcattggatgtgaaaagaatatatttttttactagaagtacatcatatcattcttattaaaatatcatttgcattacaatcaaaggcaaaatgaaaaatctacggattagctgcataagccgatttcctagctaagttagggccatacacatatgctcctaataaactaaatttgataactagaaaaagttgtaaatgagcaattgcaatcaacaagtatcgagccaaattcagataaatctcttgcttctttttgcagttggtctaccactactttgctatcagtcttgaagataacttgttgctcacccctctcagcacatcatttacttgcatacaagagggcaagtgctttcccttctctaggctgcaaagcaggtttaaaccaagctatcttttttttaaaaaaaaaaaaaaaaagtaaagaaagaaagacgaaggatcaaggacagatgggggttgacatcccaacctttaatctcccaaaaaagatcctcctctaaatatattcattagaagcgaaaatacaaaacacttgggtacccaaggaataacactaagggaatctataaaatgtgagcctttgtctatacctaagaaactcgtgagaaacaaaaaatggtagaggatcccaccaagtatacccaaaagagacagctctatttacacacaagttgtctttatgataaacgtgaataattttgaagttaaaattgtcagtgaactttttacaattcatccatctagtgtaaagtgtccaatggacaatcttcggatgagagaaagcatgaaggtgaagtttagaatccgtttccaaccaaaaccagactgtcttcactgcaacaaaaactctaacttcatcccttaggcagagacccactccagtcttattatcctcttcgaaaatggctgtatctacatagcaattgagaaaaccatgagtatttaattacgggtttatgattacctccgaaatatccaactccctatttccttcctgcactgtcctagctttctgcccatcattcaggacagacatagctccagatattaccattgagcttgtctccatccttccttcccagagcttagtattccaccgacaccaaatactccataaggacattgccaccttatacatatatcttaaccatataattgcatcagaatatcaaaattattttaattttagccatttatttaaattatacatttggatttccattctcacctaatatttttatatatgctaatgcatattgccaaattcatcttcccttccaaaaaaataaaattgagatgaaagttttacattaaagtagaatgtaaatatgaaacttataccaaaatttgaaattattaaaatattttagtttgattcttggtattttagtttggcgtatcactcaatttcaatgcattggatgctgcttgcaaaccacccaatttctttgatccaattatgtcaagcaattatatttagaagggtcctagtagcaccctaccaataaatgagaaaagaaagaaagaaaaaacaattttaaacatacgtaaattttaccaatgtatcaaaagtgttaggaaatatatttgttaagactatttctcatacatgtatggctgtgtttgtccagtaacatgtaagaagaaaatcgtattaacagcaaaaccgcttgatcagcacaatactctatccgccagtgataaaagaagagcgagacatttgtttgaaaaagaaaatacctactaaaacccaatacagaagaaccatttgggtcacagcacataactctatctgacgaagttcaatgtaccattaactggtgaaaagcaatacacaaacacaatttataagattaaacactaaaaaaacacttttccatcaaaactcaataaaaagcagaaaaactctaatcaaacagtcccaatcccatatcatcgtcggactcttcctccaccttttcttcctttttctcagcagccggggcagcatcagctgcagctgcaccccctgcaggtgcagctgcaacagcaccaccgccacctccaacgaatacagcaccacccactatcacctgaacaaaacaatcaacaaaggaaaaataacctcagtgacccacttaattattgaatccaaaagttaaaccagcaaggcagaaatgccaccatcaatcatcaatagcacaataattcatttagtcggacaagtgtattaagtattgttctccaattaaaattagtttcatttcgatcatcatctaagcaatgttaccagagtaaagcttcaactatggaaaataagagtcagttttctataatggacagaagctgaactccgtaaataacagagtcccatgtctaagaacatccttaaaattaataccaactaaattgtctaaaaatatcagcaaatcttaccagagtaaaacttcaaattttcaaaattgcactaaaagctttaaagtaactagatctaaatttgtacttgttttatgcgtgcacaaattatatactttcaggtaatgaacaatgattaagctttgcaagtcatagcactaaaacctataattctcttcaagtcagcgcataatctcagagtaatctgaatgaaaaaccaaaaaataataaagaaaaaataataataaagtcaaactattaattccacaacagaatctcacaaatgaataacaagaaccaaactagcaaactctctcggattcaggacattcgtcaatgaaaaatagcctaaggaaagcctaagcaatactcgaaacaggcacagtgcaatgacgcatagaaaatgtactattctagaaaatcaaaataatacaaataaaaaggatcgaagttgaacgcaggataaacataaaccgtgaagttttatctccgaatcaagaaaccacaatcgttagggatgtgaaaatgtgtacctggaacacagcggaggtaggagacacgggagagaaggaggactggactccaccggaggaatcaacggcgagagcggcttgcacgagcttccgttggagatcgtaggtggaatcggcggaggcctcgatgtcgccggaatgttgcttggcgctccattcggcgccggatttgcgaacgacaaaggtgaagactcccatggttattggttactcaaagcgaaaccctaattggaaattgaagcctcacagagagcaaagttgcagtgcggcaatttgagttgaacgagtcgtttatgtaccagtcaggttttggaaccctaatgctgtgtacgtgaaaagtccatttagtccatccgaatatgatattttaataacttatatcagcgcgcatatttatgtgtaaatagaaaaaaaaaatatatatatatatatatgtatatataatttagtcagatacactatttaatattatattattatcgtaaaaatactatattattattcaattaaaaatatgatatataataagattattattttttataaaaaatattttaaaaattataattaagataatttttaattagttgaccgtacaaatttaatattgacggtacataaaacttatactaaaaaaaccaacatttttttaataaatttataaatgtattagtcatgtttaatattcatcagaaaactaaagtattgattaaagaaattaaaaatattgatttgaaataaaattttcctaccttaacgaagaacagcgaagaatattttaccttaaacaatcttatttttcgataacagattattttgtttctttttttatttgtgttgtttcctttttatttaattgactgctcatgcctataaaaaaataactcatcaacaattttttctgtgaaaactcttacttgaatttttcactctcaataacttaccacaatctcaaatattgacgatatcataaaaggccgtgaatatcacaatccgattgcttttcggtgcagttttatttttttcgaatccttaattctttttttcgaatccttaattcaagggggccacaaagtaacaaacaatcgttttctaacagacataaacaaaaattttcttttttagttacaaaaagatgcaagtttcatataacactgaatggtaagtggtagtggcaagtaggcttttggccttttactctgttctgttgttactttttgatggtcattttgcttaactcactacgagcaattttttatttcctaactgcatgtagtttccagtttagatacttcgttttggttttcactacagtacagaccatcatgttctttaagtcatcgtacattcatgacactgatctatggagccctaacaagtaacaacaccactacataggtacattaccctattaggccacgattttatttaaaaaataaaatgtgttctttcaaagtaaccattagaaaggtatgaggctgactaacatacaactataatttcctatgtagtttgtctaaacacggtgcgatccaacagttacgtaccgcactacactgcattaacatatacaaatttcacctaacccccaccataggaagagtaataattaaatagaggggggggaaagcctcaacaatgagatgctattttcttatccttttctgtttaaaataattggaagccatgccagactagttgcaatttagaacaaatagtgcacatccatgaatttccacgttcattgatatcgtcccctgcgttgttattacgtctgttccactccacacttccttacccttgcatgaagtgatgcttttgtcaggaagaaccttagccagatatgatgtctttgcatatatctccgtcttctgttcgcttagattgaagaaagcaagatagatttcccctgaatagagatataagattaatataaatgaattaatataggatttgactttgactcctcttagagggtgaagtggatgaaattatagtagttgattggacccttatttaagagtcagatggtactcgtgattaagcaaattctgttatttaagttcttatgtactcatgattatttaagcaattagcatttttccaattttgatgctttgcaattgcagaaaagaagaaaattcttgacatccatccaagtgtttgttagaaagtagagagagacctgtccttcctgttgcgatccaagagcgaatcccaccagaattaacattagctgcatgaatgaccaatttgctttatgagtgataaacacaaggaaatggggaaaaagaaaagcaaccctggaaactatttctaaaaagtggaaaatgattacaaaattttaccttcaacatactctacagttgcacaaagaccggagtaactatttaccatggtcccattggagttcagttcccagatctgtagaagaccggatagatcagcttccaacagaatcaataaaatacaaattggccaaggcaaatggtactcaataggggtaaaaataataatatgcacataacgaagttgttttaatgaatcacacacaggactccttcctaaagattaagggccacacgctactcttgtacatgacatatggactgcaacatacctgatttgaatcccatctgcatggagaaaatgtacctctcttgaactctctagaagtaacctttcgttttggagaagcatccaagcaaaatttcattctgtcagttgcaactaattgatgtttccctcgatagtctgcctgatacatactcaccccatctctgtaacaataccaatgtaacaatttctattgttaactgcaacacaaatatttaaatggaagttggataaatggaaaatagaaagataaagcatgattacaatctgaattgaagttctcttttgtgtacgcagaaagtggcctgatgcttgttttctaaaccatttttccaacagattatttcaagatcttggttaagactttcaatagaccaaccactcgcctttgattcactacagccagtcaaacccaatgaatgtctatatgatgcttttattcctttcttaggtcttccttttttccctccagggtgcttcaagttaatagagcttgtgacgtaaggaaactgtcattgcagtaaagtgaaatgattcatgataagttctatgcctcacgtgcctattattccctaaaaaattagatggctcacatgcctccatattgtttgagctgaagtaattaatctctagcacggtaggatttgtgataacttcatatgtggttggatcgatcttcctcacatcccccccatacataaggggagacttcgccaaagaccacaaagtcatctgccagataagaattgattcactcagagtctattatcataatgcacgtacgcagatcaaaatagatacatgaatatataggaaagcaactcagttatgcttcttcttttttttatcaatacctgtgtccttttttcttctagagtgagtttactaaacctgtgtggaccttcatttgatcctacagatagaatagggggataagaaataattccataatccatattccaataacatgaggattctggttcacacaaatgaataatagataaaagcagttactggatcaatacatacataaaagtaataaacaactcatgcacagtatgagggttatgacatattgacattcataatgggcaaatgaaaaagtagcagcttagtctcattacctggatcagttagccatccaaatggtagcatgtccaaatcaggccaggaatttccctttaaaccttttcctcctatcatattagctttagaaaaatccctggttcagaattaaatgaactaaagttatgtaatatggttatgacagaatgtatacagagaagtagcatgattgcaacatactgcaaggctgataaaaaaaaatcttaaaacagaaatatagacagcttaatcaccttgttacatcaaaatgagccttgacgtcctcccataaatcccagtcatctcctgttattctatacatgttgactagtccactggcatccttggccatggctggtgtcacactggttccgggagacagagaatacacaatagggcgattaagctcactgagaacctgtcatgacatgccatacgattagccaacaaatcattggaaaaatattaccaatctcagtgtttatgtgagaatgagaggtagtggagagggtaagagggagagggaactgcagaatacctcagacacatagcttatttcatttaaatccaagtcatcaccaaacacacagtcatgtttcactgcaaggacagaagaaaatctatcaacatagctgccaaagcatagccaaaatgatgatatatgtattctcatagatcataatgaaaatccagttaagagtccactaactaatttctattgtatttttttcctatgtcaacatcaacatcaacagcacctttaacccaagctaattggaatcggtggtagatgaacccaatgatagatacgaggaggttgaaaaaacaaaaatggtaaaagctaagaagggggaaaggaggaggggggagatgaagaggaaaaggactaaaaaggaaccatctagaacatagagataacaatgtttaaaaggccgacacaattttagaggtttagaatggatgaaaaaggaaattgcagtaaactaacttttacaagtgtggcccaatgaagtaggctgtgttgtttttatctttagtgaaaatcgaagttccttgatatgataacattacttgatatctattggaccactaaaatacgaattctgtctgcttagtctcttgatgaaaaaagcagtacaactgtttgagttattaaacttagattaagatagagcaagaaattatttaaattcatcatgattttcgtctgtgacatgatgcaagtcctgatagtgcataataagcagattataaattagttgaactggtaccaagatcaacaccccatgcagcatactgctcataaagggatttcagaaaagctctcccagctcccaacttcgtatttacactcatgaaaccgtgaggcatccatgcacaagccctttctggcattgctatgtcttttgcacgccacactcgaccagattcttgataagcacctccctaggaaattgcacgaggaggaaatcaaggtcaacaagaacttccaattaagataaaacaatattctcatattctgcctgccattttgtattttttttagagaaaaaaaatgtattatgtaaggcatccatcactacaaatttctaatacagaagtaaagaaaaataatcaagtcatagaagaaatgcaaacaacacctttgttgtatctagaataggggtgtttgcattgacagcttgtgtgcttatccctctcataacatgaatcccaaacttcaaacctaaactatgtactctattagctacttcactgaatcccttcccgcctgtggaagaaggccaccttcctgggtcagggagcatccttccccattcatcaatcacgtcaaatccaagagaatcaggataagcacccttgactttcttcctataccagaggtaatccaccacgacaaactacaagagttgatggaaagaaatcagtcaatatctaaccaaagcactgctaacacagttaaatcatccataagttattgttctttgcagtatctatacctgatatccatgagccttgagacgttgagaaactatttcagcactttgtaagaattcttcttcagaaattgtccagcaaaaggaatcataggaattccaacctcttggtgggaggctagcttgctgtaggccactctcagatatattttgagataacacactgaaatgacacactcagatatatattatgttatatctttctttacttttattgtctaatatgtgacgaataagattaaggaatactagttgcacttaggatatgattgaacaacataagatttcaatttaatatactttcaacttatattttctgcaattaatttggacataattgaagcttgcttgtaaggtttaaaagtcattccacacacactgctctagtggaagctagtttatattctatattaattcaaaatcacattcgaaatagtaaacattaatgttaaaacctatgctgagtttcaagtctacttctccaaattaactaattgaaattaaccagacttgggcttcctggatttgacatcgtggatctaagtcaaaagttgcattattatgttactgattttaaaggttgccatataggtatatgattaccatagacgatattcaatgcaagttttgcaaacagcttttgacatttagctaccaaatactatatttaaagcaatgcataaaaccagcttctgaaaatcacccagcaataccaaatccaccccaaatgtgagtgagctctataccttttcgtattcatataaattcaggaaataatgacaacagtgctttattattattaataaaaatattttctgttcgagaccaaatatgtaagtagatattttctttaagagtaagaatttacaatgactaaaaatgcaaaatcagagttgaattatccgagtatcattagactaatcaacaacagcagcagcacttcaactacatattcaatttaataattccaaaaggcagtggaaattttgaatactcggtaaatcactagtatttctgttcactcacaaggcagacttctgttcacacttcacagatccaccagagtaatgaaaccagtgtgaatcagtccatttgacaagctcaagcagcaagcaatggcaatgtgaatgaacaaaaaagcagaacactttatttataggctctggattctagcctccaatttattaaccagaaattagcaatcaagcatatcttaaaaaatatccaaaatgtagcattaaggactacacaagcgaaactcagaaccaacaaaacaatagcaagagaagcaaaagattccatggttgcatacctcagagaacagagagcaaggagaacccataaggaggataaggacactgagaaacccttcatcattgtgggcacgtctgttccaccaaacaacagttcccactcagttaaatactgataaaatctccaacttcgtagtacatcattatttataagttataataaattaaattcgaaataacaaatataatagaataaagtaatgataatgcgttgatgcgttgtgaaccatatatatgtgtgcatgatgcataattatcacatgacattgaaagcaacgtaataacggtgacgtttatctgtttcagacttttacttgaacacagtcgtggctttcttcgaagggatgcgcattttggttttgtcgcgaccttgtttagcccttgacacttgtttacgttactacgcgcatgatcccgattgcagaggagtaaacgtatctgccacctccaaaaattttgcaattcattccaaaattcggatttgtatgcatgttcgtgacgatcaacgaagaacggtttcggtgattaaaaaagtgcacgaaaatttgtagtttgaaatggaaattttggtatatggtaaagggagagaaaaaaaagaagagagaaaagaaaatggtaataaaaattgacgagttgaagaggggtcagtttcacacatgcgatgtgagaacatgatatcatgtgtggtttgctgtcgggcatgtgtctataaatttgcggggtggagcgcgtgggcgtagattcctccacacagacaaagatacagctaaagtaaaacacctttcctttggttttggttttgcctcttaatcttaatctttgtctattctagataatttcacaactcattaaatgctaaacattttataaattactactatatttatgtttgggtcttactcatgaagacattgatttaaatattaaaccaaaaaaatatttttgtgtaaatcataagaaaatataaaataaacataaataatacaatttttcatctttcaataaaaatacttttactttaatttttttaaccaatatctttaaaatacttgttagcatttacctttatgattatatatgataccgaagtcatagttaatccgtgttctaaccgtcgaagaaaaacttctctttcatttttttctttttagtttttcgcatgcaaagtatccttcttgaggaaaaaaaaagcgtctctcttaatatttgaatcgtgatttatcattttgtatggaattagcctcttcctatggacctaattaataataaaaactagtactctatacagtgttcattaaggagaatttactgtttatataaaatcacttttgataaagtttttctcaagacttgatcctgtgtgtcgaaccgaaatggtttccaacaactaatatgtactcacactaaaaaaagtaaaaaataaatctcctttcttaaaattattttatatttttcatctaaattattctcatataatttattatcttggtagagtgaggtgcgttgggtgttttttattttttttgaattttaaccaaaactttccgtctaatatataaaaatacatgagattctatatataggtgatgttttaaaaattggaacatgatcgttgctttttaaccaaaacttttctactaatacgaataaaaaaatgagattccgtatataggtgaagttttaaaattggaacatgatcattttaatgatatgttcacaaaatttaatcacgacgtattaggggtaactaatacgaataaaaaaatgagattctgtatataggtaaagttttaaaattggaacatgatcattttaacgatatgttaacaaaatttaattacaacttattaggggtgagcatggattgaattttttagaatccaatatgtatccaatttatatttatttaaatggattggattttaaatccatattcatatttttttaagaaaacaatttagatttaagattcaatctatttaaatggatatgcatttggatatattcaatttatatccacttaaatattatattacagattttagttattaaatgctaaaaagtgaaaacttagtacctgtccatttaagagttattttcaaccgatcttagttaagattatttttttgatcaatattgtgtatttttggcatacctcaaccaaagcaaattcgacagatatcggtccagacatttttagatctacgtcaaccaagactattttttggctaacattagtcagtacattttcagtcgacattgaccaatggtgtttttggtcgatcttaggtagggttactttttggttgaggtcggcaaagatttttagtcagtgcattttttggctgacattgactacagattttttatcaacatcgatagtgactaattttttgccaacattggttaagatttttgtaactaacattgataagatttttttttgctgatgtcaatcattaatattttttttgccaacattcgtcaggacttttttttggtcgacgttaactatatttttttgctgatgttggttaaaactatatttttgttggcaacaactaggatttgttggtcaatattaaccatgactatttcttttagttgacattagctagggatttttttgttgacatcaattaggatttttttgatcgacgacaattggagaaatattttggctgacgttaactagattttttcgtcgatgtttgtcgagtttttttttatcgacatcaagtaggtttttcgctcaacatcaacaaaaaaaccatagacgacgtcgagcgaaaatcctacttgatgtcgataaaaaatattcttgaccaacattaacaaaaaaaacctagcttacgtcggctaaaaaatagattcgactgatgttggcaaaaaaatagtctcaatcaatgtttactaaagaaaccttatcaacattaacgaaaaaatagcctcaacgatgacggcttaaaatcatcattagttgacgtcgacaaaaaaaaataatctcaatcaaagttggcaaaaaaatagatttgaaaatctaaataaatatccaatccatatccatttcatatctaattaattggattgaatttaaagtaaaaaaatgaatttggatatgaaactaatccatttaatgaatttaaaatagattagattgaattaaatataaattttttttatggataagagtttttttgtccaaccctacgacatatgacgtgatagagtctcatccaaccaccgtttcattgtattcgttggattttttcttggtagattgagaaaaataggaactgaatcagtcacctaacataaaaaaaaaaaataaaaaaatgcatgtagtagctggggaaaggaacagaccaatgctatatatagcttaaaccgagttaattttggcacgaagcggtttacattacatatggttcatttgctctcctaatcaatctacttctcgtaatgaaaaaaaattgcgcaattttcttcatataaacaagcggggaaatgttacgcgttctatgcaaacttaaagatgaaaaacttccgcaaagatagttacaaacttacagttaaatctcatttcttgcatgccgttatctacgcagggtcaatggccgaaattaagagggggccgttctgcattttcacccaaggtactgcgaacaatgtgctccaacctgaaagcatcacattgagaactgcctaatgagttgcttataaaaattaaaaataaacaattagtatatatatgattttaagttgcttaaaagtaaagagaattgctttaagaagcaactattgttgatagttatttaactatattaaatataagagagagaaaaaaaatatttgtgaattaaataacttgttaatataaaattttattcatttttttaacttttaaggaaccgcttttatattcaaagtgcaaaattagtagtagggaattgctattgacactatcactctgtgtgtcttttaacaatatttccaaaatgtccttttgacatagacataaaagaattgtgattttgtaataaaaaattatacttatatgacagaattgcatttttatcgtgtaattttttcaccctcatgtaggccatggatgactgtgtaatttattttcacccacaaataataccacgaaaagggttccgtttgaggagatggtggcacagtgaggccaatatgtcacacagtaaggtggtggcacgcaggcttagtgtggtggtgatgggttgagtggggtgaaaagaaggtgaagggacagagagagggataagaaagttttttctcacgtttgtagggatcaataacaaatgagattggaatcaataacaagtccgtttggttaattggttaagcatttattgtcattgaatccacacgttaatcaacttgaagtaatattttgttactcgtgttatcttcatattttgttgaattgaataatttctgcatataatattaacaactatttattttatttttgatagaacaactatttattttattagtaaccaaaatttcaagttaaatatcaatttttgtcgttaaaaacatgaaacattgaatcatttaaaaatagaaaaaataaatttagttcttgaatatgtaaaatttatgacaaattaatcaaacaaacaatttaatgataattaaattcctaaattttataacttaatactaaattagtccttaaaaaatataacttattatcaatttggttcataaaattattacactttttcatatttgataactaaatttaaaattttcattatatcaatatgtcatccttacatttttattagtaaaaaaataagtattctttttctttattttatcttttaaaatgagatgttctcattaaacaaatccaaattttctaaagtgtatttttttataaaaaaaaagattgaaattacttggagggaagttactcttatgaaaataaaatacaattttttaaagtgtttttagtatgattttctcatcaaaatttaagtgataattttttgtcacgcgtataatatcaatattaattggaaaataatacgcaagaaattattttgttgcattgttatttactcaaaataaaatggattttggggaaagttcgactcacttcatctacatcaaaataatatattaatgttttgccgatggcgccattcaccaccgccacaccgcccaccgccaccgccagcaccttcctcctcgtacttgatgtctttcactcacctgtctcactctataattcgttctctttcctcgcatttccatctattctgcaacaaaaatgagaaactgcactgagcaggcattgggactcgccatttctttcttccttttactcatcctcttaaccccgtccattcctcagcctcagagataccatgatttcgctgacaagcgcgaattctttggtaattccttacgaaaaactacttgttagcctttcatttccagtaaagtaaccttaaaaatgtaaacttggttatgtagaggagtttatgtcaactgagcagatgagggtcttccatttccattcagtttgttggcaaattttgaaaagtaaaaacaaacagaaggatttctttttccgaatttaaatagaatacattacactgagtgaacaaacttataaggatttctaataataaactttcgtataatgtaatattgttaaatttaaaagagttcaatttctatttaaatttaatccatcaactaattagaaattatggttagcatgagtatgaaattaatatacttaatgtaaaaacggacaaacttttcatataatataatgttgtttgtatttgtgattagttgccagtttcaaaaatctttcacgtgaaaatcttttatgacatcattgtaagttcacaatgtaaaaatctttgcgataatagaatattaaaattattatttgtttcctcttttttattgttcttcaggcattcccaatgcacctaacgtgatatcaaatttcccattcatggttattggtctcattggccttgtgctttgccaccgtaggaactattttaatatcaggtattttcattttgtcaccatcggtttctttagcttacgtgattgttgttgtcaattatataattaagatatgtagcatcagtttgcaaggtgaactatggggttggacatgcttctatgttgctgtgacttcagttgcttttgggtcttcatactatcatcttggcccagatgatgcaggccttgtgtgggacaggttgccggtgagtttctcctatagaagttgaattcaattcagccattgttgctgtagaaatctatattcttccatttcatagttttgattccttgattattgtttgttattggagatgtctgctgctttcgcgtctctgttggcaatcctcatcattgaaaggattgatacaaagaagggaacaatttcaattgtacctctaattatggcaggcataatgagcaatgtgtattggaggcaagcctacttcttcattccttctatttgcatgagtttttttttccccttaccctattgcattagttggatatttattcattgatacatacatgcagtccttctataagtgaacaaaattgctcttcatacggataaaaagttggacaaaacttagttccagttctttagatgcttttagggctgttctttaatcaaagttggagtttcatcacgtcaacatttgttgtgtgagttctgtagttgatactccaattttaatgtgaaaataacagtaaaagcatcaccaaactgcatctaactattctaaaaaattgtcaattctataaatgcagttatcataaagatataggatttattgtgagtggaaacatcttggattgattaagataatgtcaaaattaggctagttcttaacccttcggtaactgagcatccagtttactgaacttttgctcttgagaatagttgctacttttctcacttattcatttatagtgaaggttctttggtgacatccgtttatatgttctggcccaaagtgcatcatgcattgccatacctctcatggctactttattgcctcctatgtacacgcattcaacatattggctctgggcttcaggtttgtacttttggtattataatagctttttctatgtaatgtagatagtattttcaattaccctgaatttcaattttaaatcttgacaggattttatcttctagctatgctgcaagaggctgccgatagagtgatttatatactgacttttcacattgtcagtggtcacacacttaagcatttgtctgctgcaatggttcctgtcatcctaacagtcatgcttgcaaagagaagagtttactcggagaagcttttgcatgtacgcaatactcagctccatccaatacagatttgaattataagaaagatttgggactaaaatttcagtgaaaagagtgttgacattgtcaacacaaaatgagttaggatcaccgtccaggttatggatattttatgaatggtttccctttctcatcaaaactctttgctgtcattcatatatggatcccaaaccattataaaaaataaaaaaacggaatttgggaatgttttttgaatttattacctgattttctaaaactatctaggaggttttttgcacttgaaataatttcaatccaactttcttgaggcaagatgctacatttctacaatttttgttggtaaagcattctgtatttgtttcctttacccaactaaaatttagcactatttggatatcatgatatcatttgagttattacttaataatggaaactatgtatttattgttgttgttatttccacctctcctccttttgcaaaagatgattttcatttacgtcttcctataagggctagaatcttaatctgacgtggttgatgtggtctgtatgcaggcaaagtctacttaacacgtaaagcatttcccggactatgatcaaagaaggcatttgagttgtggagtgatctaagcaatgtcatcctttctctcccactgaagaaaaagtagaaaggttaagttgccaagggaagtttagtgatgtatcatggagcataaggagtttgttaaatattttatgtttataaacttttgtgctttagttgtactaaaaacgaaaagaaggtaggtggatggagcaaatcactccctaccaattgtgatacagtaacattcaccttaattagcatcttgtttgtacggtcctgtcctgatcttcaatttatagccagtattaaaatagaagaggtagtccaagtagatgaagaatggaatcttgactcgttcagccactgttctttgatttgtatggaagaacctttggcacctgcaaaatatttaagaatacaaattataacttaattatttaaaaactagtgatacagtaactaaaataagattcaaccgtaggtaccaacggagtctaactggtttaacagggtatatgagtgtgttgtgatactgttttgattcctattgaccaaaataaagactcaacggtaggttggcagcattcccatataataacggctacgaacctcacagtcgagtgtaaaatgctctacatttggttggtaattattaatatttgcactgatttttttagcttggcatcttcaaactaaacgaataagcacggtagggaaaacctgacttgcagtggaagcagctgtaaaaaggccactcttctctaactaactacatatttctagggattaaaaaagcacagagtttaaattaaaggggccaaatttatacaaaaagcaaaaaaaaaacaaagtacttggaaacggccaaatgtgcacatggttggaaactaagattcagcaaaatagtcgttttcacttttgatgattgatgcaacagaagcaaccaacggtggcattgataaacaactggtgggaaatcaaactgctgaaggaagttgcattccactacatcttaagtaaaaggtcgcatgtctctaacaaaggttcacactagaaatacaaatacgtccgtcgcgtcgtgtgattctctttgaaggaaatggtcccatgatgccactttcaaaggctatatctgctctgtttgttccttttgcacagattacatatgtttcaacgttaggacaaattatccacatgaccctttaccgtgcatgcttcatctcattaacagattctgatatcagtatatatttggaaagaaatttggagtattataacacatctttggaatatctataggtgcatgcccgataaaattaagtaggaaatcgaatccactgctatacaaagtctcccagtgtatcctaaataagtaaagaataatcgtgttcatagattaaatgcttcactttgactgagatgactggttcacatacatttactgttaagattatatcctgcaagttagagaatcctattggagtttggacgtacagtagtaattgatgccattcatataaaccacgaaattagaataaaccatttggcagttggcaccatcaagtaaatgaaatgttgtttctgaaacttggttttaattttttagtggaaacagtaagtaataaaggaagatgattacatctaaaacaaggtaatctgctacatgattccctacaaaggtgatcttttgcactaattttatatcaattttgctaaccattgcccttttcaaaggataatgattttgaaattataaatgaattttttttattaaaaaatgtagcatttaatattatatcattcatactgactagtagctggaacaaacaagaacaagaacagccaaagagaaaaatagactttatattcacttaaatttgataattgttatgtacttgagatgctatcagtgcattgcctgcatgttttgtgtggtttttattgctcagcctacactacaccttgcaggcatgcaccaatattcaaacaggagtgaaagttcacgtccaaaaatagatcatttgagccaactatggctatattatctatacaggaagaaactgaaccactgtaataaagttaactttctcttagaagtcttctacttcaagcataacaacctaccttaaaatgacacagtaccatattacaatgatcctctgccattaacgttactctcaacagctatactaataatatcaacatctcatattagccgttttcccactgttttcatagttagatttgcttgcaactaacatcctccatcagagtatcatccaaggcaggcaatgagaatgacctggatcttacccggaccttgctggcacgggatgattcggtggccgagggtagcaacatgcgaggtggcgggttattccctctgcgctctgcaatggagagggaagttcctttgcgcggcaaactggactttgctcctaccaaggtgtgattagccagaaatgcctcaccttctttcttaactaaggagcgactctctgaggaagatgcgtctttcacatgaacgggttcagtcgatgaaggagaaaatgtaaaggaacttgcataatccgaactggtgggagacagtgttggcgacttggaactgaatttggggctgctcctcagaaaacaagcaaaagaatccgatgctcgatgatgaggcgatggtggcggcattgatgaaccaacaacactagggacaacaaactgatccctgacttgaacattatcctttaccctctccgagccattatctacaaaacactcaaaggaaccccgcgagccacccacattgttcgaagaaggtggaaaaggatcaacattcttatgttgattcccctcttcaatgatgttcacactagattcacagcacttagaggatgtgaacaagcctttcatgataccactagcaagcttccttgtcaatctcccccacccattttctctagcgggaaggcaattttctgatccagcattagacaaagaaaaaggtggaacaaccccaccagcaagcgccttatgaaaaatcccataatccaaatcatactcctcaactctcctgggacgaatccccacatcaatctccattctctccacctctccattctccaccaccacttccttggtagaaagagcaatccaaaactccttcggctcttcatcctcaaccacactaacaatctcccccgttgctctctcataccgaacaacctgagaagccgctgatctagcattgcaacacattgcggagccacaatccttcccaatccacacgtatatagcagagggcacgtgcacaacaaacgcgccacgcgaatcaagcgcgcgtggggaaggatgatcaaccaacttagggacaagatgaagagggtcgtaaggagaatgaggagccatcctatacatcctgagaacagaactgggactagaaggcatagcgtgcacccgcttctgacactgcaacagctggcacgcgaagcccatgttggggttcgtgacgccacgcgcgttcttgacgtagtggaacgcgtcctcgaagctctggccttccctccacatgagatacgcgattaccagagaagtcgaccgcgagacgccctggcagcagtggacgaacatgcgcccgccctgttggcggacatcctcaaagtaatcgaatacgtcgtagagaatgctggtgatatcctccgagggtgagtccctcagccagagcgttttgtagacgaagtcggttttgaaatactcggggcacacgaacccgacgcaattcagcacgtgcgtgatcccgtgccgccgcagaagctcgtggctcttcgccaccgtgtcactccccaggtacacgtgctccgcgattctcgagcattccttgtcgtagaacgcatggtagtctttcttgaattgaaatactttacccgaacccgaatctggcgttatggtggaacctcttggggtcggtggaagagaccaatcgccgagatcgtcgcagccggcgctcggccactccaaaaagctgcgtttgttgatggcgagaggcttaagcggacgcggcggtttccgggtaaccggagaccggtcggtccaggaaattgatagggaatgtgttgctctacggtgaccgccgccgcggtcgttgttgttgttgttactctcttctcctaacatggataatcgacaagattcgaactttttaattgggtttcaaacccattaacagaagtaataatgggttgaaagcaaaagcttggaacggtaaaaaaaaaatggttacggtatggtattggtaggtgttgtgttgcggctaggttcgagttttttctcacctaaaaccattgacggtgacccacttctgactcgttcttgttataaagagaggagaattcacacaaaggcacttaaagtttggatcttgaagagagaagagagaaagcggtggggtatgtgtgtaaaacagaagaggcagagggaagtgaagaagagtttggagtttgccgagaaatggaaataaaagtggggctgggtggtcatggtcattcagtttgacctagacataatgcgtcaaagtgccacctcagttttggaacttttttcttaaatataataataaatactgtgcctctttaaaactgcatttactatcacatattttaatttatttttaattgtctttcttcctcccctattaattatatcatcagttttaataatatttatataaggtgcaattgtaatgtgcattaaaaaactagtgaaggaaattctacccaatttaattttcgttatatttttatcgtagatgaatcaaattataacagcataattttttataattattatattattttataattaaataatatatttttaaaatttaccatttaattagattaatttttatatacatattatgtttgcaaaatgtcacatgaatctaaaataattgaatacctcatttatatagattaacgacaaatagtaatataaattttaaaatatattaaaatattaattattttattattttattattattcaattttaatagaatttgatacatgatcttaataatatataaatacaattcaataatttaatgaataaaaatatttttatatcaaattataaaagtgatcagaacataaatataattatatctctccatatttttatttatatatatttgatcattacctgtgtttttaaacggttttaatattcttgatttttttccatctctagtagtcaaactgttataatagttctttattattaaatgttacaatgaaaaaatgtttgaccagacaaataattgtttgttctagaatatggatttgaattgattttattatcatctgaaaaattctttttatactaacaacattaaaacatcattaaaagagttcatatttttttagtcaaaattttgtaatatttcaatatataatgggagtatatttttttgtactcaaatttggtcaacggatttcttatgtgatttcttaagttttttttttgtttgaccgggggtttcttatagttatacaacattttttaactgaaattttatggtcagagcaaataaagtgaattttttataaatatgttgtttatataaaaaaaattattccttcatgatattttaataaaaaaaagagtgagaaaaaataattaaaaaatcaatcaactcattgtctaaaataaaactaaaatacggtaaactcataattaaaaaataaaaaaaaatcacaaaatcacatttattcatggtaaagtcacaaaaaaaaaatcacaaaattaaactcactttcattgcaatgatgaacttggtgatgatttattctaaaaaaaactctaatgttggagactcaaatacattgatgacaaatcaaacttgatctacacttgtaaaatcacaacaacaaaaataaaaaattaaactcattttttacaatatgatacttgatggtgatcaatgctagagaaacttaaacttgtaaagagatgtttaagagacttgaacacactaatattattaaacctaatctacattagaaatttgaatttcttaaaaaacggataaagatgctgagttgaaaacaagttgaatctatcttgatcatagatgtgaccaagagaaatggttaaactcaaaagccttttaaaacaaacaaatgtattgaagtaaaagcataatggagagaagcaattttgcctaataccattttgagtgaaaaagaaagtaagagataacattttgaaaaagggcttaaagtgaatatggaaaaagaataagggaacattatgagaagcaagctaacatatgggacttaaacctttttaagtctcccacgacgggaaacataagtggtccgtaggataggatttttatctgagataagtgtagttccaccatagatttgcctatactagattatctttttctttatttaaaaaaaaaaacatcccatcttctagtcttcctcttattgtctctgtttcttctcctcattgccatcgttgcattcctcctccatcgtcgtcgccacattcactcttctccctttgtcgctgatgacaaggccttaagattggacaaccttttcctgctcccgatgactcacccaaccaccactgacaatgacttttgcaatgacggtgacaaagttcttcccttaacaacctctctcccgtcgttcctttccttttcctcccctcaagcaaccaccactgctagtgatgccactgcacacatctcactgacaaagacttttgtcatcatagacatacttcgctgtcatttataccgtcgtgaaactgacgctttgatagtggctatccgaattcgcaccaccaatctctctctgtcagagttgcttccttaacagttcaacccataattgatctacaaatcgaacactcacatgaacatatatgagaaaacatacatcaacaacaactagatctggggaaaaaaaaacccacacatgtataatggttggaggaggacaatggaggttaatccagactttgcaagttgttgtcgaggatatagaagccattgtagaaccaaactacgacgatgccggaaatgaagagtgtgacaaagccgatgagaagaagcgcaacgatgtcgacagggaataggagatagatcggacctgcaactaaaagggatgtctttttttttaaaaaaaaaaaatctggtgcgtacaggcctattgtagtccaacacttatcccaagaaatacaaactttccatgactacaattttttttttccatcgtatgaaacttaattggctctcccacaataaactactttgatgttatgaaatgaacatgaatgtgaaaatttgatgggaaaacgtaaagaagctaaacatgaaataaacgttttagcaaaattatcattgtgcacaatttaacataatttaggaaaagttactgttgaaactcctagctaaaaataatatgaatattttttgtaacaaaattacagttgcgattgaatttgtgagttctggtgagtgtataatttgtgcttcaaattacattcaactcacaattcttttcaagccaatattatttggtgtagttattcttctgaagttacattttattggttctctataagttaattttaattcttgctatattgttgttctcaaattacaactgtttattgttgtaggcagaaagaaaaacataagattagaggataatgtcactgttatatgttatttattctttaaatgaccgtaagaaatttaaatttaagcatgcttgacaattattaaaagatgaattgaaaaggacatttgaaataacgaaaagttcttcaaaaagagcaacggttttttcttctagggcatacataccaccttctagcctaaaaacaccaacaagttttgaaaatgacccaacatcaccattggttcatccattgttgtcaaagtcgagtattaactcgtaaatttcatccaaattgacatatgcaaatggagttaaattgattgtggaaacgttttttatgaactcaaataaactcacgtagaattgctcaaaatcatgagtcatctccaagttggtgagttcaccctgcactccattaattttagagtgttgtggttcttcgtctcctccaggaatcatcttgtcgcgacaaaaaacacgttttgctacaaaaaatgcaataaatcatgaagtgacatgtttattaattgtaagcattacaacatgttcgtatagttttttttggtatccattgtcgttcttttcttatgcccttgttttttttatcgtgcacattgcaacacatcacatttatactttcttaaatttcaattgacattatggtacatgttttccttctatatgccatgaaagtggtttttatcccacttttaattttctttaccattcttacatatcactcattcaattttgaattttttttatttacaatgttaggatatttctcaaattttcaacaattggaggaacattgctttcttgtttatatctttcaattgttacaatctattatttttggaggaccaatatcatatttaacccataattaaataaagaacattgcacgcataaaaaaacaaattaactgcaaccaaaaattgatttccactgtgtattacgtcttgaatatacaacgaaagcttgtttcggttttgtattacgactagttttcgttatgatttttagccatttagggttcattcgggaaaataatttaattaagatttatttccaacaagtttttattatataaaagcttgttataagaacttaaaattaaacaatgatgctaaccaatattttttgaaacgatctggtgactacaggtgccagaaaggatcaaaatgcatatttggatagtgtcaaggaacttgcttttaactaatgtatgtccagagatctcgaaggcatatatgggagatactgaggtgtgcccaatgtgttttggcactctggaaacaatcattcatcttatgagggttgagggatattgcctaaaaacattcttagtagttaactacttaaatactaatatctcaatatatggttattttttaaaaataaattaatttagttaataatattaaatttattagtaatttatatagtatgttttaaaattattcttaaaattgttgaattttctctttctttatatttaattattttttacccaattgattaatatgtattagtctttttctcccattttaaaaaaagaaaatatatttatctttttaattcatatcatttaagtaattaaggttattttttaaaaaaataattaatacaaaatacaacatttagcaaaacgagtcctcctaagagagataaacaaaattgaaaaaaatcctagagacaaaatagcattaaaatgaagacaaaactaaaaagaaaataaaaaattctcttccctcccatcccctccggttccctccggttgcagtcggagcgagaagagaatagggaaaacaaacaaccaccattgtcaccactcacgcgcgcacgcaccatgcagtaggtgtggtgtgcctctttataactttagttactgcgttcataactctcaacgtgcaatgaatgaaggaatgcattgcataatattattaaaggcagcattgtaggtgaaggtgaatgaataaggatttgggcgattgctggtgctatgcctttggattttgattgatatgtatcagagcagcattggcgcacaccgcctcgcataccgctctcagatatcgaacctggtcaaagccggtctcatcaaccaagccatccacctgttcgaccaaatgaccgaatcaaattgccgcgtcttcagcgtcgactacaaccgcttcattggcgtcctcctccgccactcccgcctccacctcgcccaccactactaccgccgccacgtcatcccccgcggcttctccctcctgcccttcacctactcccgtttcatctccgccctctgctccgcccccgacaacattaacctccccctcatccacagcctcctcctcgacatggacgctctcggcttcgtccccgacatttgggccttcaacacttacctcaacctcttatgccgccaaaatcgcttagaaaccgccctcgaactcttccactccatgtcctccaagggaagagaccccgacgtcgtttcctacacgattattatcgacgcgctatgcaaagctaaacgctttgacgaggctgctagggtttggcgtcgtttaattgacagagggttgagccctgattataaagcctgtgttgctcttgttgtcgggttgtgcggtggggcgcgcgttgatttggcttatgagctcgctgttggtgtgatcaagggtggggtgaaggttaatagcttagtttacaatgctttgattgatgggttttgtaggatggggagggttgacaaggccatgaagatcaaggcgtttatgagccggaatgggtgtgtgccggatttggttacttataacatactgttgaattactgttgtgatgaggggatggtggatgaggccgtgaggttggtggagaccatggagagtagtggggtggagccggatttgtatagctataatgagctgttgaagggtttttgcaaggcaaatatggtggatagggcttatttgatgatggtggagaggatgcagaccaaagggatgtgtgatgttgtttcgtataatactgtgatcacggggttctgtaaggctcgccggactaggaggggttatgagttgttcgaggagatgtatgggaaggggattaggccagacatggtgacgtttaatgtacttatagatgcgtttcttagggaaggaagtacccatgtggttaagaagctgcttgatgaaatgacaaggatgcatgttcttcccgatcgcatattctatacggcagtagttgatcatctgtgcaagaatgggaaggttgatgtggctcatagtgtttttcatgacatggttgagaatggggtaaatccggatgtcatctcttacaatgcacttgtaaatgggttttgtaaggcttctagagttatggatgccatgcgcctatttgatgaactgcagagcaaaggtttgtaccctgatgaggtaacttacaagttgatagttggagggcttataaggggaaaaaagatttcactggcctgtagggtctgggatcagatgatggagagaggctttacacttgacagacatctctctgagactctagtcaatgccattcaatcaagtgatggcacaacatgacagtagtttgtgttttgatccactcaaattcatcacacctttctttcaaatgggaaacctgacttaaaaagttttttctggatacaatacaccaaggcttagcaaacctgacctgacctgaaacgttatctgcaggtaatggcgcctgtaaattggtttatcctatttttatgacgctcgtggtgccatcccatacctttatgtgtctctatgctcctatatacttatgtgctgtataacatactaattcacaggccagcttcttgtaaaggatccatacagaggactgtgctctaatggtttcttgctaccaatgaagtaacggtatccaagttttgtttcataatgtcaacagagtgaacagactatgcacttggcagattgtatatgtcaatacaatagaacattcatttacttttggcgattgttatacattgagagctatggatttgtttctcacccagcacaactaatttcagtaattgatgatttggttggaatcactccagctgcctattcaaatcccaattgttgtttcttaagagttcatattgagggtggctttgagttagtcttatgctgtcttcatactatttgagtaaatctttgaccagtggcagctcaattcagatggattcatgtcctgccttgcatagcagaaaatcaatgaatattttatggttctaactatcaataatagtatagcacccttcttgggttaacaactccttgatgttggtagaatgttgtcttgtttcatcaagatgaagtttgtggttgcagagcatagtttgaactatgaagatatggtttcattggtgatctcaccttggtgtggcttatgcctagtgccttgctatatcctagcaaattgttgaacaataaactctggaacctttattaacagatcatcggtttactatttgtgtctatatctagacatgtaactcagtggagagttgtggatgtgaaaaaaagattcactaggtagccttgttaggtttcaagattcagatttattagtttctgaaaaactgtgatgctggcacaagttatgttttccttctgagatttggattagcatgcaagaatacatatttgtaggattatactgttacaaaattcaacttgcctgacctttattaacattattttctggtaaattatgatgcttctgcctgtatctgcagcttggaacctcaagcttttccaaagaaatgtcaccatgatcattacacattgatttatccgaagtatgtttctactccttaaatttcagcgcgttcttttattagagaactatgacatataatatgattttgtccacttttgctaacccctatatgaaagaaaacaaacaatataatgtaagaaaaaaaatggatgcatgaatcatttaaatgttgcatagtgtttctgaaggctgctgaatcaatggagactgactggaaactgccttatcttatgttacttaataaattttcacttttgttggtgggatagtttatagtgcatttatgcaggagaatcttatattaaaacaacactttccgtagttgttacatttagtttgatagtgccacagtgatgtgtattctctgcagttgtgctgaacctaaggagtcagaacatggtttcacgcaactttgattatatgtattgttttgcatggtatcaatccccatgtctatgaaataaaataagttccttagtcttttttttttatataatgatattaatgtaccctggttcattgtatgctggtatttccttgccaatagattctacccaagataatgttgcaccttggaacaggactagctgaaggacaactacaaccagcacaactagcaatttgcagattggtttgatggaaaattggagaagaaatagaaagaacaaaggagggcaaagagaatgtacagatgaaggacatacgcctggattcttgatgatttacaaatagaaatgaatcatctagggtccaccatccaagcaacttccggagtatgaaattaaaaatggaaatagttaagaaaatgccatggtggtggctaaatgtcagcaaatgagacgtgtattaggaaactagtttcaaaactgctacattttagaattagtttggaaagtacagtattgaaactgggttgacaaatcctttcttcattcactcactcactctcttcaattgtgtttctcaaagattttcatttcaataacaaatctttctctaacatgtggtatctcaagttctttattcacacatattacaccaattttagaaactcttaacctagttttattgagaatccacttctaatataatcccaggtcatcaaaatgaaactggatttcaacttgcctgaatataggattttagaagaagaaatggatttttccctccggttttgaacatcattagaccaggaataaccattggcagccttatcttgcatttgcaagaggcttattccacaagttgaacttgtgattaatatttacattctgtgctagtggcgtaaacactaacaacctattaaattattaatatcctgttcaattgaaaacttctacttgcataagttttttactgtcttgggtagcctttttctcttttgaactaggttatccgatgtaagaatggaggagttagaatgctaattattgacatttgatcatgaaatcttagtagtttatgggtttggctgatcacattacttacatctgttttggggtgaggtggagtaaatggaagtgttgaaaagaaacaaaatggagaaaagcaattgctaaaccgtggcctgtctgcatctggggactgttaacaatacatctgaccagatcttggaaaatatagaaaatttgaaggcaacaaaagaccctggctttaatttttctatttgacttagaattctaagaataacatccatctccattccaaaattgaagagaaaatttcttccaactattgaattgaggcatttactaccgtgacatgagcctggggaattgatgttagccacatgaatcagaaacttttgtgtggttgttttgtagctattgcattattttccctttgaactttggttctttttttttttttttgagagagagtgccgtggggctgctgtttgactgatctgttgaaaattatagcttccttcagttgctggaaaagttaaaaaaatgctcaaccgcctgaagttcatcaatgtaatttaagctgccaccgataaatgagtgttatattatgggcatatatacctttaatttttgccaattttgaaatggtttcatatacttgtctcttttttatgaaatgagtatgttaaggctgctcttatatttaacacattgctttatttatttaagctgaaaatattgatttctttttaaattgatcgaatgttgactcctaagtcataacgagttcctctcttcaatcggctgttcttaacttttttaagtgtgctagaattcgcagtctgtgtttgtggtccacgtattttggaccaaagtaggggaaaggtatcttccgcagtcttgtttgtgtgaatgtaaattgtggtacaagaaactgaaagcgctttagactttagttagaatgtatgttttccccttgcatgatcaggtcttttccctaacctttacaattttcatagtccaagaatccatgccgcctgtaaattcacacaaggtcttgttctctaatgtggattcaaattctctatatcataggacaataataagctcggcaactcaagtctaaatttcacacatccactccaaggcttgagctaatcatagcatccataagtgatacatgatatcactttctgtttgaaaaactcaaatcgggtgttaaatatctaaaataaagaattgaaacattttgccccacataagtggcttatgtttgattctttgcctttatatgaatcatccttgaagttcccatgaagtcattctcattcccttaatgtgctttaatttttgttttaggcttgatttgtgctcgtttccattagcttaataatattctcgtatcactgcctttctgtttctcttcattttcctcatacatttttgcacaaccacaccatgtctcatcgagaaaccaaccctcatttttctagatcatcacaacctgaatatatagataatcgtgatacagaaccttatccacttgtgccacgccgaaaacgccgagaccaaccatccacacaagtagctccacctataccagttgcattgccacctgagcatgaagatcgtgttccattacgaacacgacctcagcatgaagaccatgttccattgcaacctggggtagaagatcatccacacccaccaccacctattctccaagagcctcgccgtggcaagcaaagaagtccacgtagacagaatcaaggtttcttgccagttaagtcaaaggtaaattttcaagaaccacctccctcggctgatgtccagccaccgctgaaccgtcgccccgagcattggcaccagccacgccacgatccccgcctcagtggtataaagttgcccaaggagcaaaagtctcaacccttgacatggttaggtgcttgcttgtgtgtgatattttggctcatcataatcataggaggcttaatagtccttatagtgtacttcgtatttcgcccccaaagtcctcattttgatgtgtctagtgtgaccttaaatgctgcataccttgaccttggatatctactcaatgctgatctaaccatgctggctaacttcacaaatccaaacaagaaggtgcatgtggacttcagctcagtgataatttatctctactatggaagtacccttattgccactcaatatgttgagcctttctatgctgcaaggcttcaatcaaggtttgcatatatccacatggtctctagtcaagttcagctgccattaagagagagccagaggcttgtgaaacaaatggaaggcaatggcgttatccttgaagtgaggggagttttcagggcaaggtccaaattgggaagcatcttaaggtattcatataatctttatggccgttgcagtgtcatgctaacacgccctcctgatggtattttgctcaaaaagaaatgcagaacaaagcgctgaagcaataatttagcaccacagatgatgattctatatgtcattggtattctttttttagtccttgaaaattggggggttttggtctttcttaatttgcctattcctcctgaaaaataacatctttgaaggctagcctcttttttccctccccaccacatgtagttttgttaaaccacaaatttgtatcttattttttttcttctcgagaattattagagattatttattataaattagtaacagcttctttaacattagttcatactatattaagtagtagaagtttcttaagggtgtgtggctttttaagttttcacgccaagtatgatcgatgttcaatggccaataaatatcgcgcttttttatcttatatcccacaaggcacagaccagctggtccaagatttgtcctaaaaagtgaaatgcttatacgttacattttatcgtaccaaattgcacagcgaaaaattataacatatgctccaagtttaattaatgctccaccatcatgactccgccactgttgtaagttcactgcatgctttagcgtttttaatttcacatttaggatatgatttttaaaaattaataattataactttcacgtctcaaatgcgattcttttattctcaacatgtttccaaacatgttaatctatgcatacatgagcaacaacatctttggtgttgcgctaggacttgagatggctcatcaaatatgtttagaacattactaccagtttaaaaagattgttccaattaacatgacatattaattgttaacatttgctcataaaaaaaaaattgtttcaacaatgtctacacctaaaaagcaaaataaaaacaacatatcttgccattaaacaaacatatgtcgacaagattacaagacatgatttttcttagtcacaccactaatttagttttgtcctacttaggtccaattttagttaaacccgtatatttccatacttcttcaaatctaatgtcgtgaaagttcaagactaagtgaagatctaacccggttgaggaacacccccttaatatgcagtctcttttaggatatttgttctacaccttcctttgcaaaataaaatgtcaggatctaatcggtacagaagcaaaataaaggtaaaaaagaatcataattaattttattagtaaaattgtattgaatatatttgataataaaacaaaaagagggacgattgaatgtcgtccaacgacgttgaaaccgctatagtttctagagatttgacatgttgagtggttgtccagcccacttgttccacctgttccaatatagacttgctagggagacattgacgaatacatagatcccccaaaaaccaatttgttcaatggaagaaacgtccatacagaagccgacaatgctgtaactcgattgacaaatagggcaccgacccataaaaatgcactatattgagcagatacagaaaccagggttacgcttactgtaatgtaatgacagtgtatttgtttattgctttcatgaaatgttcgttcaaaacaaccaaagtacaatagctagctactcaagccggaagcaggtgcaacatcataatgcagggaaacggctcatctgaattgagaaaacctctaaagtgaataagtgaagatgcatgttatgttaattaaaattaaagtgtttgatgaacttaacttattttaattcaagcgtgaacacaccctcacttgtatacttcagacttcagagactttctcactttacagtagcctaatgctcaaccagtgaccaccatgacggcattctaagagatggtggaacatgttgatggtataaactacaactttgtaacattaatttgaagaaatcaacataaatacacaaaaaaagagagaaaagaataaggcccaattataatagaggttcggaaagttccatttcgttagaagcctcctgttgtgtatcgggacgctgctgaaatccaacaaagtccatgccgagccactgccatggccaacacacatatctaggtcgattactgctccttgaatcttccctgttttcaaactcttcgagctgatgagtaagctcctctactctgtctcttagtctagatgacctcaagtctgctaacttaagagacttttctgctgcatctctggctgccatggcagcagcagctgtttcttctttgaaatttagtttcttctctgattctaacatggattgctttgcctcttcaaattcctgcttaagtgctgacaactgcagatttgcagacagcaattatcactaggaaaattcgatgaaaaaatacaatagcattgaaaaaaaaatccaccaacaggtggctttctatgatatcaacttgcttagttacagcaattttttttttagagtgagatgataatgttagagagccaagggattgcagtaacggaattcatggaaaaaggatgtcattagtagtagatataaaataaaaccagctttcaactaaaaacgtagaagctgtttggtttgagaaatcagaaaacaaagtgaaaataaggtaacattcttataattaaaagtaaaaagcagaaaacattttcccaaaccaaactgatcacttaaattcttgggataattagctcatgacatggtgtactaaagtgttcacggaaacagggtctagagttcgattgttgtagtccccattcttctaaataaatttcagctcaaggtaggacaagtgatagctcttgggtatcagagcattacatgctgaaaagggacaatgaatggaggaataggagaatctagaggaagaggactttcactccagccacggcctcatgaactattcttattggtcattatgaaaagcatgcataagcttgtcttatgcatatttatacacacgaacgtaacaactcagcgggtagcatttgcagccattctaaccatccaaatgactaactagactcagtcacaacaaactaacaactactgctattcatgtgatcattcagttcttctccctgagattcctatcggtgagcctgcacactatccacactataggcccaaagggttctttcatgaggggacacattagatatataaaatcattcataggcttccacccaatatctaaagcttttgagatagttggttcatgaccactagcaaccagctactagctaatgtatttagagcccatttgttttaatgttgagtggaattgatcttgataaaattaatttgaatcaatgaacataattaggatgtgtgtccaattaatctgtcataaatttacattgggacatgtgtttttcattgaaaagtgcaagaattgatttttcacaccaaaacattgcacaatcaaagttggactgaaaaaaaataataaatcaaaatttaaaaacattaaactctaagaatacttgggcacaactgaaaatttctttttggtcacatcctccaaatatagcaaacgtgtcaacaaatgttggtaatgaatagcatacctgtgccacaaattcttgttcgacgcctctgcctgcagcagcttcttgctctgctgccactttccatctgttaatttcttcttcagcagcagcaatgtccatcattagtccctcaatctacattacaaataggccaagttgttactttgtgacagagaagtacaaacaatcaaatgtgccttacaaattatccacagcctaggatacacaacaaaattctacgttctacaatatacaaatattaaagataaaactgtttatggttaaggaactagatcaaattaaactcaaacaaatttaagcttacattttcatttgccactctctccttctcttcaagttcctctacccgatgcattctatggtcaagctccttggcctgagcttctatatgctgcttaagtaagctcaactctgcccttaatgcagttaagcaatatgcaaagaaaaaaagttatgatgtcaacacaactgcaaattgcaaatatgcaagcaactatgcatttaattctgatgttaagtaccttaattcacccacagtatgcttcagctcaatgatctcaagctgagatgcctttacaacatcctccaaagcaccagcctgcatgcatgcacaaagaattcattgatgggtcttcaaaatgcaaagtacgatgggaacaagtttcattaaaaactagaaagagaaacgaatgcttaaccagggagtatatttcatcctcttctttttccgttgtatcagacttgtcatttgaagctgcaactttcccatctccaagaagcttactgaatttgaaatctatcccagcctctctcaacccattctctgcagcttgaaacagctcactctttctagaagacggatcaactgcaatcctcttagacaaagcactcctaagaaaagaaccaatttgatccttctccctaactaaccgagccaccgtctcatgtaaactcttaacctcacgatccttctcctcaagcacatccttagctttctgaacagcaatcttggtcaactcatatatggactccatcccagacaaagaggcacgaatattctcctcaacatccgtttcttgtgggacaaacaacgattcagacagctcttcggtgctaccgtggtcaattatcctaacaacattgcaaatctggttatgaatttttgaaacaaaactcaactgatcaatcaacaaaggcctttgtgattccatccgagattccaacttactcaacttctcctcacactcaccaacaaactccttcaaccgcaaagtctcactttgctccttgctcaaattctccgaaacctcattcagcctctgatccctaacagctaaatccctctccaaatcctcaacaatcgaaaccttctttgcaacctcatccctcaagccactgatcgtggcctcaagctgagaaacctcaatggcaatctcgtaattccgctgttccatctgctccctcgcctcgttcctagccttcgtggtcgcctcgttctgcttcaaaagctcctccacgatctcgttcgcacgcttgattacgccgtacgccaccgccgccatgccggtgtatttctgcgaccgcggcagcgctttgccggcgaagctgctcaccttcgcggagatcttctccatgccggtgaccatcatgtggctcgaattcccaatctccgatcgcagcgcgtcgcgttccttcgcggtttcttctaattgcgtcgccgtcgcctccttctcccgaacggcgtcgtctcgctggcgaccgaactcgtcgcgcttctttatggcctcgtgtgccagcgccttcaatcggttgaacgaaacctgtagttctgacttcgtattctccgcggcaacgcgcgcttgccgctcccgatcgagctccgcgagaacctcccggaatttctcgacggagacgtcttccggcgagggaggcttcgtggcgatcggaatcggatcgccgccgtcgtcctcgacgtcgctgagcaccgcatcggcgtctaggtcgccggtgccgtccatttaatgtaatagcatatatacgaatatgtgataaaccctagaaattggagcgaaccaacaacatgggagtataaagtgggaactctaatgaaatgtgattttgtcttaggttgccgatgattgatgaagaaacaccgccacaccggacctaccagtcagtcagcctctgaagaatttcggattgataattaagaatttgtctattttttgaatttcaatttcaattgaaaaatagtgctgctgtggtgtggtgttaaaataaaaatgattgtttatctgttttaaattgacgaatgtgtaagtcaaggaaataaataaaaataaaatagaagagaaaggaatatgggtggtggggataaggatgaaaaaatggatcagtttatctaaaaataggttggactgatccatttttataaagtgggttaaaattattagtccgtttcactttaaagtgagttaatcgattagtgagtcagttcatttaaaaaataaaaaatatatttaaaaaaaacataaaaaaaattataaaaaattcaaataattatttatactaaaaattaataatgtactaacttaatcatataacaatgatttttaatataaaatacatatctaatagaagtaaaagcaaacagagaatacatgtctaacaatgattttcaattagctcctaagtcttaacatattcttaaaaatttgtttcaacatgatatagacaatctaagcatatttatacacgtagtataactcatcattaggtttcaaataaaaatatattagggttacagatttaaaatcactcacttcttcttagtcactcttattctaaaccattcatttaatgacctattatattttattttttttattggtggactgctgatcgacctggtaggctggtccggtcctgacccacatttggtctgacccatttattaaatgtgagttcaaaattttaacctgatccatactttcttgcgggccaaatagactgacccgttagatcaaactcgttttaccatcctaggtgaggaagtggggaagtgtgtttcacggcccggcgatgtgattggacgggcctgatttaggattggggaagtgaagatggcaatggtaggcgtgagggcaggggattggagtgatggtaggtgggacaaaaaggaaggaaatttcgtttgcaagggatgacacggagacagagagagactcgttgaggccaaaacgagcgtgggctgagatttgagactgctccttcatgccacggaacgcataatcattatagttttttctctcttgaatatcactgtataataggattttagtcctttagagattttttttagttcctgtttttactttagcaatattaaattataatgttacaataatatttataactcattgacttactgtgcacgtcccttgatgtgtatatttttttcgtaaattatattttgaaatttttatctatttaaaataatggatgacatcaaattaattaatacaatatttaaaaatataatttataaaaaaatgtaaatgtatgtagtaatgatgtgataaattaatgagatgcttatatgtgttaagtcatttattagcataattacttaacaaaagagactttactgaaattataagagattatactagtaagtagatttcatccttttatgatgcatgtggagtcacatctagagagataaaataagatctgttaaaattaaattaaaatcttaaattttttcaaattagaataaaaatattcttaaatcctatgtagcaataacagatccattaaaatagagttaataactcaagttaagttgttgcattaaagcccttaatagtgggattgatttaattagtttggtttacgaggtatttcttggaagtttcggtccttttgaacagtgggactcgtcaacgtagcaaaatgtatattgacatttcttatcagcggtaaatatttacgtgataacaccaactctacggagaaggatcgaggaaaaacacaagtgacttccactttctattgaatgaatgaatgaataaataaataaataaatacaaaggcaatttcttgtctcaattgctaataccattccaaattgacaatatatatataattgcttacttgtaaaaagaacattcatttacttattgaatgccgatgtaaacaaagcttctcaactaaagtgttaattaatttgtcctggagtatgattttaaggcttttcccatatttttataatcatagactatatataaactctttaggcttgtttgaataggaagaaaagattaatcagttgttgttgacttgaccttgctagctagtttccttccaacaggagctttcttaattcgttgtcctcttccttctatttagttaaacaaggagaagctattctacttgacgcgattagcgtgagacattgattattatccagcgtctgttgttaattctctcacaattcatttgcaattcttgtgtggaaacaatgcttctagaggtatggaaaaaaaaaatgttctgagttttaagtttcattgtagcatttgaggaaaggttgatacagtcatcatttgtggaaaggtgtcatttgattcagtcatcattgctccatagttcagcgcctcagtttatttttctctttcttctctttcatatttgccagttttttttttggccttgaaatttcttgaacaaattttcgtatgcgtcatttacttttagtttcccagaatttgtattttactgctagtcaaagttgtaaggttttgttttcttattcagtgttccagattggattatccgtgaacatatatatgcgatgcttttagtttaacatattgtttgcaattgcagctagagacttggacagctttggttgttatgtttttgcttttgttgattctaaaggagtcgatcatgggaggtaagagttcaaaagggtctgaaagaaggcatgtttcatcatatggatctgctggttcttcatattcacgggatagctatggataccctcaatcaccaaatgcatacccacaacaaaatccttataatacgcctcttcaccaccgtgcacaagctccattccacgactattcacagccaaaaaggaggatagataggagatattcaagaatagctgatgattaccattcactggatgaggtaattgttgtgatttgtttacgtataattgtgtttttgtcatttgcttaggttagatataattgtgttttttttgtatgaatatatgagtattttttcatcatttttggtttgttctgtttacatcattgactttttgtgtttggtaagaaatggggttagggacataatgaattgatttgaactagtatgtctatctacttcctacctgaacggcatcgatatttcatcagtcaacacaaaagggaggagaagaaagaaagaaagggaatcagttatgttctttctgaaatcagccttcaaatttctgcctatgatgatggtccacgttaaaaatcgaaatattgaggttcttaagtcttaataaggattcaatctaacaacaaacatgtttccccacagaaaagagtgttaaaatctgtgccgagctgaaccatcaaatggatctgtttggggctttgtgtcttagaaagtgggtatggacctaactcaaccccaaaagttagctcataaaatgagggttgtctcccacttatatactattttggcattatctctagccgatatgtgggacttgggttttccccaatacatcccctcacgcccaacacttttgggcttggtgcgtggataatacagtgggtggcccgttaatagatttaggatagactctgatatcatcttagaatgtgggtttggacctaactcaaccccaaaagctagctcataggatgagggttgtcccccacttatatactattttgccgctatctctagccgatatgtgggacttgggttttccccaatattggggaccatgttccaggagaaaaaaatgtatagaaatgctggattttgcaaaaaaaaaaattgcgagacccttgcttagaattgctatatttttactacaactccgagtaaaacctttatatatacttgtaaagtttcttttaagcagacctttatacttcagcagatctttgaagttggcatgagctttaaatccaagccatagaatatagttaaacaagttcagctgaaatgaagtggcttaagaaaagctgctacgaaaagagacaactgtctctcatttttattgttcttcctgatcatgcatgcatgaatcagcagagcatcccttaattcatttaataatatgagtagcagtaaacatgttatcaacgtctgatatgtccaaactagtccaagagtgcaatgcaacaaggttggtatgagaaaatatttggatgaagcttagagtagattgctttattttactttttttcttttctcatagtgcaacaagaccagcatgagaaaatacttattggttgtttcactccccaaaactttcattcttacggttattactcacagaagaacaccttattttgtcaaataatgaaataattttgcacaggttaccactgctctttcacatgctggcctggaatcttctaatctcattgttggcattgattttacaaagagcaacgagtggacaggttttatctcttagtcatatcttgatgcttggatttcttgtagtgagttgtggtattaattaaatttgcataaatcactttgaaatcagggaagaggtcattcaaccgaaaaagtttacatcatataggaagtggtcaaaatccttatgaacaagcaatctcgattattggaaaaactttaagtgtttttgacgaggataacttgattccttgttttggatttggagatggtaattccatatataaatattcatgctttcagattgcttatgtttcaaaattgcaaacttgattgtgtttctttcttgtctttttcctctgacagcatcaacacatgatcaagatgtcttcagtttctattcagacgagaggttctgcaatggatttgaggaagttttgtcaagatatagagatattctccctcgcctgcgtctagcaggtgttgccttcaccaataatctttcattgcatttttgacttaggctcagcatgactcattgcatttatgtgacaggacccacttcatttgcccctattattgagatggccatgactatagtcgagcaaagtggcggccaatatcatgtcctgctaataattgctgatggacaggtatttttaatacatatttcacaaaattgaaaagaagatttttttaaactagtgtaaacgtgcatcagtcatcaaatgtttcattggccgttatcacactaactatatgattatgactctaaaagtatcatagattttaaataaaaaaaaaactaaaatggtataggtttatgaaagcatttttttgtttggtttcttttgttagtgataataataatatctaccttaacacaaacatcttggcattgatagctgcagaagaaaactgctaattgttagattgttagattagcataatgtgtgagttctgaaatatgtctgtcgccttcttcactacaatattttgctaagattaattggatacatgaatacatctgaacaaaagatgaacttaaaatgcccttaattttgtcagtgcttcaacaatgattaatcttttactgtagaaattccttttcttcttatctataagatctaaaaacattgatacttaaaatattgcgacaggtgaccagaagtgttgacacacaacatggccagctaagtccacaggaagagaagacaattgatgcaattgtaaaagccaggtaaattttgtagttttcttttttctggattgccaccctgcattctcatactctttaaattgcagtgagtatccactttcaatagttttggtgggagttggagatggcccatgggatatgatgagggaatttgatgataacatcccagctcgagcatttgacaattttcaggtttggtgtaattcacttagtcctattgacctgccacggttacttcttcatagtccttcatattaagctgaaatgtgaacattttatttttggctgcatgtagtttgtgaattttacggaaataatgtcagagagtatagactcaagcaaagaagagacagagtttgcactatcagctttgatggagataccttctcaatataaggcaaccatagaccttggcatattggggtaataaatgaatattatatagaaaaacaaggtacttatagcatattaatgaagattttatctagatattaactgaacttgcttcgtgtcttcattgatgaaagtagtgcacggagaggacattcaccagacagggttcctctacctccacctcattatgagatggcttccagcagcagcacaatacctcttccttcaaacagttttcaacagaacacaccaacatattatgataatgttaacgcagaatcatcttcaagaaacttatatgataataaggtactatttagaccattcttttttcaacttaagatgtgactttcatataatctcgagacatatgacgtgatcatcatgattcatgatgtttctgtgtcacaagaagtcaacaatggtttacatatgacatgattaaccgcaggtttgcccgatttgtcttactaatgataaggatatggcatttggttgcgggcaccaggtaccaagttgaattatattctaccgattcatcttgatgaatctaagactatatgattaggacattatattaacttttctttccactgttgttattttctcacatttggcagacttgctgtgtttgtggagaaaacctagaatggtgccccatttgccgaagcacaatcactaccagaataaagctttactagttaaccttgcattgcagaaaaaaggttagttacgtttaaagtttaaacaatgtcataaactgagtgcttaattgttatcataagtcaaaaactaacgtgatatatcataggcagggtagcaaagagaggagcagggttagccaggctcatggtggtggataagtttttagatttttgcctaaccaaaactgcatttcgcaattttgaacaaaaataaatatatgccagggtaggagctaggaagagttgtgaatgcgcgttgcctcattgtacatttgaagtttgtgcgtcccaattaggtttcatgttttgatgtaagttgcttgtaaaaaaattcttaggtttttttaagtatactatttgtttttgttttcttcttgtatgtaaattatacacgtcttggtctcacagttcacttctttatcagtggcagcctgacagtcactggtgttcctttgacaaaatcaccataaacaacaaaacacgactaaataaaagagcttgtttattgtcatctgtcacagactgacacacattcgaaacttgtaaattactataaaaaaaacttttttttaaaaaaaaaaaattgaaacacaaaagtggatttctaaaatctaaatcaaattatttttaatttttaaaatttcaaacaccaacaacaagaagaaaaaaaagctacgaagaaagagatgcgcaatcatacaaagacacggtataattgtataacaaaatcgagcacagcacagattgtagtaaccaatagccataccaaaataagaagcaatgggcagtttattccactgccttgcattgcaagtgttgcagtgttccccgcaattcaggtatgaactttgttagccgttattttctttttatctcgaagcgaaactattgagtgcacgcacgatatatacaaattaataagtcataattttctgtagaaaatgcagaaagaaagactgttgccaaaggttgcgtgatatatatcacctacccaattattacgtagcactacgtttaagttcaagtgtttattaaacttcaaactagcgaactagatggagtcacggtacgtctacgttactattacaatgcaatcacataatgcatttcggatataaaactacattttttatctcttttttttccaacttttttattacatcccttattatatctatcatttttttatcttcctatccttccctgtctcaatcgaccccaaaatgaagtgtgggtatacatttttcctgcatttacgatgctaataatgcaaaacaacacttagagaatgggatgataatgtgtggtttccagataagatagtataatattcgttcgtatatttctgtttaaaaataatatccatatctaacttcatatttaagtaagtaataattttaatcctcatctttctattcattggatacttatgtatttatgtatgtatatgtgatccacaatttccttatctacaaggttaataataataaatcaataaaaataattaaaataattattacaattataataaaaatttattcttaaataattcaaacataacattaaaatacatacacacataatattaaaaacaaataaatataatattgaaacgtccaaactcaagttataaataaataaaattacaaagataatcatctaacatattgattattaaagttaatgttgtaatttgttctaattgcgtatgtttgtaaatatacatccgccagtatagagtttcaatattgtggatcattgtccgtttcgcttgtaaatattttaatggatacggtatgattcgagtacactttatcatctcttcttagaggaaaaaagaaagtatacaagaagaagaagaagcaatcaacaacattgttttactataaaagttagtaggatgttaaacataaagtttatgggaggaaaagcagtgtcatattaattgttggagtcactaatatgaacaaagactcacacataatgccataagaattttagttgaaggtctgacattaaattcacttgtgtgtttcatgccttgtttaatgaagatgtgaagtgaaagttgttttttgaagttagaggtattcataaaaaagaaaaaatatcaattgagttccttaaccaaccgactcaaatttccttattaatttatttatttttatttatatgcataatacaatgccattttggttcaaaagaataattaggatcggaatcaagtaatataaattttttctctaattttaaaaataatataatatatataacaaatctaatataatctaataaactaaaacataccaacccattcttgataaatagtttggatttaatttattaaaaaattaaaaattaaactaatatattttaatttaatttgtttaattttcttttttagacctaaatcaaacccattttatgaaccctaatcgaggctgattaaccgtcaaagaaaggaaaataagagaaaatcatatttacggagtcaggattttcaaatggaccagttcaacacatataattggtgaaggatccgagaatcaatttgtttgtatttatatgcgttaaaaaatctgattagtcgtgcaggttacatcatatctcaataatcaaatgaccacatatttttttacctttacttatttttaaattaacattgcatgacttgtaggatgaaatgtgtggtaacttatatatagttctttttttcgcttgaacttaaaattaaaattaaaatgcccttttgtcttcaccagtgtattttttaggagtgaaataaaattcagaaactttcaaacactggatctcattatttacactgactcacaataatatatagatattaaacttagtcacacacacatatatatatataattcattatcaagaaaattaataaatatgcaagtagccctcaccttaaactagtcaccttgttcacctggtgagacatagaaattgaattctcttatattattgagtaacatgatataattatgtacatcagaaagagagaaaaattgacacaattttttatttatcaactagaacttatgcaatctatcatgatagattgtaggatccatatatgttataaggaataatttaatgaaaggaacggataaagatatacttctctgttatattataattgttaggtaagaaaaaaattatcttaaaataattttaattttaatataatattaattattattttttacttgtatcttttatatatgaataataataaattataaaatctaaaaatgaattaatggtaataaaatattaattttataaaattatttgtttttatttatttattattatttttaataaatataaaataactttaagatgataaatattttgtaaagtattactttaaaaataaacgacaaaatgacattaaataaacaagttgcttaaacttaaaaaataattttgttgccacatgtacaatcccacatcctcaagttatatattgggcttgttcaggcgtgcagagaatctcacaggtgcggaatatgatggcataggcaaacaacagatgatactactgaagaaacacgaaatgggaaggtggtcatgcactttggtcttcaattttgtctctgcactaataacaataatattgctctccggacccatagttgaagttaagggtcttccacttcacacggattcacgatggatcgtgaacgaagatgggcagagggtgaagctggcatgtgtgaattgggtgtcccatttggaagctgtggtggccgaagggctcagcaaaaagcccgtggatgtgatttcaaagggaataaagtccatgggcttcaactgtgttaggctcacttggcctatacttttggtcactaatgactctcttgcttctctcaccgttagaagctcctttcagaaccttggcctccttgaatccattgctggtgtccaaaccaacaacccctccattatcgatcttcccctcatccaagcttttcaggtaaattgtttttgttatcatattcaattcaattattttctttgcctaattaaccaatttgttgactaatttgaatcacctcatcttccttatcttctttgctattaatcttatcatcatgatgtgttggcgcatatttgatggcgattgccttttggtggttattgaaaacagctccaacctacttccttattaattgccatttatgttgcatatagtgagtagaatatgtttttgttatttgtcttaatttacaaacaaactctcgttttatactttctaattccaatcaacattgagcattaaaaataattagtaatttaatttttttaattttaaataatcatatttatgagtttaatgtctatacaaacccacacgttttctccaatttcttccttcttaactacttaactaatcttatatctctcatcattataataaattgattgacttttatgataattattttaaaatttatatttacacaattgtgattgaatgatactaaaaaatattttatattgtagacattaaactctttattttattataaaataattttattaactaaattcatttttctcttattttttttataaaattattatgtttatattggacagtttcttggtgggtatttttaagggtgatattttttaagagtccgaaccacactctcaactaacttccgtatagtatgagtttgttcaagtttgagttgagtgtgggcaacattttgtgatgactacaggcagtggtgaaaagtctcggggacaacgatgtgatggtgatattggacaaccacataacccagccagggtggtgctgcagtaactccgacggcaatggattcttcggtgacaaattttttgacccaaaccagtggatattgggcctcaccaagatggccaccctcttcaatggagtcactaatgtggtgggcatgagcttgaggaatgagctccgagggcccaaacagaatatcaacgattggtacaagtaagtgctcacagtcaaagtgtcttttttttttaagaaaagtcaaagtttgtataatactttctctatttctataatctaaaaggaatcatattaatattgtaattgtgggtcgaacagtatgcaattatcaaaattaaagtaaaatagtgtttttacatgttaaattgttaatgatgttgtctctcttatgtgttagctagatgtggtaatatgagttggttagtcccatcaaaaataattgggttaatatgttctgtctcacattttatatatagattacagattaaaagtgacaatccatctcatttttggttggattagtccgccaaaactaaatattaaaataataataaatatattttaattgattttaattaattttattttttataaatattaaataataaatacttattaaaaaattaaatttattatcttcaattttaaataataatttattttaaaaaataattaaaaattaataatatatgtacaaaatatcaaaataaataatatcttttaataaaaaagggttggtggattgatccacctgattttctctcagctcgttttttgactgacaaaaatggaatgagtttaaaattccaacttgaccttaaaaaaagccaaaataagtagacatgataagaccaatccattttgtcacccctaatatttgctagagcatctagattttatgttcaatattttgttgtattgatgtcattattctgaatgaaataatataagttacttgcagtaaaaaaaacatcctctctccctctcttttttcaaaattagctggtggctggtgctagagtaaatacaattttaagttacttgtaactgtatgagggataaaaccatggtttatttaaaattagaaagaaagaaaaataaaagagagagaatcctcatgtgactaatatgttgttctgaacaaaaggtacatggtgaaaggagcagaagcgattcatgcagcaaatccggatgttcttgttattttatccggcctgaattttgataaagacttgtctttcattcaaaaacggccagtgagcctgacatttaaggggaaattagtatatgaggcacactggtatgccttcactgatggtcaagcttgggttaatgggaatccaaaccaagtatgtggacaagtggcaggaaatatgatgagaacctcaggctttttagtgaaccaagggtggccattgtttgttagtgagtttggtggagacttgagaggtaccaacgtgaatgacaaccgctaccttaactgcttcttggcagtggcagctgagcttgacttggattgggccttgtggacacttgttggtagctactactttagacaaggagttataggaatggaagagttttatgggattcttagttgggactggacccaagttagagataccaatttcttaaacagaatctctgccctccaacttccatttcgaggtatgtagtacataatttgtgcaaatattcttttcctaactctacactattagttggttgaaaaatatcactaccaatttactactttagggaaactttgataaagctatgatttttttttaatcctaatccaaagttaacgactaatcacttaaagatattgagatctatttaaaaaatattaactttcccaaaatatgtttctgtgtacgcacatatctggagatcgaattcttaattatatacttaaggatcaattatctgttaaccatattacacattgatagagatatcatataaaaatgttcatgttactaaaaaaagtattgagtttgctaccattgatgtatatgttgttcaacaaaaaataaattgccaatttagcacttcatggaaacttgaactacatttctctctgttgacaacatgcaggtccaggcataacaagaggcaatccatacaaattgattttccatcctttgaccggtttgtgtgtcataagaaagtcattactagacccattgacattgggtccttgctatttatctgatggctggaaatacacaccccagaaaattctatcaataaaaggaacttacttctgcatacaagcagagaatgaagggatgcctgcaaaacttgggataatatgctcagatcctaactctagatgggaaatgatctcagattcgaagttgcacctctcatctaaactcagcgatggttctaatgtatgcttagatgtagacgataacaacaacattgtgaccaatgcttgcaaatgcttgagcagagatcgtacatgtgaccctagtagccaatggttcaaacttattgacagcggaaggagatcaatgttgacaacctcaacatcatccatgctaaattcatcagacctttatggaaaccattaagctcagcataagttgttttaagaatattaccgtaaatttctctaaccatgtacttatgttttaatggcagggaagtgatgcattaaacatgtccatatatatgactattgaattcaatacatattatatcactattaaaatatgtacagaatttactaacgttggctaggatttttggctcaagaccagggcaccattgctaaacgacaccaaagtcaacatagtacattgtgccatagagaatattatttcaggattgtgatcaaagcagggatggtcaattatgtaatcaataaaataaaattaagaaatatatttgaagaggataattaaaaataaataaatgttaatatataagattgagataacacgtgactcaatgacaatgaaaataactcctgaaaaaggttatcattaaataatatctcctaaaaatacttttattcaataagtattcttaaaaacattctcattaaaaaaattcaatgtaattatatagaaataaatattataaaaaaatcaagacaaccttcctaaaagattgttgtcaaaaatattaattaattttacttaataaattttaaatactcattttaaaactatcaattagtacgaagttgaaaacttcttacatgcgtgtttctttactacctatacgccgccttgacaaaaagattttagtccttgattttgcacaaccttccaaagctaataaagaagagttattcacctttatttgtataagatgaattgtatatgtagagaaagaattatattcacttaataactactacactttttcttttcgtcatggttgcatatactttaggggaatcaatctagtgagctacttggtacatttactttcttaatagcgagttagactttctttcattaacatttataaatgaaaacgaaataaagtttatccataagctcagacaacttcaggggtgtgaaaaaatcgatttggtaaaaaaaaaactaatctgaagtggtttcaaattgtttgaatcggtttaattttacatttaaatagtcaaattaatttagaaaatcggttcagaattagaattggttttaaaaaccgtttatgaaccaaattgattttaaactaattataagaatcaaacttatttcgcactgaactgatttttttcaaataaaaatcaaaataattttggataaagatcgcttcagtttcaattcaattataatcatgttttgtttgaatcaattttttttacacccctagataacttatatgtataaattaaaatgagtttttagagaaattaaataataaaatttttacaaattaatttaagtataaaataaattatatatatataaaaagtttaattattttaatttttttcttcagaagtttatttaaacattttttagtacaatatattttggtatgtgatttctgaatgtgaaaaaatcatgtgaaacaaaggagttactcatatgagaaagatttggaaggtacataacaagatatatagctcggaaagggaatactttaagaaagacaatgacaaaataacagtagacagaaacacaaattccccacatgtatatatagacatcctattcctatgtcttcaataaacaacatattggtgtctcattagctcgcgtggaatatcaaatatcatatgaaatggaaatgggtaagtggtggtcgagcacgttggttttcgctgttctctctgcatcaatactaataatagcattactctcctccgatgatcacacagtgcctgtgacgggtcttcttcacacggattcccgatggatcctcaaccaagatggccaaagggtgaaactagcctgtgtcaattgggtatcccatttggaagttgcggtggcagaagggctcagcaaaaagcccgtggatgtgatttcaaagggaataaagtccatgggcttcaactgtgtcaggctcacttggcccacacttttggtcaccaatgactctcttgcttctctcaccgttagacgatcttttcagagccttggcctccttgaatccattgctggtgtccaaaccaacaacccctccatcatcgatctttctctcatccaagcttttcaggtaagtttaagttaattacttctatttcttacccaactcagttcattcataaatcaaccttaccaattcgttgactaattttaactacctcatcgtacgtgtttttttagttattaaatcttgcacttgatcattgatgttatcgatcggtgacgcttatccgatagcgattgacttattgtggtttttgataattgagtgcttcaatcaactaatttgctatgggccagcttgccatgtaaatgtcgcaatatccttattaaattcatcattgttgacgtgaacagtgggctaacctattttttttttcttccgttagcttcttattacgtcatgcatgcataattaaattgctaattttttttgttttattgaattttcaacaatacaaaatatttgctctgtaaaaatgtttttttgacttaattacatttgttgatcgttttatttgaaatatgtatattttggtttgagctaatttgatttctgtttttaaaattaaataaatttgttcttctattgattttcttctacttgaattttttaaattgttgttttttattcaaatgtttgagaggttgatgatttagtgagaaaaaaaaaatttaaaaaggataatgattaaggttaaagagaaaattaagaaattgattttttttattttgaacaaaatttgatattttagtgagtgagttttgagtaaaagaatatttataatcattaaattttcaaagattttaaaactaaagatacttaattagtaaattaattcaaagcacatgtgaggaactaaaatctcacataattcaaactaaagagatttaaaatgtaattaaactataatgaaactaaagaaattatggtgtgacatagttaagagataataatgtgttttaagtatatagtatagagtttaatctctatgtggtgaatataaaaattatgttaaaagggatcaatcctcgaaatgaatcatagttttagaaattaatccttaactttggacccaaaataattctgaatatttgtatggccatgagttgagtgtggtgcaatattgtgtgatgtgtccaggcagtggtgaagagtctcggggacaacgatgtgatggtgattttggacaaccacgtgacccagccaggatggtgctgcggtaacacggacggcaatggcttcttcggtgacaaattttttgacccaaatcagtggatattgggcctcaccaagatgaccacccttttcaagggagttacagcagttgtgggcataagcttgaggaatgagctccgaggatctagacagaatgttaatgattggtacaagtaagtaactgctaacaactacaacctcatcttgaaatggacctaaaatgataatgtgataaactaatgaaatatgtcagattattacctaataggtcttgactgatcataattactaaaatatctaataaaattgaaattatggtagtaaaattaaaataaattatattatagaaatgaaaaatatatttaagcatacaaaatttgtcatcagaaaacaatttccaaacattacaattccttcattgttcgctggcttgttttacaacacggaatcaatttcctacatagttttggtaagatttatggctatgtagatgatttgcaacaccaaatcatattcccaggagtatgtcacaacggaatagtttttaaaaaaaaaacaagaagaaagaaaattcctgtatagatgataattaagttgttattctgaattgaaggtatatggtgaaaggagcagaagctgctcatgcagcaaatccagatgttctagtcattctatctggcctaaattttgacacagacttgtcattccttcgggatcgaccagtgagcctgacattcaaagggaaactagtatttgaggtgcacaggtatggcttcactgatggtggagcttgggctgatgagaacccaaaccaagtatgtggaaaagtgacagcgaatataaagaaaacatctggcttcttagtggaccatggatggccattgtttgtgagtgagtttggtggggacttgagaggtaccaatgtgaatgacaaccgataccttaactgttttctggcactggtagctgagcttgacttggattgggcctattggacacttgttggtagttactacttaagagaaggggttataggaaaggaagagttttatggccttctcacttgggattggaatcaggttaggagtaccagtttcttaaacagaatctctgccctccaaattccatttcgaggtaacgctgcgaccataaccactaattaggacttttttgtacttccttaattcatgtttttgtagtataagcaatgcactcttttatacacttcttttaacatattttttattggttaaaacttattgaaaattacaaaatcaagaaacacattcattaaccttaaaaaaaaaaaaagagataaaattcattaaataagatataagactcataaaattttgtaatttctaataaatttaactaataaaaaagaatgtttttaaaagaatatgttcaaaaaagtgtattataacattcctaacattttctcttgtgccttttgcttttgtactcgcccttttctgttaaagctatttttgaataatccaattttgcacatacttcacaaaatttgcgcaattattcttttccaaactgtgcactattagttggttagaaaataccattattactaatttgtcacttaattgtttgacattgtgcaggaccaggcatcatagaaggcaatccacacaaactgatattccaccctttgacaggtctctgtgtcataagtaaatcacagctaacatcactaacgttgggtgcttgctcttcttctgatgcctggacatacacatctcaaaagaccctattggtaaacaacacggatttctgcatacatgcagaggatgaaagaaagcctgcaacacttagcatgacatgctcagatcctaactctaaatgggaaatgatctcagattcgaacatgcacctttcatctaacctaagcgacggttctattttatgtctagatgtagatgataacaacatcattgtgaccaatgcttgtaaatgcttgagcaaagataacacatgtgaccctggaagccaatggttcaaacttatcgacagtggaaggaggtcaatctcgacaacctcgacattatccatgctgaattcaccggaccttttgtggaaatcattgagctcaatataagttgcttttaagaatttgggtcgatatgttgtactcatcaaaggtatcccttgcttacgttttaattgcatgaacatgatgcagtaaataagcatatccgtgtgaatattcagtacatagtataataatagtgaaaatgtataaatttattaatgttaacgaggatttttggcttaaggagcttgaatgttgcccaacaccaaaatcaataatgtgttgcggagaatcttgttttaggaggtgataaagacttggataaaatgatctatgtgaacgaaattttcatgaattcaataacacaaatattaatatggtggcaacttacgttgtggacccaacctaaaactttatcttataaaattgaacaaagtttattttcgcaaatcctttacatgctgccaataattaagttattgaacagagctttagttccagttaaaccctgcaagtttcgaacggtcaatgtcatcctaaagtgacagcaagtatatccttgcaaactattttcacactttaataaatagcaatgattctttcgcatcatagaagttacgaaagatttatacctttcttgcaataactcgtagcttgtgattcgtctttgtgaatttattatacttttgtgtgttggtaatttttgaaacgtgttaggttaaaagtgcatgtgaaaaaactactgatagactaacaggttgccaatataatgaatatatgaaagttacgaatgaaataacctaaaaagtttacagcactagtgtgatttcatttttatctgacacaagataataaaataagaaagccataaccgatgatgaaggtataaattcgacaaatcctttatctgatattccaatttcctttcttactttgtgatttgaaaccaaatacaagtaaggtaaagattcaacaaaatttggcatcaatagctatataagaagccactggcactaactagcagtgtagcaataaccaagcccaaattcatcgatcctaaacattatctattttgatcttcttcctttcttgcatccttaatttccgttatggtaatggtgccacggaagatgcaatcggggcctaggcgccatattttttcagcatcagatgacactacaatgaccaaacatattcgtgccactcatgctcccgttgatggacacattgacgttagacctctttttcaagttgttgaagacatttttcaccgtgcagcctctctcatccctctctctctctctccagaaattattgtatgatctcaattaatctttacgtgatttagtacatagtcaaaatttcaatttattagaaagagtgaatgaaacttagctgtattaagtggagaataatggaaaccatatacagttgtcgtggaacatacaataatttctctcctccctcactttgcattttggttcttagttaacttggtttctgagtgtggttgtttttgaaattttacacagggaaaacaagggcagatggatgccatgaagagcagtgcataccaatctgatttagctaatgtgctagatatttcgtaccacgcaatcaacaaaattttctgcgaggttttcttattcctaacaataaatcttttcttacaattctaaatctccctctgtataaatattgataatagccacaactatttaaacgcctacaacaacaatactacctccggttctttttataagaaaaagaaccggagagagtactattttatctattgtgtggtttaacttattcatgttctcatgctgtgtaatagatgttacaagcgttcgagcggtggagatgtacatgccacaatcatgggaatactgggcatgctctcaagctattcatgggatgccaaagtggtgatagcgttagcagcatttgcagcaaacttcggggcattttggctggtggctcagctttatgccaccaatcgtcttgctaagtctgttgcaaagttgaagcacatccatgaaacactggaacaagtggatgatttgggaccaaagtttcaaacaatcaacaaccttctcaaggcaatgttcgatgtaaccaataacgttgtccaattccttgagcttcactctcagtacattgaccctgaggtcccagagatgttgactgcttccaatcttattcccggtgctgtctattggaccattcggagtattgtatcctgtgcaccgcatgttttaggcataactggcttgggtcaagggtatgcctccattgttaatgtcatattatactcatcacaactttatcttagtaactccggttaatttctctttttttttaccaaaaaaactttaatcaaactcttgattgaacatgtctgttttgttatcattatttttaactttattggcccataagcttgataacataaatactcaccttcgaatgcaactcaccatttgtcgtcagcatttaggtaagtcattatctgcatatgatctttttttcttgggtgcacattttgtatggacttttagtttaatgtttctattcagcgggcttaccagaagggctttttaagtttccaaaaattgaggataaagatcaagaaattaaatttcaattatttgtcgccgagagatcccatttatacataatgagcacctcacccctttctttgtagttggagttgggcaagatttcacttgtaatgattggctttagatgcctacgaagtttggcattcgtgaggacgcagccatgtcagaaagggcattctcgcttggatccaggaaatagctctcagagatctttattccttttggaagaaagaggagcagaacgttttttatactatatttaaagagttacttgtgacgtaatacaaataaactcgaatatggatatgactttgttttttcaacccccaataaattcgaatattatggttatgattgttttgatgaatgacttgcaaaattaattttctttaaaattgaatttgaagggatttgtgtttagatttttttattctaaaagaaaatctataataaaattcaggataagtttgtttatcaaacacaaaagttacttaatggttgttttaactcaatcaattttacttagaattaactcctttgggatcaaacatgttgtgattttggataatttaaggtgaatccaaacatgaatcaaaacttttggcaaatgacccaataaggggaaagctgtcctgttccaaccttctaggtagtttgtcttcatgttagcattgaggtgttgaggaggaaaattgtgctactctacataacagacctacataatgtccctgatcaagagcttgtgatttttgaacaaatgtactaagagtcacgtcaggattcaaccaggttagagagtcaatacgaactcgtttggattccagttgtggacaaagcaatcccatggactaacgtgaaaccaaagtttgagaagctgcaaccaatgatgtcatgttactcactttatgacccttctctattggagcccgcaaccatcaggtacattaaagaggtatggctgttcaaaacgaagcctattcttgtagagttggatccgctagggaaggttgtgaatcttaatgcaatacccatgatgtggatttggggaagcttggcttatcctttctctagctcaagggaggaagcactgtggaatgaggaaacatgggaacttggactattggcagattcaattgatccatcgcttttggaatgggttagtaatctttacattattttctttcttgtgaataatatgtttatgcaaaactagcactctagtataacatattcaaagttgagcaatgaaaagtctatgataagatcacataaaaagcaacaattagaactcttacagaaatcaatactccttgaaccatgatgaatgtacaatgatctaatgcatatacttggtttagatatcaaaggcaaatatatatgctcgtatgaaggggatgatatagagtggatccctaaattcacaagcactgcatattaactggcaagagctctgcaactaccactagagatgatttatgtggggaaaagcaatccagggaagaaagttcaagaaatcaacaatgccatacaagcagaaaaattgagcaacatacttcctgacctagccataatttggttcttttgggttaggctagagagcatgtggcactctaaatcacagcagagtaaaacagtacagaaccaccatataatgcatgaagtaatgagaatcctaacctacgatagtggtgacccaggatgggctgtgattagtcaaggaacaggaaagatggcacagggcaaaggagaagcatttctaaagtgcctaaacgaacatgagcaatggagggatgcagcaaaagataaagggcttttgccagcaatgcatgattatataaaagaactccaaacccctcaccactgcaattgcttgatactcccaggaaccagtttaggataccagacaaagtggcctgtgctgaatgtggccaaacaatggaaaagttctacatgtatcactgctgcaacgagtaaactcctaacatcacacacatcacctaatgtataatgtgtaataagtagtgtgttaacagggaacctagcacattgatgccaattgaaactattggatgaagataccacttatacgctaactagtaaattagacttaaaataaattcaatactttaaccagcaaatctccatccaacaatttcaattaataagttgtgtgttaacagggaacctaacacattgatgccaattgaaactattggatgaagatatcacttatacactaactagtaaattagacttaaaataaattcaatacttgaaccagtaaatcttcgtccaacaatttcaattcactgactgcataagtttgttgaattcctgtatgaattccaagtgttgcttaatctaggttttcaattcagacagcatgacatctgcatatttatggtttgattgtaaaggcttgtaatggtaatgcaaaacttgttcaagtcatttcttcattagattctgtaagatcctctatgttgccttttggaaacacgaattataatgacataaaaaatggtagcatagtcatttcattaaaaaatatttctacaaactaactaataattacaaactaatatatcattggggggaagatttaatggcagtggaaacagagttccatatctgagcaagaggggcaataatatgaggcacaactgcaccaatacctttgagggcagctcctgaggcaagcccaattgcaaaagtctcaacataaccaggcttggaatcgagcttcatgtcaataacagtgagtctattgctaattgaatcaatcttcctagaagattcagtcaatagcttgtcgtgcttacctttgccagaggatatgactccaaacagagccttctgaagatcctcaatgaccttcaacgacgcatcttgcgagtccataccctgagattcatagtgtgatatcagctccttcggcgtcggaagcttcactttcctcgacggtttaggtccaactttaggtatcgttacattaggcgtttccatttctacaattttaatagccaagcgtcagtgtttattactttactctaatctttcaaattctcattttcagattctgaaatctaaaaatcagtttcattagaacgtcattgacactgctcttaattgtggaaaatgaatatatagtaatgaattgtatgtaccagaagacaggtagcatagtgtagcttagagaagattacaccacgctgtttaaaactggttattcaagacgaattaatttatatatgcttcggaaactagaacaacccccatggaataatcagggagagttcaccataagaagcaaccgttaataaataaataaataaataattgaactaaaggaatggcacaacgagaccatggaacagactacgaatgaaatagtgcgtagctgttcaagtcacaaaagtgacaaaagaggtcaacattgcaattcgtatacgctttcgttgacacgtccttcggcgatagaaactgacaaagaacgcaacgcctatcaaaagcgacaatagcagaagaactagttcaggaagaaatgagaaacgagtaaaccctagagaagagaacatacttcaaaaagttcaagcaatatttgatgcagaaattcggatgagtgttcccttggcctcgcggcgttagggtttatcccttaattgaagaaaatagggggttctgcctctgattttataaagaaaaaacagaaccaagcctacgatctaaactagtggtagccaaattgggcctaggccccgttgagatccaaaaaattggtaaccgaatggattttttaaataagaaaaaatcaacttaattttgggttccaggctgttgttatttacaccttcctattacgaaaatacctccttatattttcttttaatttgttagtcaaaaatgcatttttatataaaaaaaaaatacaaaatctcattatcaataaattattcattcattaaaaaaaacaatgtacactctatttttcacctcgttttcaataatttttaaaccctgctttttaaatcccatcttcattattctttaatctatttttttcatatgcttttcattatttatctactgtatccaatataataatacatttcatttatttatagaaatattttttttcttatgttagagaggtgaaaatctatttattttttactaaatcattttttaacatttgcatgtgaatgtgaatcaacccaaaaccaaaatgtctgaacgcggaggcaaaagaggagaatggaaagataatcatacttgtcctcgctggagaaggaacacccaagaagaacaatgttggcgagaggaactgagaaacgttgttaaaaataatcgactgatgaaaaggaattgaaaacaaaaaggaacaggcaccatccatagaaaaaccagttcataatattattaaccaagacaaaatgactagaagagatagtgctggaggaagaaaggtgtcaatagatgtcaaagaggtgacttaaatagttgtttggtacttataacataaggttgtttttgttttgattcttttaattttgacttgaatatagggttagtctgtctctccacctgccttcaacacattaggttagacaagttagtgggttgaaacgtctaaaatgttctattattttattttatttttttacttaagcaagttgactcggcaatttcaacttaccctgtcatccctatataatttatttcatttttttacatttcattcacaaaaatcatctttcctgttatactaaaaatgtaagtgatgttattttattaatagaaacaatattaactaaatggtttatatttgttttcattgtgcatgaaaaaacatcttttttaaaagacaaaactatttatttattttttcaaaacttaattgatcagggggaaaaactttaaactccataagattgttgtgataaagacaaattacctaattataggcttccaataaaagtatcaagatgtctatctatggtccaatttaatggtttgctaattacaatgtcacaattgatcccaagttcgagacatgacattgcctttgctcaaccaaccaacaacaataaaagtatcaccattaaataattgtgagaagtcctaacatacacattgcatgaaaaagaagtataaaaatagcatatgaaaatagtaagtgtcagaatcaagaaataaggtaaataatgtccggaatattttataaaaaatgaattttatttcaggtcttctataattttttgtttgcattgagtcataataaaaaaaagttttcttttaaatttatgttgtaaattaactgataatgtgtcagttaaaatttttaaaatacaatcaactatcctatttatttataattttaagttataatttatgagagttaaaaaccattaaatgaaaaaagaagaaaaacacgttagatatgacatatttcacaagcatgtcaataaaccccttccaataccaacactcccaaaataacaaaatgacaattaaacatccaacaacaaagtagacactaaaacttaatcaccagataagttcttcctattcctcaataagtcaacacttatttcgaaaccccttaaacttaactcccaacaaacccaaaacactgaacaaccaacatccaagttgcaaaaattccttagatatgaaaatcattgatttggaaatttcagatttagaggaggaagctgtcagggtaagtgacttgattaatgaaaatgagacaatcaaggaccaccctagcatggtagatgatgtgatggataacaatgaggtaattgatggtcgtattagtgtttttgttccctctctcttcatcatctcatgccctctaccacagtcatgagagcttgctagctcattctcttgtggtcttagttccccatcctgttcccaagcttttgttaatccattcatcgtaagcaaaatcgttgttcggcaagtcaaagtatatcaactaagtcaacatggataagaaattgaatacaatgtgtctcgacttaaacttgcacatggtgagactactctcaaaataactagaaagggacaaggatatagtgataaaaaatttaaacgagaaagcaagaaagcaataaatgatgttgttttgtcaccaacaaaataataaaatgtgcctaaattgaaaactataacggtaaaatacacgaaaaaaataggtgataaaattcataaaagataacttcaagtgataaatttacaaaattatgatatataattgaatgataaaatatgtcaaagatttcataaattatttcatgctccaattagtgacatgattttataaattcacattgaaaatcaatgttaacatataatataaaactttatcccatgagttattaaagtgaaatattaattttaaatataaaatgacacacaaaaatattgttatgaacgcactgaatctccaaaatattacacaaataaggagataatataaatattaaacatcaatgttttatggaagtttttcataaagaaaattgatacaacctatcaacaataattaattgctatatagagaaatataaagtaaaaaaaaaaaaaaactcattttcaaccactaattaaaaaaaacaactcaaacacacaagttttgatgcaagaaaatgaacacagtattaaatggtttagttcaattaattaaatagtgtgtgaattgttataaattcttatatcaaaactcaattataatagataaataatccttataactcaatttgataagtaattgaacacttaaagagtaattgtatctgtagttgataaaaagagaataaagtgttttatagctcaatttcttgaatttgatgatgattaattaattttggttgatgatatttaattaagttttttctcaatcatatttttcattcacaaaattttatcctaagattttgtttaagagatcctattgacaaagtatattgtttatataataaacatatatacaaagataaaaaatggtgaatgtataaaacattataaagtatgaataatagtactcttaaaaaagatcccgttacatattgtaatatcaaatcagtttaaaatataattaagggcataattgatctcacttctacaattttaacatagagagattgtatttatacaataaaaataaataaaactagtgaaaaaatataaaaaagagtttaatttccacacactaatgtaataaattttaacttttttacattatcaattaattagacattaagtggtaatatttgaacacctatattttacaaacattctataaatatcttttacttttctccatctctgtcttattaattgtttatattttctgtttaaggtgaggtttataaatcaacaaggtgtttatgaattgttttcctcaaaaattataatatgaatgaattttaagaaaaatttaaaaaatcaacaaatttattatacatatcaaattataatatcaaattatattatgacaatagtgtatttttatttacaatattaatgtaggctccatcttatttaacactatcttaaggatggaaatgagtatcacggcatttagtctaacatgacttgtttattataaatgtcagactataactctttgaaaaatatatttacataaaaggtcaagctcaaacttaaaaacaaaaaaactgttagactaacctatttaatatatataaatttaaaaataatatatttatttttctaaaattatttttccttattatgaaggtggatgatcaaccacttcaaaaaatcaccttgaaaatctcataaaataattattacttatttgaaaatataagtaggatgttgagatattttctatttaaaatttgtttcattaactttgataaattgatataaaatattttgtaaaattaattttcctaaaaatgttttttcgtgtttgggagataggagatggcttaggaattaaaaatttattcgattttgtatataacttgccttggttcttctttcttatttattttagtatttgacattaagactatattattgaatgaaacttatggtattttatttaattgcttattttgtttataatattttgttgaatacttaaaagtactttaattaattttaacttattgtttttcactcacaaatttaaaggaaagtatgcgtttttatttatattaaattttaaaaaatactatgcaaattttcaaagttttaatgtataataattaaattttctttatatataatatttattgtaaaatagattttttaataggctcaataagtcaaaccaaacttttaaataggttataccaaattttatatttttaaatcaggatctaatcaaatatggtgtgaactatttcaacctaactcgacacaatattttttttcattatttttccttttcatctatcactaattttttaggaatttaatctcaagagtaattgagtgaagtaagacaaaaaaaaaaattaacaaatttaaaacatttttttgagtttgaagacttttcttgtcctaaattggtacatcattcccttccctaaatttttaacgtcgacaaaagaaatctaggaattcaattctccatcatattttacattgtcaatattaaataggtttaaaaaaaaaggtataattgatctaacataacttccaaaatttacaaaaagagaaattttgcctttattcaatgaaatttacaataaaagaaataatggaaagacaacaagtgttgtaaaaaaattggtttgtttttatagctgccatcataaagatcacaaaaatcatgacagaaatgtcatattcttatacatattttcttactcagtacttttttcttcattgttctctactttttccctattcggctatcatcaattttctaggaaatcaattatcgatcattatcatgactgactggtgatagaaacctgccaaacctttatctgtccatcaagagagccactgaaaaccgagacgctaaatttaggtgaagtttgatgacagtactcctccggaatcgccgccaaggatttcaccggtttccggtgaccgtcgagcacagcaagacatccaaaccgtccatgataagcgcgcttccaaatcctaaccgtccgatcagccgacccactcagaagcaaatcagagacgtggaccaaacacagtatggccttctggtgccccctcagagccccactcaccaccatatggttcgcactgtcctccctctcccacaccaatatggaacggtcacacgcacccgaaaacagcaccgaagcgtcgtcgtttaacgccaaggcattcaccgcggacttgtgcttctccaacgtggcaaccagcacgtgccgcttctctccctcgggcctcgcccacacgcgtatgcgcctgtccgcggatccagtgtagacggttccatcgttggacactgcgaccgcattgaccgcgtcctcgtgcgccttcagtgactccacgcagcgaaaatcagagagccgccatatcttgagagtcctgtcccacgaaacggagtagatagagccgttactgacggcgagccccgtgaccgcgtccgcatgctcaatccagagctgcttatcgtgacggcggattgcgacgtagttcttcgggaggaggaaacggcgcagacggtcgttgacggttgggagagtggctaccatgctgtggtggtggttcttgtggttttgccacacgcggatcttgcagtcttggtgggtggtgatgacagtgttgttattgttgaaggtgatggttttggtggagttggaggtgggttgggtgttgaaggcgtggagggtggtgcacgtgtggcggtcgtagacgttgatttcgtggtcggtggcggcgtataggaggttgttgttgacggcgagggaggtgacggggtgagaagggtgtggcgtgagggtggtgacgcaatggtgggagacagagaaggtgaaggtttgtggagagaggttttgtagagagggaacggatgggagggtttgtatggagaggttgctttcgagggaggaagtgctgttgttggaggttgttgaagatggtgcttctgaaatggaggagtggctgatagaatcatcacatgcatgttgcttttgtttggggagtgatgagattgttgagtggtgggtggcggtggcgcagttggcggaggagcatgtctttagccaccattggatccgcatgattctgttttagataacgtggttagagaggcactgcaaaataaagatgagaatcacaaagaggagaaaaggaaaattttgcttaagcgggtggaaatggtgacacgaacaagagaaaaaagggtaagaggagggaacgatcaacgatttttaaattgcattttgaagtgtgtattgagacagatggagcatttactgtgggtggtgccggagcatcaatgggaaaacgccaaaacaattgattccttttctttttgtttctttcttcttctattggctgggaagctcgctctttttgaattattctatgcaatgtcacctcataagaaaaattgatgagtagctaccatctcaaagcgcaagttggccatattttacacttcgcacacacgcagtcttgtagatacagtcgagacaaaagaccggacactccgccaatgggagtccccaaacgtgatattaaaacaggcacaagcctccaaattattagaaaacttttcatgatttcatcacgcagatatatttaatttacttggataagaggatgacctttattttgacgttaagcaaacaggctcacatcggtccagacgtaaaacacctcacaaacaatatattttataatctattattctgtcattataaattactagcacttttcattcaagaaatatatcttcaaaaagatcagaacatttgattactatcttcctacgctcactggtttaactaaacactaattcctgattacatttatttccttgtaatatttaactgcgtttttatgtaaaaaatgaaatgcactcacaaatcaattacggtgttatgagactaagagagggttttaatttttaaatttaatgataaaatttatgaactaaaattgttcaattaaaaaataattaaacgcatataaaaaatgaagaatccaaaattgcatttaatcatgcttgtattacttactaatattgaatagaagaaacataaaattatgaattgatttctcgatcaatttatgaaggatcctcccgagtcccgattgcaacatgagacagatgcatgttactgaaaataatgggccgggcttcgcatgggatttgggccacacagtaaggacgaggccaagcaaactgcggatcccgacgtcacattctcgttctcgttccatcttaatacgcagaagaggggaaaacagagattttgattacaaggggaaaagaaaggagattctgagactaaaagcaaatcgaagcagagaagaagaaagaaagatggtgaaagtggcgacgtacttcgcgatgacgctgggagccttcgtgttctggcagtccatggacaagctccatgtctggatcgctctccgtcaagacgaaaaggttcattcctttctctcaatttcactctcctccaatgagaaaaacccgagatatcttctaacatatgattattataatttcctacctaactcaatttaactctattttaggattctatttcgtagatacattattttgaacctttcagcaatggttcgtgttatttgatctatctgtgctgtatgcctgtatctctaagtacgaatgctatttgttttgtacttttctttaccctctttctgtatggtaatctgtctcagaaagagagattggagaaggaagcggagatcagaagggttagagaagaattattgcagcagcaggccagtcagaaggattctctttcttgaattcgaatgttgtaattttgctgccttttgctttgtaattttccttgcttttatttttccaatgcaatggtcttgtgctcgaataaattctggtactcccgagcacttcatatttaattgcgtggatttctattgtgttcctctacacatgcacttgtttcataaactgctatgtgtcagtaattgttggaacacttcactcaggttatgatttatgaaccagattttaagcgttttgatgaattgttgcagtcatacttgaaccttttatttttcattgaaagtgtgagatttggaattcaaccatcggatcatgtgttgaagtgactggagtaaaagtctctaaaatctctagttagttgatctgactgtggtgcataactcatttgctgctgttgcttctcctgaataatgaatatagtcttacttgctctacaattccctcattgtttgtggtttattcagatatacaagtataactggacaaattggcctgtttaaaagtaaattgaagagtggagaatcagtatcaaaccattgtcagcagtctttcatcaacctttttctcatacttgtcctacaggatttttgaggttaaattgagccattgaggaattatgaagaagtggcaataccaactggaataagcaagtatcaaaatgatgttttacatgtttaactcttgctaaggtgttgactttattgcaatcataggcaagtgcttggaatacaagtagatgttcttgttagcttttgcagtctatgatagaagattttaaacagaatagtgaatactggggtgccactattgtgctatggctgcgcattgtggctgccagacacttcagggaactcctagctttgggtggatagtggctgaattgcagtagacagcacagctgtaccaataagtggcaaaaatatgattgttccaccttctcttcggatccataatccacttttagggttacttttatgatttcacattctcttcttcaaaaccctgttagttttatgttgacttttgactaaacccagttgctcatcttcatcaatcttcgacccttctattttctggccaaggtcagcacttccgtttgcattctcttctctgttctggcctgcctctgtttacacactttgcaggctattctgtcattcctagtactttttacggaagtgtgcatagtaaaagttgatgactcttgctactgcttagttattagttatgcattacatttatgatgattgtgtgtttaggctacggactaatgatgaatatgtgtttaattttgagtttttttaatttttatatataatttgagtatttatgtatgaactgtgtggcataattgtttgcattctatctattacaaaaaaaacactgaagtagtactttccaaattcaggttttgttaaataatatttgaaattcaatccaacacctgtattgttatgtacgctacaggctataatttaattggactgaattgttactcgtacataagaacttctagaatagagacaccaacttcctctctgtggtatatgtagtcatgagctaattgagtcgtctgcttttctgtcgatggttaatgttatgataaggtaactacatttaaatcacgtatgcagtaagtaattttttttatgtagattttacctattggatggaatcatgtatttgttatggatattcctagtttctgtggtacaagtaaaaataagacgataggttgatttctatggacaggttctattagcattttgccatagaatatttctctctttccctttactagcgatcagtgatagaggcgatactcttctctcgttgtctagtgtatggcaactacctagtgcaaaggtggaatataatggatgtctgatgtctatattgcatgtgtattttagtgctgagaatgtttactctttcgctgcacaagtgaaatattttattgtggtagtgatagtgtgatactccaacacttgtttgtttcattgtatattgcaattacctattgacagtgtgatactctaaacacttgtctactctttcgctgcacaagtgaaatattttattgtggtggtgatagtgtgataccctgacacttgttcgctgcactaggtctatatcacacttagggcatataaaatactctggttgtaattattattgcttcccttgctaggtacttaaagtcttaaattgtagtaatcgatcaggagaataattgctaggtacttaaattgtttattattacctatttctgaatggagtttcaatgggagaccaatttgggaccacttatgatttttaaaatcatttgtttattattgttaattaaaataatattgatattatgaaatacaatgaatgaacgggaaaacatttgtttcttattgttgattaaaatagtgttgatgtttgagatcataagaacacaatggatgaactaaatacataggtcctgaattaggcaatgtggatatttcgattcactttacgaaccaactagacgaaccaagtgatatatgcaatgttgtcaattacagagaaaacaaaaagaagcaaaagtcttaaaatattttgaggttaagaggaagaatatgagagtattttacacataaaattttattaaaagttatataaccaatatgtgtctaatttctgttaaattattaaatggtgtttagcacggagggtctgaatggaatgtgagctaaaaaaattaagggggttttataagttgcaaaaaaaggaggactttcgagtgaaatttggacaaaacaaagggaatagagtgtaatttactttaataataataaagatgatgatgatagaaaaataaacaaaagttattaaatcttgcaataaaattttatgtacgttaaataattttgtgtaattcttttaaaaaatgtaaataaattagaaataatttttaatataacttttaagataattattttaatagtcattagaatgatttgtctttagatgataatgaagaaaattgtcaatggatatattatttattaaaaaactaaaacattcactactatataatgataaaagaaaatataaaagtgaattaaatgacaggaaaaaaaaaagaacagtagtctcattttttaaagcaaatatttaaatttataatataggacaggaataaaacttttattttcgataacaggaataaaaattttaagattaagatattttcttttaatttatatttttgaaagtttatttaaattaaaaactaccgacggtttttttttttcttgatggaggttcgtgtcaaagtaccaggaaacaaaaaaaaagttacaaagcacttagaatatttgttttaggtgggcccccgcaacaagtccttcaaatcgatcaagtaaccccatttgttggtcccaacgaaaaatgaatttgccgtcatgccgtgcaatgcatccatattattgttggattttagaggcaacccaaaaattaatgaattaaaatttaaaatgataaaaataaaaaaacagaaaagaaatactgattcatcatttttattgctgaatatataaatgataaatcagtcataatttagttttttaaaaaataaaagttatgaatccgtaaataataagataattatattctattattaaatttatgagattattttattatattattataatatgtaagtattaatttaataataaaatatattttttaaaactaattaaatattaaatattaatttatcattacacattatgtaattatcataatttatacacatttaataattgatttttttttttgaaagaactaaattgtgattataccaaaatatcatctagctgaaaagaaaacaagagagtctaggagagagagaaggaaagtagttgtttaaagcatgttttggaaacgaacagaatgatgatcgagttaatgggacctgcacctttcagttgagatggatgtagcaatcaccaaccatttcaatttgtctatttccttctttcacttgggagcaaagcctctgtcaccatcacttacaccttcttccttgttccgcttttcacgaccatgatcctctgcttcacgctcactctcggatctcagtcgcagatccaccttcaacgttcaccaccttttcaatctttctcatggatccctctacttctcgtccagctgtagtcatcgataatggctctgggtaccattttcctccatttctatcacccaatctcccttctatgcattatgctattttttctctgtcaatatgtggacaccatgtgtttgttgaaatgctccaatgcggttttcttagttttaggactagaattgtctgtaatattcattgacccgaattcctgaatttggaaatgatgtttttttttttttttgcaggtatactaaaatggggtttgctggtaatgttgagccatgttttaatgttccgacagtggttgcaattaacgagtcttttcttaatcaatcgagaaactcctctaaaggcaattgggttgcccagcacaatgctggcgtaatggcagatcttgatttcttcattggggatgaggcactctccaaatctcgatctagcagcacttataatctcagctacccaattcagcatggccaggttgagaattgggatgccatggagcgcttctggcagcagtgcatattcaactatttgaggtgtgatccagaggatcactattttctcttgacggagagtccattgacttcgcctgagagtcgcgagtatactggggaaatcatgtttgagacttttaacgtacctggactttacattggtgtgaattctgtgcttgctcttgcagctggttacacaacatctaaggttggtaattggtacacagctacactcgaaatttgattttgggaattatgttgaatatagaattggatttggatgattatcttgagtgctttacatatttaatacgatctcagcagcaacacatttggtagttatctaaacacaaaatgcacaggatgcttcatcagcccctgcaatttgacacatttggatgctttcacttgaaaccaagagtgaacaatactgtagaatatgaacagttgtggttgttttgcattattacatgcgcatatgataatttatcagctcccccgattatgttgaatataaaatctagaatacgaagttggttatgcataattttacttgaacttgataacagtaccataggagctatcaagatatttgtttcttattatatctatttttattttaagaatattttcatttatggctgatctgaaattcttcgtagtgcgagatgacaggagttgtagtggatgttggagatggggctgctcatgttgtacccgttgcagacggctatgttattggtagtagcatcaagtcgattcctatttctggaaaggatattactctttttgtgcagcagcttatgcgggtaggaaatccttgtggtataaatttaaaagtttattgtgctgttattgttctcatatttgaatatctgtaaaatttctgtaaacctcttcttgttaatgttgaaggatctcacaaactaccatttacatagctagtgaaatcaatcatgtataaatgctaatcatggatgaacagtgtgtgatgcacttatgatagtattattgtgccgatcaaaaaaaacaatgatagtattattgttacattttttgtagttaataaatagaagtgaaatttacttatttaatttcatgattgagtatgaaacttatttgtgtcttcggctataaatttttgttgaactgactgagattgtaataatccatatccaattgtcaatctgcattttgctaaagtcagattcatgaactgtcttgtgttgacatcgctttgtgcaggaaagaggagagaatgtaccaccagaagactcttttgaagtggcacggaaagtgaaggaaatgtattgctacacctgctctgacattgtgaaggtggtctttagttcaatactttaattctttgacagaatcatttgaggagtttgtcgaatttctctgccaatagttttgttgcctctgccattagcatgtcgagtgtcaataaattctcactactttaaaatgcttttcttttttttgaatcaagggatgtaaataaagttatcttttgaacttgttagttttcctacataacaatgactcattttctctcaggaatttaataagcatgacaaagagccagccaagtatatcaagcactggagaggcattaaaccaaagacgggggcaccgtattcctgtgatattggctatgaacgatttcttggccctgaggtttgttctatggctgctctttatattttctctattatggatagctgaatctctcttagggggcctccagattgttctatggctacttgttttatacctatttttagtatgatttttcctttgtgagtacctgaacctatctcatgaactaatgaattaattaaatatatactcgattagatcctgatttcctatcattaatatccagcttaacagaggggggttatacagaaaagtggtaaaaaaataaaagaggccgaagaactagcgtgggaaggggcaagggaggcttaagtacaagcattgtagactggttggggtttgaatctgggatgaactgatcaagtagtctccatctctaagagtcttcatagcgcttatctatgtatagctattggttccacttgagcttgttccctaaactactgaagaattaatgaaaatatagtagtgccttggtctaattgtggagctaatccatgggttcagtttgggtcattatattaacaggatcagtcatattaacatatctgtatgctttccctatgatttctgcagattttctttaatcccgagatatatggcagtgactttaccacccctttgccagttgtaatagacaagtgcattcagtctgcgccaattgacacaaggaggtcattatacaaggtgaagtacctttacttattgatgtgtatataaataagctccaagagtgcttttaaattttagttaaccaatttttaatataaaattagtgattttcttaggctcaatgttaagcttggggcattttttgttgttggccagatggaatacaatagtgtcaaatgttatatttataagtccacaatcccagccatgatatttaatttctgatcatataaatttcaagtcctttagtttacatgttcttaatgattgaattcttcacctctttcctattttgtcttttttacttcagaatgtagtgttgtctggaggttcaaccatgttcaaggattttcacaggaggttgcaacgtgatctaaaaaaaatagtggatgctcgtgtccttttatctgaagcacgtttgaatggggagataaaagtaagagttaatagatacctttagatcatatttacatagatgattctcttcctctcacacacagacagatactaaattctttataatttatataaaccttgcttgcactagttgtatggactaaaccaatcaacaaccaatacatcattatgttgtattaaataattacataaatccttgtcatgtaattattttccattgaaattagcgatgtgttggttgttaattgtattttggaaggtcagactgctatatatttattgctttggcctggtatttacttttttatgtttggaacctacagtcgcagccagtggaggtaaatgtactcagcaatccaatccagagatttgcagtttggtttggaggatcagtgcttgcgtcaacacctgaattttttacggtatgattgaataaatggtattgtttgccaagtttagaaatatagaacttgaccagtgcaaaatatgaccgagtttttttattttttcatccctgtggactgcaatgtgttttcttgtgataatgtcattctccttgggagtgtcgataatttctgaatgcttcttttaatccttccaataaatctcgatgcaagttttacaatttctggtccaacgtgcaggcttgtcatacaaaggcagaatatgaggagtatggagcaagcatttgccggacaaatcctgttttcaagggaatgtattaaatcaacaacatattagttgattatcgatgcagttatttggtaagactgttgaatgaaacagctggttatcgttatcctcaattcacttcctgggctttcttcccacctatattcagggtggcagaagtgagtgtaaaatatgtgtattaagtgaaaatatgcgtttgtttttattccatcacttggccgtcagtttcacaaggttaatacagttgccagcagatccagacggtacttaatggtttgatagaatttgatctttgacaaagctggttgagctgaattgctacttttgaggttcagcttagagtttgatgaagttctgcattttttgtcgttcattgatgggactgataataccatgaagtacttttctaggcagtaagttaaattcattttgattgaattgtaataagcagcagtgcaggttagatttatgtttacgctaaatcgtgattcatatatttttgcatttttggttacataatgtataattgtattttgtttacttattatcaaagccagaaataattcttttgccacattggaatttgaaatcattctcccaacatttataatataataatagctatttttctttctggtagcacattgacccgttggtgaaagtggctgaaggcctagccatttgaatttgctattcttttaccctttttgttgccggtaaaaatgattcccatttcaattcaaataataattcttttttttacagcaataataattccttgtcagtatcgaataaatatcttaattaataggtatttataataataatagatgattaaaacaaattaatcaaaattatcatgcatttttttaaaaattcatctaactttttcatacgaatctatgattttaatagaaattgacctcaaatgtcttgatatgtaaggtgtgttcttctccttggaatatttaattcatgtgtgtacaatgatatctaaaataaaaagaagtttgaagttgttcgtatagttctttctcatcgatgagaatattataaataaaataatcattttgaatttgttttcctcaaaagaccactaaattatttatcaaaatcagttaaatcaaatacttcatgataatattttctagaaatctgtcagggagcctcaatgtctctttacaacgcaataaaattttcattttataacattatatttatacatattcttttattttgagaaaaaatagagatgccctttttgttaataatctgagatgcatttgaaaaattaactaaacctttggataacattttaataattgagaaataactctaaaccctaaatcttattgaaagtcataaaataatcacgtgttattataattcataaaataactctaaaccctaaactatctcaattttagacaattttgtttatcttgcctatgaagctttataataaagtttaaacattcattacaggtgaacttcaataattaataactgataagtgatacataacaaatcaagtatacagtgataggttggcataactaatctaggttatttcccgggtcttctttatcacaagaaataattataaatctttcgataacattttaatatatttttttacatcacatatattttagacttttagttgatccttttcaagctagataagtccgtgtatgactgaaaaaattctttccaaatatttaatataattgaatagttaatatttaaattgaaaagtttcaatttataagttgaaataatctcacatcttgcgtgcttgccacctcggtgaaataacattttaatattaactcttctgtatattgaattacaatatacttaaatacacttatatatttgcatgcactatctttgcatgattgcatgcaaccttcggagcggcgatgatgagaactcagaagtagaagaagccggcaagagcagcagaggcagctccggcgacggcggagaggtgaccgagggaggaagaggcagcggcgctggaaggagaaccacccttagcattgtcgaaagcaccgggaggcacgggcccaccaatgggtgcagccacgacgctgttgggagcagaagccgcttcactggatagggctccgatggagtaatcatcgtcctcatagtcatcggcagaggcctctggtgctggtgctggattcttagcacaggccaagccaatgatggcgaacatcaccacggcaagaaccacaaaacggcgtgcacgtgccattttttaagaaaaataattaattaatttgttgatttgttttgcagattttctctaaggaaggggaaatattagagaaactctgcaatgcaaggaatatattgtggttgcggaaaggtcgtaaggagagggttcatatattatagggtacgtttgctattaatgtgtgagggaagccgttggttacggttttttgctatttaaggtaaggaatatatatactatatatgggaatgtgatgatctctgcatggaagagggaaacaacacaacaacgttgttggatttgtttgtttgttaaggttgttctatatttatggtgtgccaaataaatctttattccctttcaagaatgtgacattgcaagttgcaacaatggcaaagaatattataggggacatcgatccttgctggccgttcataaattagcatgttttttttctggggtgtataaatatcttttgaattttaagtcaattctacaaataaaaataatcaatatttttattttgttgttagacgatgaggattaattaattaaagagataagattttaaaaagaatttaatttcaatacactttcaacatgaaattgaaaagactttttaccttgtaaatgaataaaaaatcaaagagtatttttaaaattattattataaaagtcaaacatccttattatataaaataatttataattaaataactcttaaaaaaatagttatattatttgttcattctgattaaattctttttaaaatgaaaataatattatagaaatgaatgatttgaatcaaaaaatatttatagatataatatgttaaattaaaaaattaagtttgaattaagattataataattttacaatttatccaaaaatatattatcttttatatatatgacttattagaattcaaataaaatattccatgttggaaaggtcacgtggtttaatcaggaagtatttttatgtaaaagtaagaattctaatttataataaagaagagaaataaaataataaactaataacgaaatttatatagggatatattacttgtatttaacaattttaaccttcttttttttcctgattgacacacacgaggaaaaggattaattactacaaaatttaattttacttccctccatgtattaaataacagaatttttccttcattcatacgaaagtgtgtggataaatctgtaaagttattctaatttaattaataatttctaagttaaatcctaaaaaattattattcataatgattctactttttttaatagtattcttttgaaaatatacgattctatttgacttcaatgtaattgtttcttatgaaatcaaagatatatgtaattcataaaagaatccttagtaggaaatgaagtactctgttgatctgccatattttttacaatgaaatttttacagaaactttaataaattttttattttattttgaaaagttattaatagttttttaaaaaattaagtttcattttaatatttaaatttttgtataaattaacttcgttttaataaaaggagaaaacagtgctttgctttactaaaaaggttattagttggtaaaggacatcataaaaacgttattattaattttattttaggttaaaatcattttatatatatatatatatatgagggattaaatcacatataactttaaaaattattatatcattttataacttttaactttataatataatcttaaaactcattgttggattcaaaatttattttacataaattccatacaaaattttatattaattaaaaattatttgcgttcatgtaaactaaaatcgacttaacataaatattttaaaatagatcatttttagttgttcaattatgacaaaatttaatagaaataatcttgataatatgtagatataattcaataatttattcaataaaaatcacattttatatcaaattataaaaattgtgtaataattacacgatataattaatttaatccttcatatatatatttaaattttttaaaaacacaccatatgaactaataaacatataatctatttcacaaattattccataattcataacaagttatttacagattaatatgcaagaaatattttttcaatcttacataattcataaatacataagcagcattaattactcctatgaaaatccttagcagtctaaagttcaagttgaccattaactttttcccttgattcttcaatcaaaactagataatctacaaaaattatgcaataagtcataatcttttatacgcgttgtacttcccaaactaaattaaacaagcaaaaagactaaggttgtgaggtctaatgtaattttatccttctagaaaagtccttagtcttgcctctaaaagttctcacattaataataaccctatcatatatacatgtcttgtgtagcttagatatatatacctcacagtaacacctttcttaaaatctcacaatacttccttagacacttaataatatatttcaaatcaataaaaatgatatgcaaatctttctttgctttaatacatttccatcagcccccataaaatataagcgacttctatcataaacctttctagttcctagtataaaatcaaataaattcttcgcaattctaattttttcttcatgctcaattacctattttttcacaatttcataatgtgactcgtaattttttcttcttttaatatgcacaattttaaacatctccattgtttttaaataaaggaaaagtgctcctcttcgactttaataaaagtttactaaatcgagccgtggtgatatcgagtgaatgacaattctgtaaaattcaccaaatttatctaagcaaatgatcctaggataaccaaattcaaaagtcaaggcaactaaactgcatatgaaccttcaccattttcaactatgatgatctatttgaagtctacgttgatatcaacaaccgcacaaatagtgaagctcttgttatatgttgccaagcttggacctatcgatgcattctttggttctatttacataataaacaaaggattaaaacactaaatgctatgcatggtaagcataaattaaaggatgacatggtgtaaataattggcatacaccggcacatagttaacaaagatcaatatcaacccgctttggctttcctcttccagtgtggtaggcagcatcaatctctacacctagttgtcctttgtccccagccccaaaggcatatagcttccctgattcagttagggcaagtgtatgagcattccatatggaattggtcgtactaacctgtaccacccgttcatagttctgtttcatcgaagtgactagctttggagttaacacagacattgtatgcatggcttcctgcacaagtacatacatgatattgttgattaacttcatttttattaggattttctgaatgaacaattttgtctccaaaagtatctaactaataattgacatggaaagattaaccttaataaaatgaatgcactagagtcaccaatataaaattaggtttgtgctacttgtgccctgtctctaaggcatttacaagaaatgtcatctacggttcactatgcttcaactagaagcttcattctgaaactggttcagtttggaactcctctgaaagttccaattattgtaaagtagtaatcaataaccagttcatcatatcataattgttaaaaaatcagcggaaggacgtgtcctttgaaccaaaccaaacaagcaattcacaaatcaaacaaggagcaaggcataagcaagtagacctgctcaggattttcagggtcatggccaagtctgccagtttctccacagccaaatgaatacacatcaccgctatcagacactacaaaagtagtgtaatctcctgtagcaacatgaactgctttgacatttttcagctcttccaccaccttaggtactgattcacattctttatttccatgacccaagcagccataacggccccaaccccaggtgcaaacacggccatcctgccccaccacagctgcatgccaagaaccagcagcaatcaccatgggctgaaggtttaacaactggaattgttcaatcaaacgaggatacttctcatccgtttttgtgccatgtccgagcttcccacccataccacacccaactgagtacactgacctattaagatttcagagaaggatcacgtaatcaataaacgtatagatagttattacaacaaaaatgaaatcgaatgtaaatactagtttatttaagaataaaaaatcagcaatgcttaaaaactttcataaatcttgaagccgtggacttatgatgcaaatacatgtaggtaattgaagaaaacagaatggaagatatatatgatgccaatcaaggaataaatcataatacaaaaaagttctcttttcactctacaaacattaatatgcatacaaaaaaatgaagtatgtaaaagtgcctaatttgcatcatatgatataactcccaattcaattattgtggaaaaagaattgaaaaagttgagataagaagattaagttgtagctcacattccacttggttgacaagccaaacaaagcaggtaacagaatccagcagctatttgcactactggtatgtgttccagagctcctaataaaggatggggttccaaatcatctggatcagtttggtgacagagtttgccatcaccaccccaagaaaatgtatatacccttccttctcttgacaatacggctgtgaaatagtttccaattgcagcttgcacaacaaatatatttttcatagattcaactaactgtggagttgtaactattttagatacttggtttccatactcagcttcaccaaaagattgttttccaaaggcataaacctgcccagaatcactaatcaacattgtcctcccagtcgcagcagtggcttgtataattcggattccttgcaaagctctgcagcgtaattgagttatgttaacttaaattcaactagttcactttccacttaaattagtatgataatgtattaactaaagttccaacctgattggccgaggttgccatacatcttcagtagtgccatgcccaagttgtcctgaactattggacccaaatgaataagcaaccccttttgatgtcacagcaatgctatgaccggggcctgctattacttgtgatttctcccttctaccacatgcttctccagcaagcaaaaacctcagaaccaatttccaagaaccgccacatctttgcttcaaatgttgccgttgttctgttgtcattggattaaaaatggctttcttctggcacatgtccaatgcagcaagctctgacaaggacaagttgaaatcaggaacaaagtttgccggctgcttgaaaaaggagcatgttgcctgcaaaacaccacatcagaaatgaaaccagcagtattagaattagtacaagtttcaattaacaacttaagagctgaaatggatacaagcacagcacttgcctcaagtttagcaaggtcttgaggatacaagttacatgttgtaaggacatgaaggacaatggaggggttcgcagacaagggaaactctcctggactagaatccccgaagcaatggcgttgctgccgttgaaatgttggcaattgggtggcaacaatggtagtagctggctgatcagggatgttatgatattggatagttggggtttcaccggtagtggcatccattggcactgcgaatcttatacagtgcccacacagagcagaagagaggatctagcacttctggtaattatgaaaatatgtgcaaacggattactgcattaataaattaatttctgtttctccaactaaagcatctgaaactctacaagttagtacctcaagaatatgtgacatagttttttgtttttttttaaacacaggttaattacatgattttctgtatccatttacaatggcattataaatcaaagacaaaggcaaatatttagtgatgaaactgaggatcatcgcaaaaagattttacttttcataaataccaaactaaaaaaaatctaaagcagacattttattgattaagggtgaaccatatgaagaaaattgaggatggaaataaggtgaaggaatccaaagaagaaaacttaaagtacattattcccagatgatgggatattctacaatcacacacacaaaaaaaaggaaagaatttcctgatcaaagttgaagaaatcgccaccaccaaaggttgatcatcccaatcaaaatgaatcaaattacaaaataccctctttcatacagaaaccaaaaatccttttttcgactttcccagatcacgttggatggatacgcaactataaaaaatggtaaagcaaaaaaattgaaaaaaaaaaaaaagaatcaggataaggggaaaataagacatgataaaagagttttggttgaatggcattcgttgcgatctcctcaaaacataggcaggcacgtggaagccgtgattacatatgagagggatcaaaccaccattcctcaaactgagtatttacctggagagagtttgccaagttattattttaatgaaagtgtgcatataatgaaatgacgtagcggtgagagttttatatagcttttgggagtgtgtggttgaatgaataattttttttcaaataggatgatatctcttctctttcatatttgacaagagattatttataattatatattagataagatatgtattcaggtattcaaaataattcgaaatgttagttttaatcttaagtttaataagtatgtctttgataaatagcattacttacaattaaactaaattcttttaaactatcaaacagatccaaataaatcgaaatcgatcaaaccaacaataaaacaatttgaaaactgaaaaactcaaatttgctgttatgatttttttttaaatcaataaacacatggaggaagagtataagatggttgcaaaaattttaattaggttggcaacacatcaaccaccctctccaaaccacctgcaaataagggagttattatgacttggttcgaattattattatcaaaatcctaccacattgtacattattatttgaatttttattttaaatatatttttaattgctcaaattaaatatattttttcctctaaattttaaattgatcattgtaatttgaaaatttgaatacatattatatcttaatttatcttataatttaattattatcttatcttacatattttatcatataacagtaaatagaatacatatattttatcttatcttatacacatatttaattcttattttctatttactgttatacaattcaacttttggttatatatatatatatatatatatatatatattaaattttaaatttatatgagacataaataggtgtattaaaatatgaatttgagaaattgatttaatcgaagtttgtaattttaaattgatcattgtaatttgaaaatttgaatatatattttatcttaacttatcttataattctattattatcttatcttatacatattttatcttataacagtaaataaaatacataaaattttatcttatcttatacaaatatatttaattcttatttttttatttactgttatacaatttaacttttcgttatatatatatatatatatattaaatttgaaatttatataagacataagtaggtttgttgaaatatgaatttgaaaattgatttaatggaagtttgtaattttaaattgatcattgtaatttgaaaaattgaatacatattttatcttatcttatgattctattatcatcttatcttatacatattttatcatataacaggaaatagaatacacagaattttatcttatcttatacaaacatatttaattcttgttttttttaatttattataataactaaggtttcaaaaaaaaaaaatctggcaccattagtactagagtgacgtgattagagtcagatatattggaagttggcacggttaccgtcagaagtactccagaaagcatgtttttctctggaacttggtgtgaatagcgccagagtagcacgatcagcgctaggacacgatctagaccactatataaggtcatttcacgcgtttttggggaccaaaaacctatcttcttcctccccactacgttttcctccattaaagagcttgagaagctccagaccactcaaccattgaccaaaacacttcacacccaacatgaaacttgtaggaaatcatcctatgagctagaatccttcatcactttttcctaaaaaccatcaaacagagatatcattttctctagtggagaagttgtccactagccttccttgtcgatttagaggtaggaaacacaaattctaccaattatttaagaatttgttcttgaggtgaatagtatctcattggagttagagttgcaattaagcttgagttctttataaaagtatgcttaggaggttgttgtaatgaagatttaactttaaaatattgattttatggactttagaatttggctctgagaaatgtatgtgtaggaagaatgttagttaaattggtgattgtatgacatgcatgagccctgatgtttgtacaatatgtgctcaaggggctatataaacagtaaaattgtgttgaagtaaccgttttagccatattgttaatccttgggttttggcctgtatagtgttgaattctctgaattggttgatgcagagtctttgggagactctagtgacttggttaggccgagatagatcctgctgagggtatgtgagttgacttttaggtggttagttctgataaccttaaggtagaggactaagaggtttaaatggaaaagaataatgtttcttttcattctaatggttgagaaccgttattgattgtttgtatgccttcatgtagggcgtgatacggatactactggtggttatgaccatgaagccaagaaagctgatatagcgctgagagcaggtaagttctttcttcttgggagtgtttcctattgactgtgttccaccatactccgagggagtgctggttattgtatgtcatgatgcatgtgtattgaaattgtgtgttactgcttttattgagaacatgtatatgatgtacactgtgatggtatgttatgtgattgatgagattctctgaccagtagaatagattacttatggacttcctttagaaatgtgtccttaagtggatgatctttccttggaagtgtcatacatgtccaagtaagtcatgagagaatgtgtccttcagtggatgatctttctcaagcattggtatgaagtcctgagggaatgtgtccttcagtggatgatcttcctcaggcaatgtgtgcagagtcctgagagaatgtgcccttaagtagattgtctttctcagataatgatgcgaaaagtcctgagagaatgtgtcgttcagtgaataatctttcttaggcaatgttatatatttgtatatatattgttacacctgtgttgtgatatacatgtgatatgcttcatgagagtcgtgatggcttgttgtgtgatatgtcaattttaatactgtgtcatggaagtgaactagggggagaaaaacctccaaaaatcctgattttactgagatttgcatctcaccccgtgtgtggggattatgttttacaggtgatgctcagcgagcagatggtggatctcagggcaagaggcccgagctctggtatggttctgtgggaaccttaggcatatattttgagaacatgatgactcttttctgttggttatgcttgtattttgtacccctgaggggaggatgcatagttagtgtgttttttgtatatctgagagatcgatgtatgtaaagaggatagggtatatgataccttattttttaccgccattattttgatacataatataaaaatgttattgtgatgacgtcactttatttatcgcttccgaattgattaataataattaattgttgcgcttaagaccataaataaatgttaatgagccggatacatacgggtcattacatttactattatacaattcaacctttcgtgttatatatatatatatatatatatatatatatattaaattgtaaatttatataagacataagtaggtgtgttaaaatatgaatttgaaaaattaattttatcgaaattatacattttttaagatattactattttataattatcatatttaaatattattaaatagaaatagaaaaactaataaaataaaaaataatgcagtattcatttaaaaattaatattctatttttaaaaatattttttaaattttactttcttattaattcgttaatttattcccgttaacaacatgccatatgatgtctgtttattaattaatttttaatttaaaattacctttttccaatcacacactcaaaaaacttagtatcgtctctaaactctgatattaatattaaaaaaacttttttttgcttaatatctacaaataaatcctgcacaatgataactttattcggtattatttgaaattctttcaaataacgacgattcatcaatattttttaaattaattttaaataagttaaaaaaatttagttttctttattagcataattatatgaacacatttggaaaaaaattgtaataaatttgatgttcatattttctttatatttggtgatttaaataaaaatgttccaataattattttaaataatatacttattttcaatgtatatgtctacacaaattagtccttaaaatattagaactaatttgtgcatgcccattttgggtatatatttaatattttcatgtattaaatataattaattaaaataaatattctctattttacaaatataattaatcattttacaagaccataaatttatttttgagtatgcaacatatgttcaattaaaaatataatcaatcggttttcttaattttgatatgattatatttaatatagtattacgaattaaattttatttatgtacatttatttttataatgatgaataaaaatataaaataattatttatatgaacttgtgcagtccatggttttaaaatctagcataataagtatgattcattgaatataaattaattttaattcctaaaagaatgagatttttgatattttagtttctaaaatttaaaaaaatgcatcaaattattcacatcattaagtttagttcactactattaacatttttgtttgtgtgacaagttttatgcacgtatggatgacacttaggtacaatatctcataacttttacatgactatcacaagttagacaattgactatttaatttaatttatgaacttaattacttttattttggttcatgaacttaactacttactaacattttggtctcttaatttaatcacttatttttattttgttctttaaaagtacttttgaattttcaattaaatattatgttacatataagttattaacttaatcatcaccatatccctactttcattcattatcactcatatttttcaacttttttttcgcacttcatattgactttcacctccatcaactgcatgacaagcttgatatttattcaattgaaacatttaaaaaaacattgactagcttctttaaaaaattacattttattcaattattttttttcaaatatcttctttaacactctcaaataactattacattcaaattattttgtgtctatatataacttgcagtagtagttaatcaaactaacaactttcgttgtttgcattttctgctttgcttaatccttttatttttccttcatttgtaatttttaaatatttaacttttaataagtaatattttttttttatttttctactatttttacacataaaaattgaaactaattcttattttaaatgataataacattaacggttatcatccttgagttctagtcttgattaaaatactagtttttacaattcatatgttgtgatttgcatataccacaccaattcattatatatagatgatgagattccattgatgcagagttactccttttttcttctttgatagatgatcataattttttctaagttcgactactactaagaggtctaccaaagattagaaattatcctcgctaacaatcacatggatcttgtgtcaccccttccttcaacttacacctccctcatgctaaaaaagtttcctccacaacttttcaaatgtcataaaacaatggaaatcatcactgctttgcatgccactagagggtcatgggttcacacacccctaatatcagagacccttgaacaatgatgtaaaaatcacaaagaatgaaaaaaaataggaaatacttataacacattcatttttctttcttctatgattcttaagttttttaattatttttttcatgattagtgttatttcataaaatagattaattatttaacttattctttttgcttcgaaaaaaatgattattctaacattctgcacatttaatggcatataagttttagaagcttggtttgggtagaagattgagttttaaatcttctagaatcttgttaatggtatcttgaatttaactgttaactattcctatgtaattgctcataaataagtttcatagttataatataatttgctgaatctcataagaggaaggtgaaaaccataaggataaagaatgaaagtgagaagatatggtgatatatatgcaaataatttcatatgaaagttaaatcaaaatttgaaaaaaaatttaaggacttaaatgagagttagtaattaagttcagaaactaaaaaatatcaataactaattaagtttaaagacaaaaatgataataaatatttaaatttagagactaaattaaaaagtcaattttttaaaatatgacaattgacacctaccaactattatctgtcacttatcatttacatgtgaacaaaatatgtcacataaataaaaacattaacattaacacactaaactcaatggtagggttatttgataattttttttaagaaactaaaatgtgaacctcccattttttggaactaaactaaatatttagccattgaatttttcattttctcaacaatactctgattcatatgaaaggtacttaaaatcgtgtacttgggcaccacctcattccaagtacatcagttgcaatttccttttgttacatttagtcatcccaaattgtttgctgaataaaatttaacactctcctcttattcgtctcatcgcataatataggctacaaaaaaagtctatttaaaaccctttttaattgtaaacacaggaaaattaaaagaggagggaagagaacaaatttacaggcgagagaagagatcctttttagtataagtaaaagttatctcaatatatattaaaacttatatgtcacgtgttggttggccagtattataatttttttttttacttctctcttaaactctttatctttttgtttttatctgtacttgtttttttttttttttttatcgctgcaacctagttaatattaataattaaataaagatttgtcaactcaatgaattcaatttaattgataacacatattaaatctgtgaaggataccctgagtttgatgtgcattgataatttatgaatttacagtataacctttcctcttaatatatgtatactctaaggaacacgaaaaaaaaaaaacattctcattgtagatgctttcatcttaaaagtacaacaaacattttcatttttcctataaacgacgtgtcgttgcatcactgtaaaacgcgtgtttgggacaaacaggtcacgaacaaaaacaagaaaatattggcatttgagcagcgcaagtgatgataagaaacgcaagaaatatgaggtcgaaatctgatatatcccccaattcgcataagagaagaatctagaaaccacaatcccattggacctcgtttctccaacgtggctttttccaaacgctaaattgctattcccacaatcagagccacgttccccatctctgccactgccatcactcactaccttcttctctgttctcaccaatggcatcaacaatatcagcaatggccatgatcaacgccaaatgcgtcaacctaaagttccccaatccgacgaagctcgcaccatcaaaaccctcccttcagatcaaccttccaaagggcctcatagcctcacccgaaagcactaaactttccactgcgacagcaatggcaggggcaatattcacaaccctcggaacctgcgacgccgctttcgctgttcaacaaatagccgacatagcagaaggcgacaaccgaggactggcactgttgctgcccataatcccagcaatagggtgggttctgttcaacattctgcagccggcgctgaaccagctgaaccgcatgcgcagcaccaaaggcgtgatcattggcttggggcttggcggcttggctgggttggtggctgcgccgcatgcatcggcggcggcttctgaagctgctgctgctgcgagcgacaacaggggacagcttcttctgtttgtggttacgccggctattgcttgggtgctttacaacatcttgcagcctgctctcaaccagctcaacaggatgagatcacagtgatttgatctttgtgaagtttaaaattgggaaggggcttaaatgctgtgggatatcaattatcatcatactaatagttttcatgcaacttgtatctaatgctatatccgctttctttttattattttccattcccaagcaagccagtggtttcttttttgttgcaactgttgtgtgtaccttcccttttgcgatttttagatctgattgattgagttcaagtttgtactttctttctgttgttgaatctacaaataagctccatgcagttttgaaaggttgattaattgttgccttgcacctgctgggctttgcaacggaaagagaaagagaaatgtttttttttttttaactctaatcctcacttgttttccatttttactcagttttgttttgttcggtttcaaaaatcataatttatatacagaacgaacataataaattatgaagtatgaataaaattcttagaatttcaatttagaagttaattcagcctcataaaatcaacttttatgacgaagatcgaccaagttttataagttcaatctctttaaactatatttctagctgtgtggaactaaaccactgttttaattaaggtagttaatgaagaggtcacaactaaggtggattagaaatgagtgcaattaaggtgacattctaacactttttctcaaagactacttgtctagagtgtaacaaatgcagattgggtttaaagacctaattcaacttaaaaaaatgacccttcaaattaggactatgcaagttttataggctctatttaaaaccatatcactgattaacatgggattaaatcaacactttagaggatgcaattacaattagttgatgcgaagtttaaattagggattaaaaacagaaatccgaaaaaaaatttagtgactaataaactcaaaatcttaaaataatattaattcctaatttaagaaaaaccctcatctcttcccacataaattcaaaataattctctaattaaaaatttaaaataaaaaatacaattaacaaactatatcaaaattgagataatttggacacgttatgagatgctcaatgaatgcttcagtaagaacaaaaatttgttatcaagagctcgacatacagataaataaaggtaaaactaaacttatatgagaaaaggtagttaaacaagacctaatggagtaagatatagattgacagacggtatattttaggacgaaatggagaaaaattgtaagtttggtagatgattaaatccattattaattatatatttcaattatttccttgtgttagttcttttcttatttatatttttttcttctcctctctttttctctttttgtttcattttcgatctatctttgaattcatctaccaccaactctaattaacttagattaaaggtgttgttgatgttcaaaagactatgtcaaaacatattcatttataaccaatatatccaaaataattgtaaaacttactatggcaagtttgagaaaagaggtgtttaccacttgaagaccacctaaagttatagagcaaaattttggctatatttacacgcaaaatattcttaaatataatttgtattaaaatattttggatgttgctagtttcgaaccgatgacttgaggcttgaaatttaaactggaaacgaacaaataacttgggaaaccaacgtcttcattataatgtcgtgccaaatattatacacatttaataactatgaaataattaaatgaatcccaataataataaaagatctcacaaaaatctataaatcttctctctagaatgcatataataatgtttaaggtcttatttatagagtttcctcatttatttattatatatatctaataaaaaacaattttattcaaatcaaaatataatcattataaactataaaattatccttttaattatttaacacaattctatatctaaatttgcatatattatttatttgaatgaactattacttctcttataatttaaatattttcttttaatatatatatatatataatttatacttatttaaattaaaaactaccgacagtttttttcaacagaggttcatgaattcatcgtactagggtctagggcaggcagcaagaaagaaaaaggttggcgtgtaagaaagaaatgaaacaagttaaatatctgtgttgtgtgcgtctctgcaaccggtgcttgaaatcaaacggcttagtctgataaagcatcccccatttcttcgtaccataccaacacgccaacaacgacaattgtagttgccgtcattagtactatagttataattaattaaatataaataaaagaaagagagagaagagaagagaagagtcgttgtttggttgccaaggaaagcatctctgagaaacgaacagaatgatgatcgactaaatgggacctgcacttccacttccactcgctgtgttcaaatggctttagcaacaacaatcaccaaccattcccatttgtcttttactatcttctttcactttggatcaaagtctgcgtcaccatcatctttactctcacctacaccactttcttcttcctcttcctcctcctccttcttgcgcttctcacagcgctctttactgccatgaacctctgcctcacgctcgctctcggatctcagtcgcagatccaccttcagcgttcaccatcactaccactactaattcgctttttctcatggacccatccacttctcgtccagctgtagtcatcgataatggctccgggtacccttttcatccatttctatcacccactttctcttttagctttatgtggtattttttttcttatgtggtgtggacaccatgtgtttgttgaatgccccactggtgttagttttataactagaattatctttaatgttgattgacctgaattgggtttactctgaatttggaaaatgatgttttctttgcaggtatacgaagatggggtttgctggtaacgttgagccttgttttattgctccgacagttgttgcagttaatgagtcgtttctgaatcaatcgaggggctcttctaaaggcaattgggtggcccagcacaatgctggagttatggcggatcttgatttcttcattggggatgaagcacttaccaagtctcgatctagtagcacttacaatctcagctacccaattcggcatggccaggttgagaattgggatgccatggagcgcttctggcagcagtgcattttcaattatttgaggtgcgatccggaggatcactatttcctcttgaacgagagtccattgactccgcctgagagtcgcgagtatactggggagatcatgtttgagacttttaatgtgcctggactttacattggtgtgaattctgtgcttgctcttgcagctggatacacaacatccaaggttggtaatcgttagacccgaaaaagattggcaattatgttgaatatagaattggatttggatgattaatcttgaatgctgtgcatattaattatggtctcagcagcaacaagtttggtagctatctaaacacaaaatgcactggatgtttcatcagcccctgcaattcgatacttttggatactttcacttgaaaccaaaagtaagccgtactgtagaatatgaatgaactgttgaggtggttttgcattattactagtgcataggacaattcttcagctcctctcattatgttaaatataaaatgttaagctgactctgcataattatacttgactttgataactgtaacacctcaaactaacatgaggcttttcaatgtgttttgttctcacacgttttccgagaaattttccagaaggtcatctatttcataattgctccaagtcaagcatacttaattgtgaagttcctatatgatggactaccgaaaagtagatgcatcttgttggtaagatagtaccaattaattccttcaagtcatcctcaattgtatagtctcatacctacccaacctttgaatccttctcattctggtgtgcttctattggggtattacaataacaataccataagagctatggagatattttgtttcttgttatatctgtcttattttaagaatattttccttttaggatgatctggaattcttcttagtgtgaaatgacaggagttgtagtggatgttggagatggggctactcatgttgtacctattgcagatggctatgttattgggagtagcatcaaatcgattcccattgctggaaaggatgttactctttttgttcaacagcttatgcgggtgggtaatccttctggtataaaattaaaaggttattgtgcctgtattgttcccatatttgaatatctgtgaatttttgtaaacctctttttaatgttgaaagatatcataaattaccatttacactagctagtgaaaccaatgtgtaaatgctaatctggatgaatagggtgtgatgcacttatgatggtatttttgttacatttttaatagttaataaataaaaaagtgaagtttacttatttcatgattgattatgaaacttattcgtgtatttagctatatatttttttgttgaactgtctgagattgtaataatccacatccaattgtcaaactgcattttgctaagctagattgacaaactgttgtgttgacattgcttcgtgcaggaaagaggagaaaatgtaccaccagaagactcttttgaagtggcacggaaagtgaaggaaatgtattgctacacttgctctgacattgtgaaggttgtctttatttcaatactcagttctttgacagaattatttgaggagtttgtggtgcgcctctgccaatagttttgttgcctctgccatttgcatgtctaatgtcaataaatactttaattttctctttttgtgaatcaagggatgtaactcaagtgatcttttaaactttttagttttcctacataacattagctcaatttctctcaggaatttaataagcatgacaaagaaccaggcaagtacatcaagcattggagagctattaaaccaaagacgggggcaccatattcatgtgatattggttatgaacgatttcttggccctgaggtttgttctatggccactgtttagattttctctattatggaatccacttgagttttttaactattgaataattcatgaaactgtagtagtgccttggtgtaattcctgagctaatctataggttcagttggggtcattatatcaataggaccagccaatttaacatatctgtatgttttcccaatgatttctgcagactttctttaatcctgagatatatagcagtgactttactacccctttgccagttgtaatagacaaatgcattcagtctgcgccaattgacacaaggagatcattatacaaggtgaagtactttactgacatgtatatattaataatccccaggagtgcttttaaatttgagtgaaccatcacttccaatcataaaattagggatcttccaaggttcaatgttaagcttgaggcgttttttcttgttggcccagatggagtacattagtgtcaagtgttatattagtccatcagtccagccacgatattttattttttatcatatgaatttcaagccctttagtttacttgttcttaatgattgatctctttatctcttgcctattttgtattttttatttcagaatatcgtgttgtctggaggtacaaccatgttcaaggattttcacaggaggttgcaacgtgatcttaaaaaaatagtggatgctcgtgtcctttcgtctgaagcacgcttaaatggggagataaaagtaagttaataggcacctttaaaccatctttaaacttatcattctctccctcgcttacacacatggatgagaaattcttatgtaaatctgtttgcacaagttgtatggattaaaccaatcaaaaatcaatacatcattatgttgtattaaataattacataaattattttgtcacataattattttacgttgaaaacagtgttatgctggttgttgattggtttggttatgtaatttatggctcaatacatcaacatcaacaacatctttaacccaagttaattgggatcagtgatagatgaacccaatgatagatacgaggaggttgaaaaaaaaagggtaaaagcaaagaagagggaaagaagaagggggagatgaagagaaaaataactaaaatagaaccatctggaacatagagataataacgggtctaaccctccaccaagtttataacttttctctattatgttctaagacacatcgtccgccaatctatatcccactctattaagtctagtttaactacctttccctaggtaagtttcggtctacctctacctctctttgtgtcaaactcttggtaacaaactttaattctcattagagcattcaagggccgtctcattacgtgcctaaatcacctcaatctatgttctctcatcttttcactcattggtactactgctaccttttgtcaaatatcttcatttcttatcttatccatctttgtataatcacatatccaccttaacatcctcatttctgctactcctattttatgctcatgttgtctatgtattgaccaacattcagctctatataacattacaggtcttatagttgttctatagaatttttcttttagcttaaggagaattttgtggtcatacaacaacccagatgcacttcgtcatttcatccaccctgctctaattctatgatttacattctcatcattctctccacctttttacaaatttgatcccaagtatctaaaaacatttttcttgggtacctcttgaccaaatagatgcatgaagttttgatcattatcttttaccaatgaaaactcacatttcatatactcggtcttgctttgacttaacgtgaattctttagacttcaaagtgtttcttcacaattcaagtttcctattaacatcggcttaacttttggtccaacacatgcatgaacaaaattgtccccttgatatagttatggcaggctgtactgctatatatatttattgctttggtcttgcattaactttttttacttcattaatttggagcctacagtcacagccagtggaggtaaatgtactcagccatccaatccagagatttgcagtttggtttggaggatcagtacttgcatcaacacctgaattttttacggtatgcatttccagcattttttggggggttatgaggttcaatgcgtgcatcctataatcactaattttgtgtactaatagtgtgttcttccatgtaattggaaagggggtgggggttgggggtacctgttcaatgattaacattcttccttgctatgacttataagttataagtaccataccctgaaaaaaaaaaaaaaaaactctcttttgatcttgagcacattggtctgagacaatttgttgaatggtatccttccctcttatcttcgcatatctttaggcaatgaggtacgtagttttttttatgtttggatttataggtttgagatgtacttttatttgttgacaataaatcttagattatttcttgtgcatgagaattgagaaagcagtgatggatggattgcatgtcaatgtcacatttgtaattggttgtcgatgcctcttttagatgcacctttatttgttgacaataaatctttagattatttcttgtccatgagaaagcaatggtggatggattacatgtcaatgtcacgtttgtagttggttgtctatgcctctttgtttgacattgataacctgaattttgtatgctttgccaggttaaacgaatctacgattgcatacatgttaacaaaatatctggtattgtttgttaagttgaaatatgaaacttgaacaatgtaaaaatatgacatcagagtttttttctttttcttttggtttgccatcgttgtgggttgcgatgtgttgtcttgctataatgttctcctagtgaaagtatgcataatttcttaatgtttcttaaatccttccgataagtctcaatggaaaacgagagaagttttacaatttttgttccaatgtacaggcttgtcatacaaaggcagaatatgaggagtatggagcaagcatttgccgtacaaatcccgttttcaaggggatgtattaaagcaatgatgaattaattagttgatcatggatgcagttacttgataaacagttgaatgaatatccggttattttgatcctcaattcccctgctggtctttcttcccacccgtattcgtggtgtcaacaccaccaacgacctcagaatccgacccggttactagctcctcctacgtacgactcctaagatgtttttcttcttctctctttctttctttcttttggggtattttgaactttttttctcggtaaagtgttgctcaatgattgagatttgagaggtggtgatcgttacggtgggtgatgatcaaaatcgcttattgcaccgtgtattttgcttaggggacgatggatatatgatagcatagaattaatacgttatattgatagcattgtacaagaactccagcatgtaatttttttttttgctgaattctccagcatgtgtattttaagctatgttatataatagtatttttttaaaataatggatttttatagatcacttatatatcatataaggagaaggccgtcgtaaaacattgttagaagttattcttaaatagaagtgcttctacgagttatctgtgaacatttattttgattgagtctcatgtcttatcttaatcttatatattgaatgtttttttaattctttattcctttaaaatatatttcttaatttaatttgatttaataattactccaagaatttatttctcaactataggcatggcaacgagacccaagcccgtggatatccgtcaaaacccacccgattttaacgggaaaaactcgaatttgttattgttgatacccgtccagctcctgtcccgcgacaaaaattcggggacggaggcgggtttggtattgatgatatctgcctcgcccccgcccccgccataattaaattacaaatttagccttatatataagaataaaatcccgaaatcctaaccctgcccctcatttctcattctcgacggcgttgaaccttgaccaacaactttctgaattaattccattttgaaagctttgttgctgcaatggacctctactctttgttgtgttttattttaattttggaacaatatatatttaaatgatattatattttgggagaaattaaatatgtaggtccataatggttttaatcaaattgactgattttctttaataatttttaaattatgatctcatattttgaatgtggatttgttattaatttttttgttacctagtcaacttttttccgtttttttcaaaagaaaagccacattatttttttaattaatagtaggggtgggacggaggcgggacggggaaaacccgacccaacggggacggagatgagtctgaattttaaaacccaacggaaaatagaggcaggggcggaggcgggttttaaaggcgggggcggggacggggaatacattacccgcacccgccccggcccgttgccatgtctactcaactatctcaaaccacttaccttttatttttatttgaaccacttaatttttttaactacttatctctttccattatcatttttatctttatttctaaactgaatttcaataattttttaactgataataattaaaaataatcttgtattataatattataaaatataatttgtatgttaaaaatatttatttatcatgaatttatatttaagtgcatgatccatagggacaagcgaagccatgttttacagtaaaagaaaaaaaaattaaacagttgattagtatatgacatcacatatctatatataattattgaaaataaaattaaaacatattataataacaattcatacaaataaaattaaagtgagaaatgatagtccttagttaatattcagtctcccttttgattcctgcggcggataccgatggacaagcgccaagtatcaagtagtgtctctgggattaagtttgcaaaacaccactgaattgagtgagcccaataaggtgtgcaccttggtttgtacccaatttcaccaattgcagctcttgcataagcctcagctgttggcacgaacaaagaatctctctcaatacatgccacccttgataccatattcgttgcaacgtacaggggtaccttcattcgtgatcagaattaaatatttaatcataatatggagtagtttacccaaaaaaagaaaatgatgaattcatcatacgaattacatcacaatactggactcatcccttgatattatatatattggttgcaacgtataatggtaccttcattcatgatcagtattaaatattaatcatgaatactaaagtttacccaaaaaactgagagttaatcatacattgatcagaatacagaagtcatgcatattattaattaactaataagcacatgcaaactgtacttgatcactcatttccaatagttgatattcttttctaagactttaaacatgaaataaaaatactatgaatgttaaaacactgttcctgcgagtttataatgtagctgctttagacatctagataagtttacaatagttttctctagctgatccaaggcttgataatatgtgttgcacattacctttagtctgtagccttaattataaaatgtcagttcgttataagaacaaagaaaaaacaaaaacagtctaacaaattaaagtagacatttgtaagtacctgacattgcacatgtatcccgtattgtccatactccacgtacagagatcttgataactgatccacgtaactgcatctttccatcgtccaattcactttagttttcagtactcgcctggggtgttaattaataaagacactatatatgcatattattttatttgacttatgattttatgtttataatattggtttgattctgatattctgtatatttatattgttactcgattaaaaattatcttaaatttaaattttgacttataaaacaattattataaaaattaacatttttaatttagaataaataatactgtaaagatttctcttcactatcatttgataaaaaaattatcatgtgtatgataaataagtttgttgagttttaattagatctacataacattacaaattatattatttttaatagtgtcattttcattttcttaaaaaaaatattagctgtgtttattcacatctctctctatatataaaagctcttagaactttttattcacaaaagaaaagctcttagaattttttatatataaaataatacagaatgtcagattactatcataccaaaacaatataatattatgcttacaatatttttataattattttttaatttttattacatcaatcattttattttgtaactttttaaattaaaagaatttttttgaaaaaaaatatatttaagaataacattgccctcattaaaatatagttgagtgacgatgtgagaattgctgtctctcttaaaggagagttcagtctcattaactttcgacagtcacccgcatatcagtgataataaccacgaaagtactaaagaatatgtctgaaatttttgtaagtactcgttgaagcataaatatacttaagaatttagaagaaaaataagaagagaagaaaattttaaattaatataaaatttgaagtgtaaaaatatcataacaagataaagaaaaattaggttataactttttgtatttatttttttatattttttatctctcatttcactatcacataacttatgatagtatttatataattttattcattttttctttttttctccatctaaatccttttcaagatggatatatgtacaaaggatcgatgtaaaaacatatcatttttgttgatgttaccattattacaccttgtttactttgagagctttgtcctttagtggtgggatattgattcagctcactttaattagccaacacgaagcaagttaatgcttcttcatcgttcttattttcataataaaaaaagattcttactaactaggttctttagccaatatttttaggaaactgataaacctttgtcctgaaaaaaacgtcattcttatgaacaatgctaataatcatgttttcagttaattacttactttgtaaaagcatttttttcagttagaaagataaaagaaagaaagaaaatggaagggttttagatagaaagaaaattaagaaagcttacgcctttgtagcagcatagattgtaaagagaggatgagaaggcacgaccacagaagcacccgatccaatgttaacaatcgcaccctttctcctctgtaacatcccacgtaaaacaattttcgttactctcgtggttccttcgatgttcactctaacaatgttcctccaaaccttctcctccacctcatgaaagaacatcgccctcgggtacgtgatccccacgttgttgatcaaaacgccaacatccaaaccctcgctcgcctcctccacgcgccggagaccctccgacatgtcgccgccggcgaagtccatctcaacaatcttcacgcgcgtgtctgggtatttttcttttatttcaccggcaactgtcccaagcttctggaagcttctactcacgaggataaggttgagtcctctctgcgctagctggtctgcgaaggcttttccgatgccgtcggtggctccggtgaccagagcccaggaaccgtagcttcggacgagattcttctcggatcggaaacaggttgggaagatccaagcgaagaaggagatgaggcagttgagggtgacgatcaaaccgaggcatgagattatgagtactgtgaggtagtactcatcaacaacactgctgcatgtaataactatacgtggcattgtcgtctctttttcttgcctatagttttttgcgggttttcctagtttggcagaaatgggttgcgttaaatattgtgacaggtgaatacataacagtcatatgcacggaggttggggatgcaattaatgaatgtgaaacaaataagcattcctacacctaacaaaccacataaacatttcccgagcataccaaattgctgctatgctaccatcacctttacctgtcaagagttatggaatggaatccacttcggaagtgaaaaaggtcgatgtgctggtgcaataaattcatgatcgaggtagctctatcttttagtgaatgttttaatttggagtttataattgattttaaatatatatatatatatatatttggttttactttaaaaaataatttataattgattcctagttgaactaactttgaggaatatgtgttggatataaaattttatactgaatattttatttttaatttgattttattataaaacatttaaacataaactaaatcattttaaaattaattttaattaatattaattttatatataaaatcaattttatcaagatcaattcaaacacacacttagatctagggtgtgaagaaaaacaaaaagtttgagataaactgattttacacctagcttgaatcaaactgatttggtgtcaagcaagttacattaaaacaaattgaattaatttttaaaataagttcgatttgaaccgaattattttttctaaacaaatttagtaaagtgaattgtttttcttctaaattgtgtttttataaagtagtttgaaaataagtttgataactgattcaattctataattagttcaagacaaaatcaatttgttttgaaccaattctctaaaaaaatttagacatttgaatttgagaactgaattgttaaaatggttcaatttttttttaccgaaccaatttgttcatacctctagtttagatcgaaatcgaattactgagatcaaaattattagttataagctaattgagtgatgcattcggatgttggaaacacattttaattaacacttaagttggtatacattttaataaaataatgttattaattagtataaaaaagtttgttgagattgattgttttttatattttagataattttttatgaacaaataatgaagaattagtagatacagaaaatcaatatttttttagattaactaacacgatactcttgcttttgtgtgttttatagacaattaaataatataatacatatttaatttattaagattattgttgttaaaggaatcaatatttatgttgagtatattatttacaaaagtctaaattgtatattttttttttgtgattagtaagagtacaataacaataaaatgaaaacctttagcttagaataaatatatataatgcgagtttgtatattacataacatgatatcatgtaagatattgagatagtagtcattgatggagttcaaatttagtgtattacacttttaatttccttgtggttttttgatgatttaacaagacaaataagaaatcacattggactgataaatggttagctaggagacaagcctaaatatgttgtttcttcatatatttcaaattattttagataattctacagtttttgtatgagaagaggaaatgtttgagtctctttaagaccttcttcatcctatcacattatgtaaggaggaaaaagactacttgatttagaaggaaaacagttctcatgttctattaagttggagtacgtacaacttgctgcattcttaattaacaagaatttgcttcattcttcggctaagattgttttcataaatttttagacatgcatgtgcaattcccttgaaggtgttgcccgtgttggcgtatagttgaaggcttctcttagtagacttcctacacatttgcagcatttttaaagaatattttactattttcttaattttaagcgtcaatttaattaaccattacagttccagatagatttactcaaaactcgtcaaatgtagcgggagggattataggggttatataatctactaatcttgttcgttactatatcgatcaaatgaagttggcaaagtagaagcaactagcagttgtgaattaatgattcaattaacttcttctaaattgaattattgaatggcctaatccgttttgcttgaactgagcaatgaggagtcacgtgaattccaacaaccaggaatggtcgccatttaagtccaacctcatattctttttgtttctgatttgtttttctgtttcgcatgtttgcttgacagctaacgctattcttcatatgaatcaaactttattgcttgaattttatgctttaccttaatttgtattttgttttgtcttacacctctggattggactagggtctttaattactctttcatcattctaggattagttaactgttatgctggcatgggattaacattgcctaagtagaataatcatttggggttaattttttgtttaaatatatttgtaatctttctacatatatatgatcgacaagttttagttattccaattttttagttgcttttaatattcataaatttatttaatttttaaatgatctttaatttagtgagtatatataaggatatattaattaaggatttcattgagaacgttagaaattaagtaaaaatagaaaaaaccaaaatacattcagccaccaccaccatttatttgctacatgtgtagcgaaatcataactgataatgatgtataaaaaagtggttcaagttagatttgccatgcttggcaattaaacatcgtctctttttaataataaaagctgtccctgtcgtaattaaataatatggaatatataaataaataatttaattaagtatttgggatgcatgtgtttcagtgaggttgcgtctagaaaagtttttaaatattattttaattttttttatacacttccttctataatcatatataagtagtagttgaattttttacattttttatccatatatttatttatacatgtgattggtaaattatatttatttaattatatttatttatacatgtgattggtgaattttttaagtttatatatatatataaaggacatatcatatgataataattcttttatgtgaaaatgagaatgatcatttttattctttaaattataataaaatgttaaaattaaaatattctaaatttaagttaaagtctcatctaattataaaatttttgtaagatttatgatattctaaaatatcttaaatctatcatcataattgtcaaccgccatcatcactaccaccactagttgttagccttaatgtcacaagcagcgacagtgataatggcagtgacatcatgttggtggtaacgacgatgataataaatcttataaagattgtatgattaaacgagattttaatttaaattgttttaatcttgaatttttattttaatctaacggatgagaatgattaatctcaatcatagattaaaatgaaatgtcaaaattaaaatattttaaattcaaatcaaaacttcatttaatcataatagttgtggtgaggatcttaattaaattaaatctttaaaatatttaattttttatttgataaatcttataagaattttaagataaatggatttttaatttgaatttaaaatattttaatcttaactttttattttaatttaacgactgatatttgagattaatcaatttcattctctcacataacattgttatacatacatatttatatatatatatatatataattttaattttaattttaacaccttaattaatgtatattttaatcatgttttagttattaaatattttaagttttgaaattattgatagacgtgtggagattttttaatggaaatgattttcaatgtttaaatttattattcataaattgcaatgatggttttataatatatgatacttaattttttgttttttttttaaactaaaaataagtaattgcctagctgagctcatcaacatcacgaagtaacagcaagaaaaacatatctgtttaactaatgcctttgcaaaaggtagttagttattgattctcctatttacatattactttgtgccggtgcgtacaacaagtagaagggaaaacatgttaataactggaagctacaacaatggtttgagaaggctctgcaactattttctttcttttctttttatctcttatccgtggtctggagacagatgagacctcagaagaaaaactgaagagaatcatgatatacgtcccaagcagcaagaaacacatccttatacccttgtccttgtctagggtctaaagcaaaaccactttttctgcacccaagatcatatgtataatattattaaatattgaacttcattgcaaaaagaaacaatcgtagaaacacattcacatgatttctgtgaaatagtacaagtttatattttctgtttttaaccttcaaatgaccaatgaaacacatgtacatctaatggtgagaaatctatacttttgtttctcgtactaaatagcataactctgtattattgataagtaactagcagggtttatcatcatctttgcgcgaattatttcttcgctgtgatctaatgccccctgatcctcctcctccagttttttttctcgtcactggcctagcttattgaatataacagtgaatccttcagctgaggcaggatcattcacatcccatttcccgaacttgggtagtggctttccatcttgttcatactccacatgcaaacataaatgcttacgtcaaaacagagattaattattcatagaagatgaaaaataaaaagacccttttgctcatcattaacaacaaagaattgctggaaacctcggtacatagctaaacctcatttccattttgtttttgataaaatcaatgactttttttgttgttgtttaaaatcattggctagaaatgaacacacatgattacatgacatggtgggaggatcttaattcttaccgaagccatgaagattgaagctttgtgagatatgtggtagttacccaaaattcgggggaaaaggaacagacaacaaagagatgagaaagaaaaaaaaggaaaaagagaaagtattgaaagtgcagcattttataaaggggtaaggaatagaaagaggagcgcaacccaagcttgttgagatcttaccttcctgcttgccacactcgtccaaaacgcgggtgatttggttttctgtttattttccgtttaatttttaggggaatattccttcaaaaggttaagtcccaagccaatgaagccatattccaaaaatgggagactaacaaaaccaaattggtaagcaagccaagtgaccccgtccactttataaagtacagttatcgatttatggtaaataaattacatggaatgttttctaagagaactacaacagaaatctatatataatgttgtaatatacaaacttgaatttttccttaaacaatggaggagagagcagtgctgccattagtagctgcatttgcaaacatacttcttggattggtctctaactctgatttctgtatcacaattttatacaacatcaaatccggggcagggagggttagatgtatagagatgcggtgacttatccatgaagatggcaatcactcatttaatttctggtttggtgtatttgacgtgaaccgctataaaagccctccaatcaggttgttcactgcatgagaagccatgggaaccgcaacactagaggataaaattgtagcatatccataagcaagaccaacaaaggttgccctaaaacacaaacgaaaatcttattgtaatttaatcagaactaacaacacaataatggaaaaaagttgtgatttagtgtaggaattaaattcagcaaaacaattttcgataaatggggaaaaagagagaaatgagagggagagaggggaaataggaaagatatgcaccagatggcaaaggaatactttcgaccattgctaggtgtaaaacaccaaaaatcaaggcagcaatcctaataccattccagttcattcccaaaagtggaagaatcgctcctcggaaaagtagttcctggaatttaagatgacaatatgtgatatcagtcaaatgatgaaaaataaataagaaagacaaaataagccaagcagagtagcctcttttaacctcactaataccaggcaaaaatgcaacaacaatataatccaaaggctgaagtgagctaaggacctgattcagaaagcaaaatatttccagagttcagcaaagcatccatgtactgatacagagtacagacgcaaacacaaaaaagcacagacttgcaagaaaagttatctcaagtaggaacgatttctactcagatgcactacctttttacggaacttattatgatctactatatagtattcaagttttaaatggcaaaccaagcttacaaaatcttaaaggacatttccagagccatggccttgattcagttacctgctgagtggctgcctcgctagacccagcaaaatctagccacgttttcaatagcaaatagggatatgagaacatctttagtataagatcttgagaaggatcttgaactcaagatatggtcttcactagatctcctaataaaggaggtggatagatctccaacatgaaaaataagttcttataaaagaaccctcaagatacttagtgttaaaaaaaaaaatctctctcctttaaatggggcatcagcataaagagaaaaaaaaaactaaaaggagataaaaaaactaaccacaaataatgaaatttgatttttcttttgaacaatctcttacactttttctattatcaaatttatgtattttttatttcttttaacatttactcataaataaaaattatttaaattatttcatttcttagtgttcatatattttttccttccatattttattaattaaattaaatttaattgtttaattaattatatttaatttaataaatatttaaatattaaaaaatgagattcatgttagactcactaaaaagttatttaagatctcaaaatatgatatactattaaagaaaaaaatggaaaagatcttaaaatatattcaatcctacatgcatgacgctgagcaaaaacaataaaaaaatcctacatgcatgacattagtacggggtctactattattggatgcacaaaattagagtttatttgttagctttctagaatgatatttttataattttgtgaatttataatcaccttatgagaatgaataatgacgtattttctattatgagaatataatattagatgctttcatttgtgaatgatacttatttatagatatcttcatctaggatgagaaaaagattttgaatacctttatttatgatggaaaagacactaaaacgtcattgcatgaaatatgagtttatagatcctttgaagaatatcaaatccgcactagttctagaatccaaaaaattgaatcttatgattatggaaattactaatttgtgtttattatatttatttgaatacattgaagtgttattgtttatttaaatattttatttattcaggatgttataaattgcgagtgtttaaatctgatttttattagagtatatatacatataaaatcttattttaaattcattacagatattatgattgattttttggattcttacgtcgaccaataacaatactatttacaaagattctaggtttattttattcactagattattatctcactaaaaatcttatttttagagcaaaaggaataagttagtgaaattgataaggcttgaagatttagttatctttagatacattttttactttgttagtaaccaaaataatatgtggaacaagttccacgatactccaacaattgagagagagcgagagagtagccatacagcgagagtgaaactatagaagctttttccttgtatttgggattttacccttcaaaattcacgttcatactaaccaacattcgtttcttattttgacagaaatttgcaagttttggatgtcgtgtcgcgctttcgagtttcggtattacttcttgataatttcagaaagacccttcctttctctccactaatccactaatttcacttgcatcctgtataaattatcaataaattaatttgtgaaaattatttttcattgacagtagtaaaaaaaattcattataaattaaggaaagtaaataccactttaaatatataactaattaaaaattcaaatgtatatttaaagaccaaattgacaatacacatttaagttcagataccaacatatcattaaataattaattttaaggattaaaatggtaataaattattaacttcagaaattaaattaaaaaaataacaatttttgaaactgataaattaattcattgactatttgctcacaaattagttttacctaataaacaacacatataaccatttttcaatgataattggatccggaggtaggatgtagacatgaactttgagttaataaaaaagacttagatgaaggatgaatttatcctactttttacacattcgatatctaaattttaatttttttcatctttttaaaactaaaataaatatttatcctaaattaattccatttgatatgaaagtgaaaaatacacaccttacaaaatgagaaaaacatagttatgttaggaaaaaaaattactcctcaacataattttatgaaatccttgcaaataaaatatacttgggcttgtaacgatcgtttttatatggaatcatgattcatgacagtgattcagcattgcttccaaaagtttgaatttatagttattggtactcataagtatgcttgaaaattcttgatggaagtaggctaaagccttagattttattttacaaatttcaaaatttaatccagtacctatttttaagtattagcatattataaacttgtccattgtctcgcgtagaaaaatctgattaaaggactaatgtcatatattacctatttcaattttgcacttgaaaatttctttgaaaatattactctgatttagtaatttccaaatttgaaatctggatagatactattaaaatttaaattttgttagagttttcatgtttcattgttaaatggtttaaagtgatgttgaaccttactgttatgatctctaggatgggtatacacaaattttgacaattctttgtttgagaattgtactgaaaggaacctcttatttattcataatttgcacaaatctactactaagcatgctgttgagctggaaataatggtacaaatatgatgtagagtaaactcttgccaatatagccatcaagaactgagttggagaagagttaccaattttttttagggggaagagttaacaaggttctttagagcacagtggttaatattatagagcagtgaactcagtatcatgttcctttaaaataaagtggaccaggaaaatagaagaaaaaagtatgtcattcataaaagtagcagttgacaaatcctaaggtgcaaatagacaacaaaacaagatgaaataaaatattcacctttgcctagtcttgactattgactaagctttactgctatggcttgcaagttctaactggtccttctcgctctaaaagctttatttgcacacaaaatgttgaaaagaaaagcatctaccattaattatgatttctgaacattccaataaaaaataagattaatctggtttgtagaaaatttctaattttaaactcactgctcaaacacacacacggacacagacaaacacacataagccgtgctgcccattcatccacacttccatcttgtttggtagctgccacaaacttgtagaaagttaaattgggtttaccataatgatacagtacagacatgacgaacttattgattgtaatgcagttttacacagggcaaggcatgtaccacctagattggaatcaacccatttaaaatttggctatgataatatgctttttcatttcaataaacacagagcgaataagatccagaatacagaaggtgataatatgcattttaatattactctaatcatgttgcaatacagcaaataatatcacacacacaaataataacatcaaaatcataatcagatctagagtccagaaattagaataatacatgaacaccaacaaaatagattcaaatattttcagaaaataagaaaagaaaaagattggagaatagtgagaaagaaattttacgtggtccaaagagaagagaagagctcaatcacaggagatccaagggagaagaaaaaagagaaagccagagaagctcgggcaagagagagtgatcaggactcaggagcatgtgatggtaagaatttatagccaagaaaagaacatgcgaggttgaatagttgcaaacaagagtgagggtgttgatgatcagagaaatttacaaattctcagagttttggtgttatttgaaattctctcattttactttaaaaataaacccttataaagtccccattattaaaaaaaaaaatctttgaatttgatacaaacaatatattttaatacttggcattttaaatccctttaaaaattgaatttcactctcaaaactccctaaccaaacacatactaatagaactaaagatgaaacatgcaataacatagaatctaaaacaatagagcattattgacaataaaaatgatgttgtattaattttctgcatctcataatttacaacaatgccattggtcagattaaataccatgtctcaaatcatctaagatactatcaaactaaaccattcagaacctaaattgatcaacagaaaagctttcaccttgtaaagtttgattttcttctattttgggaagaagtaaaaaaaaaacaaagagtaacagctagagtagcagtaactatataacctattctgttgaagatgtataactatacgcattatatgctgcagcaaaactaatctacagagaaactagaaagcaacataagtcaaaaaaagagattgataagtgcctcccttttcacctccaacatcacctcataaccaataaagaagcctgccagcttgcaaaataaccgtgaagtttgccaaaaatgggttaactgtctattagaacttaatgcatgcaaaatttatctgtttaaaggttctaactggacttccattcttgcagagggctctaactctttatctgcagttgttctggttggcctcaagagatcaactgaatcatcttcctcaagattaccaagcacccaattgcctcttccagatatctgccgccctattcgctgcctttcatggtattccaaataaataacaatcaatgcaccaattaaaaaccaaattgccatagcccatctgagtccatggacattttccacatcatatctgtctcctagatgcttcatcccagtaaaaagtgctgcaatgccaaaaacaatggcacatctaccaacaattgtgtggaaatattcccaaataaccctcttggaggatgcctgctccccatttgctggttttggaggccttaggaaagcatttactggctgtatacaagccaacaatatagtagcaaatccaaatttaacatgtgttgagctgaaataaaatcccctaagctcagccacagcaaaaagaagggcaagtagaacaattactaaccctgagtattgcaagtaaacatgtatccggtaccatccatcgcccttgagatgttttagatacctggctgccaataaccctccaggaagcaggataccccatgcaacaaacatcataaatccatgcacagccaaaacaggaagtaaatcctgctccgcctctgctgaaccacgcatcaggtgtacaaggatagccctattacttgtactagaatgcatattcctgtcagtaagatgatcattggtccatttagcacccattgcccaaacagctttgagtggagttgtgggatcaacgatatttttacattctaccctcttttcccgcctacaagatgggtccaagggacgagtaaactcaaaggtaatgatgccattttctgttttacatctaacatgtgtcaaattttcctgcgttgcatgtatgcttgaagcatcctttccatcaatccaataagtgttaacatgtcccataccagtatcatcaatccaacccacatacacatagctgttcaccattccacttccaaaccctatggcaatataaccactttttctctcgccacgagctgcaatagatatggaatcctttgacaatgtccaaaagaaagtaacctgttgatcatccaaaatgacactgttattatacatgtccgatagacccccatcaaccacctcgaccttccaacccatcttctggtcgaacaaggaatgatagtagacgtgatcaggagtgttcctgtcaggagcccaaactaattctgtaggactggcttgaactccgtgggcctctggacctccagcataaatagtctcagtcagatttctcgtggtagcatttccaccaagcggatccgaagtaatataaagtgcaacatcgtgcccggcttggatcgaaaacttgaccggcacccctctttccactctcaagacaggagcttcctttttgttgatataaagaaccttttcaggatttggagggttggggtaatgcattgccggagcagaagaaaccaccaacggaacatttgcatctgcagtgatgagaccttgatcttctttgtcttcagcatccaagggacctgtacactcattcacatgctccgagacattcaaaaccaaatggccataattcacagccccatgattctgaggaagatagtaaggattaatagaatcaggaggcttgatacgccccaaagcccaaataaccttcatattcgctgaatggttcacaggatgatcatactttccatcgaccttagtcaaatgcctgcggtatctgacaaaggtcaccccatccttcctatggccataaaccaacattgaattgttgactaaacccaccccatcagggccttcataaaaggaatcaggacataccccttgagcaactccatcactatttctcacacactcactatacttagtaatgaaaaaatcatccacaaagggcataccatcttccttaaaccctgcaacgacaacatcagcgccaatcatgagatcagaatcttcagcactggaattagcccacccaaaagccatgtaattggtgatcccagtcgcggcctccaacccaatttcaagagaatcctcggacacgttcaaactccacctcaacctgaaattcttcgacaaaaccttgcaattctcgaacaccgtcggaggcggcggcgtcgccgggacgtccttgcggagcacgacgtggccgaaatcggaggcggtggcacgatcccagacggcgaggacgttgatcatgctccaggaaacattgctcaacaaatgcacatccaaggtggagttgttgtaggttccgttcaatccgtcgttggaaacaatgaatccggcggtgaggctatcgaaatcggaagcctgcgcaccccaccagtggacgtcggaaccgggaagcatgtcgaattgggaaaccctaaaggagcaatcgtccctgattttcagggatcctcggagttggtgttgaaccatttcgaactccaactccgaattgacgacggagctgaggcgagtgcaattgggagcgggatccgcatatacgaacaacaacaagaacaacaagtgtaggatgaagatgagggatctgcgaagcatgacgggtgcacttgttgcactgtcacgcaaattctgtggatcagaatccacgatgaccaaaccttcaggatcggatcgtaacaatgttctgtgtgcgtggcggaggggttcagttaaggtagttcacaaggttctgtcagtcttcgggtggagagatgactcaaatctagtcaatggttgttgtattgtatcacactatcagttgatggatcctgacttacacctcaccctggtgagccatctacgtggattcataaatcatgatctatataatctataatttatttatgatttattttacctatttttaacttcatatagttattataaaaaataacaaattaactatacataatttgtgagtagatttacgctgtcatatttcttcatactaataaaaaaaaaacacattgtcatgtgtaacattttttttctgaaacattttttaattatattattgattattcatcaattttatttaaaattaaatataatatcattcaaatcaatgatttattgatatttataaaacatatttaatgaaatataagacgaataaatattgattatttgatcaatcatatatattatagatgatcaaattaaaacatatataaagaattttttttataaaaaatatacttttttaaacaatcaatgtaatattaaatcttgattatttatgaagatatttatcataaattaccaatataaaaaatataacgacatgtgattttcttaaggaaatgtattctagatataacacgcgagttgttcttgatggttactgttttataaattatcaacacattaattggatttacggtaaatatattgaaaactagtaaagcctaaattgtctaaatttaaaatagctaataaaacctaaattttggcttacttgctttatgttatgcagaaagtcgacacattggtgaaaccttaagcaaacaagtttaatgtcatgagagaaaacaccaaaacttatcaacaatcttcattcttccatggctagctttcaaaggtggaatttgattctcttaagtccaagccacttccaaaatggtcttaaaaatatgttctaatggagcatgaacttacttacatccaagaaactcccataagttaactcaataatgaacagttcaccaaagtgaaagcaccaaggtaattggtcttcaccatattgcattttaggagactttttttcaagggaaaaaaaaaatcacatgttgttcctaaatctattgacaatttatctaaggatcatgcaaaatatgcatatcactcattgaacatcctacaccacatcggaccgttttttatgaatagccctactcttggaattgaatactagatcattaatttccacgtgaccacatcaatgtttagcatgtagaactttaacccaatgagctatgtcattatttaatactatatagtccactttgatacatagctcttatttagttgcctaagattacaaaccccttgcaaaccattatacttagattgcacatatgctccaaatcaattaatgacattttttaacaacagtggagcgcctaataaagttttttacagaaggattaaattttggaatatggaaatttacatcacataagtgactaaaaaaagaattaagttaggactgtcctccttagcaaagaaagataataagttttatagtcttgcaattctttttaactttatcaattaggaaggcattgttctccctggtaacctttcagcaaagaaagaaaatgccaaggtacatacctaaattatagcaaagtgaattgtcattctagatcaaataacttcaagtcatatttggagggtatactctgaaattatgattgtaacattgatcggaacaatcacaaaactattctgacacttgattaacacagtcaacttgaaattcaaccgctggaagaaatggattctttaatagcatgggacaaatgttatacagtgcaaaattaattggtaaagtgataatcatattatggacatagagataaattgtgaaaaaaaagtagtgttatatagtttgttattatcatcatttgtatatataaaattcttttaattaatttacacagattaatcaattaaaaagttggtttataagttggtagtgttcaaattgtcaaaattttttattatttttctaaaagcatccttaaaattattgagattcttcgtttcacttttttatttaattatttttatgtagttaattaatgtgtcttaagcctttttcccattcatcaccaaaaagataatgaatttatctcattaatctaatacattcattgtttactagaggaagaaagcacttcgtatttctctaaattttttaataataaaaaataaaaaattcaaaagttaaataaagttaataaaaaaaagagtgtcagagaggaaaaaaactgacaatataaaaatagtgggcaactattcttgtttagaagaacatggaagtttaaggataaatttttctactaaaatatgtacaccaaataaaaatattttctttattattagtattgattaaccacagatgaaaaagtacaaaacaactaaaggtgttttaattaaaaaattaatacaagaacaattttgaaagaattcttataaaaatgggaaaagtaaacctttttttttaaaaaaaaaatatttgttttgacgtttgaagactcaaatgtttgttgaatccaattcaactagaaacatacttcttagttaggatgctttgaaagttatgtaatctataccccaaacacacccttagaaaatatgaatatgagtattaaagtcaataaatttatcatacaaatttatcacatagaacaaattataattagatgaattcataaaaattcacattatcattacatattagtttttaggggttttatgtccaatctaatataaaataataaggattgattaagtttttaatccataaacttttaaaaatttaaatttagtccctacataaagtttgactagtcaaatcctttaaaataaattctcatcaaaacttttagtttctctcctcaatgttattgttaaatgatgatatgaagatgtacacaactgccatgtattatttttttgattatttaatgtaatttgttttcatgtctcaaatgttgcattcttaaattggataatttttttccaacaaaacaatctgacttaaaccaggtcaaaccaaattgataattttttttattaaaccaaattgatgactactttttaaaaaatgttaattgtcacttttttggtaacctttatgtgaaaattgaaacttattaaaaattattacctcttattttatatataagaaataattatttaattcaataagatcaataaaataattagatagattaatttatcataaattttaattttattctaagattatctatgatattaaattgtttaagagatgattattttttaagatgaattatcttattttattttgttcaatttgatcttttaatttgtttgagatgaattatgctaatcatgtaaaaatattttttttagttcatttttttcttattttccacttaatttttttataaaaaaagtttattcttaaataaataatgatgtcctgaaatggatctaagaactaaattaaaaaaaagaagaaccaaaataaatttttgaaaagatgaaataaaaactataaataaatcagattgaatttttttaaaaagaaactaggacaaagaacgaaataagtggtcagtattttttttttttttgcctataagttgaaacaagaatacaaaattacaaatacaaattaggaatccaagtaaaaccctgaataaggacaattgtttcagatctattctatgaactgatagtgatacaacaccatttttactcatgaaaacgaggaaaacgttgctcatttctctaccggaatattaacatctaacacaaacaaacgtgtctgtgacctaccttaaatgaacccctccgccacgcacacagaacattgttacgatccgatcctgaaggtttggtcatcgtggattctgatccacagaatttgcgtgacagtgcaacaattgcacccgtcatgcttcgcagatccctcatcttcatcctacacttgttgttcttgttgtcgttcggatatggggatcccgctcccaattgtactcgcctcagctccgtcgtcaattcggagtcggagttcgaaatggttcaacaccaactccgaggatccctgaaaatcagggacgattgctcctttagggtttcccaattcgacatgcttcccggttccgacgtccactggtggggtgcgcaggcttccgatttcgataacctcaccgccggattcattgtttccaacgacggattgaacggaaccttcaacaactcgaccttcgatgtgcatttgttgagcaatgtttcctggagcatgatcaacgtcctcgccgtctgggatcgtgccaccgcctccgatttcggccacgtcgtgctccgcaaggacgtcccggcgacgccgccgcctccgacggtgttcgagaattgcaaggttttgtctaagaatttcaggttgaggtggagtttgaacgtgtccgaggattctcttgaaattgggttggaggccgcgactgggatcaccaattacatggcttttgggtgggctaattccagtgctgaagattctgatctcatgattggcgctgatgttgtcgttgcagggtttaaggaagatggtatgccctttgtggatgattttttcattactaagtatagtgagtgtgtgagaaatagtgatggagttgctcaaggggtatgtcctgattccttttatgaaggccctgatggggtgggtttagtcaacaattcaatgttggtttatggccataggaaggatggggtgacctttgtcagataccgcaggcatttgactaaggtcgatggaaagtatgatcatcctgtgaaccattcagcgaatatgaaggttatttgggctttggggcgtatcaagcctcctgattctattaatccttactatcttcctcagaatcatggggctgtgaattatggccatttggttttgaatgtctcggagcatgtgaatgagtgtacaggtcccttggatgctgaagacaaagaagatcaaggtctcatcactgcagatgcaaatgtaccgttggtggtttcttctgctccggcaatgcattaccccaaccctccaaatcctgaaaaggttctttatatcaacaaaaaggaagctcctgtcttgagagtggaaagaggggtgccggtcaagttttcgatccaagccgggcacgatgttgcactttatattacttcggatccgcttggtggaaatgctaccatgagaaatctgactgagactatttatgctggaggtccagaggcccacggagttcaagccagtcctacagaattagtttgggctcctgacaggaacactcctgatcacgtctactatcattccttgttcgaccagaagatgggttggaaggtcgaggtggttgatgggggtctatcggacatgtataataacagtgtcattttggatgatcaacaggttactttcttttggacattgtcaaaggattccatatctattgcagctcgtggcgagagaaaaagtggttatattgccatagggtttggaagtggaatggtgaacagctatgtgtatgtgggttggattgatgatactggtatgggacatgttaacacttattggattgatggaaaggatgcttcaagcgtacatgccacgcaggaaaatttgacacatgtgagatgtaaaaccgaaaatggcatcattacttttgagtttactcgtcccttggacccatcttgtaggcgggaaaagagggtagaatgtaaaaatatcgttgatcccacaactccactcaaagttgtttgggcaatgggtgctaaatggaccaatgatcatcttactgacaggaatatgcattctagtacaagtaatagggctatccttgtacacctgatgcgtggttcagcagaggcggagcaggatttacttcctgttttggctgtgcatggatttatgatgtttgttgcatggggtatcctgcttcctggagggatattggcagccaggtatctaaaacatctcaagggcgatggatggtaccggattcatgtttacttgcaatactcagggttagtaattgttctacttgcccttctttttgctgtggctgagcttaggggattttatttcagctcaacacatgttaaatttggatttgctactatattgttggcttgtatacagccagtaaatgctttcctaaggcctccaaaaccagcaaatggggagcaggcatcctccaagagggttatttgggaatatttccacacaattgttggtagatgtgccattgtttttggcattgcagcactttttactgggatgaagcatctaggagacagatatgatgtggaaaatgtccatggactcagatgggctatggcaatttggtttttaattggtgcattgattgttatttatttggaataccatgaaaggcagcgaatagggcggcagatatctggaagaggcaattgggtgcttggtaatcttgaggaagatgattcagttgatctcttgagtccaaccagaacaactgcagataaagatttacagccctctgcaagaatggaagtccagttagaacctttgaacagataaatttgcatgcattaagttctaatagatagttgctattctggccaatttttgcaaattttgcatttaatctttgagctggcgttcttctttatttgttatgaggcgttttctgaggtgaaaagggaggcagttactcatgaatctctatttttaacatatgttgctttctaatttctacgaagagtagctttcctgcagcatatatttcctatagtgatacatcttcaatagagtaggttatatcaattcatcactccagcagcttcactatttcttttactacttcatcccaaaatagaagaaatcaaactttacgaggtgaaagctttcttgttgatcaatgtaggttctgtatggttagtttttataagagatgatttgagacatggaatgctatctggccaaaggcattgttgtaaattatgagatgcagaaagttaatacatcattttttcttgtccataatgccatatggttttagattctctgtgattgcaggtttcatctttggttctcttaatgtatccatgatccttcctagtaatattaattttaactataaaaggtaaatacaaatgacttaatagtttagacacctttatagcttgaaaatggttgaagtatcagttgaaaacatgaaattattgcaatcccagcagttactagaagcatcttatataaactggcaatatttacaataagcatgtgtgaagatttaagcattgtatagagcttcattattgtaatttcatgtgatggaaattagaggaaatttgggatcttgccttttcttgtgaatgatatttttcagttaatcaattaaacatagcattattgagaaagacaaattttcttacaaatctgtaaaagtttgttttgttgtagattcctaacccaccttcagatatgttcaagaggcttacagttgcgagagtttgcctttgaattttaaataaatcttggatagatttagtctttgcaattgttacaccttctgctctttatttttctgttttagttagctattgcaatcccaataaaatctcacagcagtttagattttttagcgagtttcaaattggttgtgagcccgtaaataagcattctcatttatgaaatattttattctttcttcaattttaatattttctagttccagtattttggtttttttcaaatctgatatttaactggtataaagagctggcttcctttgtgtttgggggcaaagaggttgagtgcaaatactagtgaggttgagaaatttattttcaggcatatggatgaaaatatgtctacttctagtaattcatctataaaattccagtgtttaaaggtaaaactatcaaatttggaatctttcaacctggaggctgacgttgctggccaagaacacagtttacagactaccaaagattcctatgatttgaagagcaccaagggcctagtatagcataattgactcttacttaatccaacttggattcaggagtgaaaatcaaacaagtctatatttgatataaatgattgtggtttgtaacttgtagtgtcactttatgtggatgacatgcttgtgataggaagtaatttacctttgctggccaagttcaaaatggaaatggaagatatatatgagatgtctgatctttggcatcattatttacttcgttggagtgaaagtattccaatgtggctcagttatatttatttcacaaataaaatatgttgttatttgttaacaatctcaagtgtaagttagaatcatgcaaagaagtaccaactttgctagcacaaagtgagagaaattctatgaatgatggtgagaaacttgaagagccctctgcatgtagaagcttgatgggtagtttactgtacttgacaacgagtagccttgatgtttccaactattttactttccaggttcatgagttcaccaaacaatgttctcatcatctcatgggagtagcaaaaagggtgctgaaatatgttgaaggtacaacaaattttggcatctagtatttaaagataggagttgttaagctaaatgtctatgttgacagtgagtgggcaggaagtgtagatgacatgaagaccaattcaagctatgcagttacaattggttcatgtattgtgttttttttaccagtttattttcatgtattattttctagaatgcaaaaattgcatgtagtggcacaacaattgctaaattacagtatgtcccactagcaactattgttgttaaactctagagttaattcatagacttttaacgaattctctcaactcaacttaaattagtcaaactataatgtgacaattagatatagagtgagtgaaagaaaaaaaaagttaatagaaatcggtaacacataagtccaatcaaacacaattgcatacttggtggtttttttttttttttttttccaattttggcacaggttcgtaaagaccaaacgtacatttttggtgaaaaaatgtaagtgttgctgttgcggtgcatatatcgtggtcaaaatagcatgaaaaagatttattctaacaggcaatagtacattagcacacagtgcattgcactgcactgcagcctctagactcatactcatatcatacacaacacaacagcctctagcacatattgcaagtgcttgtcctaagaagaaggaacaatgaaaaacacagggaagcaggatcagcttatggattcttctcactctgattcacccaagaaccaggtaaggtatgttatccatccaccctcttgtttccaaatgctgtgattatgcatgaatcttgcagcatttgtgtgagtaccatgatttatcccataaaaaatgaaaatgattttatggaagcatttttgtataaataaatggcaaaaacatgaacttggaaacagaatcataatcgcagctccgtgacacttatggtttttaatgtccctacaacttctcttgatttatcagcctgtgtcataagctccattctcattctattatgtttgttggccatgagagttttttgtttatattatttacttttaacattgtacccaagttaatgcacatttcttttttcctcacttcgcatgaatcaaaatgttgatgcgttaaaccactccttttgcactcttgagaaagttgaagagagaaaaaagttcccaaaacataaagtggaaagtgtaaaaggaaaatttcttcatttactagtgtactagcttccatgcaactctttcggttgtttacttgtttataacaaatcaaaacctcttcagtaggttcaagattgcctataattcccttattttattgattcaagaaaattttgactatatgacccatccctattccttgccaactgctactacccgttaagttatggaaactgtggcaaaaagatgcacatcttgatgttaaggaaaatcattacagtcatcttgagagttgaggcgatgtgaatactcattgttgcacaaaaatacggagatatttaattcagtctcaccatctaaaaattttatgttttgttaagggtttggtattcaaaatgcaatgtatttttgattcttgtaaatttcagtaacataataaaggatgtgcaatgaccttttttttcttctttcccttatcattggtttatttctaatttgcacattgttgcctgtgttcaatgttcagtcagagtctaggtgccctccttataccaagaagcgtttgattccagattccactgtcatttctacccgccatgcctctttgagatcagcaaagaagcttattgaaactagaggaacatctgtgcaggcccaggttcagaatgttctgtggtagaactacaatccgttccaagacaagttgcacttccttctgcctttatgccacaaaccagacaagaagagactgaaaaggctggagattctgttgatgtagctcaaatgaaaaaagtgagtgaggatgagaacccggtggctaatcacacagttcaaatggaagaacacaatgcatttgaagccctatttatcccttttgagcaggaacatttggaagaggatattgaagcatctaactctggggaaagttcagacaagaacaatggcaagtccatttcaatggttggagatccatccttcagcctcaatcttactgaaattattaatatggggaacgatgaggttaattttgttggacaaagatcatggatggacaaggttgaaggataccaagtgaagaagccagaatgcatccccatattaagaaacattctcaataagcatggagatgtttttaagaattctatggcatcaacaacgacactctggtcaattttcttggaggtgatatgtgacatcatttcagaactggaagacaaggttctccataaaatcacagaagatgagctgcattacatgattgcttttgcaaacgagatgaaaagtatgaaagtgaacgttgagtggcttctctagagactggaagagatacttgaggcaagacagattcttaaacaatctagcatgctaaaagaggaaaatgataggaacaaaaagatcattgaatttgtcaagaaagcattggaatgttgtgaagcagaaaagaagtcactggaagcaaagatccaatcgttccaatcattagttgatagaatttgtaatagagagacaacttgcaagaagacactgactagagcacaggatgaatctgctaggatatctcaaattatcataaatgctaaatctaaagtgaggcgctttgttaattgctctcttggcggatggcttgatttagttttgccatttcttctcctttactactttttcaatgtagtgattttgggattgtttaatgagtaatcttttatgaatgctcacatctatggatatatttagcttgtcaaaatatattttagagtaaattacactcatattttgttcaaatttcacccgatatccctccctttttggacattacttttaccctctctattaacgtcgttaactaacgttaattaaaatatgtgagtaaacaaaattgtccttacatttttattgtaaaatccaaattatcctctctcaattagtttcagaatttaggactagtatgtgtctaatttgtgttagattattaaacaatgtctagaaaagagggagtctaggtataacgtgagttaaacatttaaggagttttttgtaggatgcagaaagggaggagtatggaatttgagtaaaacacatggaatactagtgttactctatattttaatgtaaatctcccttcaggcatgttattgttgtatttaaggtttttttttttttgttaactatgtttctatggatatatttagcttgtcaaaatatattctaatgtaaatttaggggctaaaattaaaaaataatacaatttaaatatttaattagtaaaagggtgcaagttttccaatatttagcaaaatggtgcagccaaacacgcccagaatgggacgtatttcaccagatggtgacacgtggcaggcatgaacaggggcctagggttttcgcggtgttttcgtaaattacagaaggctataacttttgactgggacgtccgattgacacgaaaccggcggccacgcgtccaaaaatttttcccaaacgaagcctataagtgcctcaaaattacgatttaagtttcggagcctcaaaaaatttttgttttctgatattttatctactcaattagtgaatcacaacttgtttcattttcaccagcttttatatggacaaaggggcctgtgggacattgttattagggcttatgttgtgattagagtttaggccctgaggtagtgattatggtgtatgtaaatcgggtttagggtttaaggttgacatggtgattagggtttatgggttggggtacagagttagggtttgtgtgtgccaggttatggtttaggtgtgatgtggtgattagggttgatggatttcagttaaggttaggggtttatattgtaattaggatttatgccgctgggaacagacctagggtttaggttttagttctgattaggatttatgtcttgggttacagagctagggtgtatggattccggtttaggtttagggttgatgttgtgatgagggtttagggcttgggttacatacgttgggtttatggaattcggtttagggtttaggtctgatgttgtgattagggtttaggtcgtcggttactgacttagggtttacggcttccgaactaagtctaatgttttcattagtgcatatggcttgggttatagacctatggatgacagattctggtttagggttatggcagtgaataacctaatgagtgttacatacacttcactaatatggattgtgggtatagaattagggtttatgggtgccggtttagggtttatggcagtgaataacctaatgagtgttacatacacttcactaatattgagtaattagttttccaattcaagttttgccttgccaaacatattgtattggtggaaactttgtttgacactatagttcagggtcaggtgaaacaaaaacacagacaaataataaccaaagtaggaatagttgtctgtttaggaacaattactggattataggatggaaaaacgcctgtcatgatgacagatagaatcaacctgaggtctagggtgtttaaagctttgtgttggattacggttattgttgtatatgatgatgaacttggcacaagttgaaacaatgtacgtcaaggttattgctgtatatttttagtggtttagggctttggattaattaaccccaaacacgaaaccactaaaccctaaagcataaaccctaaatcctcaaccataaacctaaacccaaaacccaaaaccataaatcctaaaaaatcatgctgttgtgatcacaaaaataatttcaaaaattatccaaaattatactgcaaaattgacgatgcatataactttgaacagtcgaaatttctcgtagcaatgtccgatgatgacgtattttatgtcagaaggctcgaaattaagacaagtaattagataaacaaagaatagcttgcaattcactaattgagtagataaaaaaaaatattagaaaacaaaaaaatttttgaggctccgaaacttaaatcgtaattttgaggcacttagaggcttcgtttgggaaaaaaatttgggcaaggggacttgcattggccttctcctctcaatttcgagcgtgtgggcgccggtttcttgtcaatcggacgtcccagttaaaagttatagtctttcgtaatttacaaaaacaccgcgaaaatcctaggcccctcttcatgcctgtcacgtgtcaccatctggtgaaatacgccccattctgggcgtgtttaaacacgcctaaccctaggcgtgtttggctgcaccattttgctaaatattggaaaatttacacccttttcctaattaaatatttaaattatattattttttaattttagccaaatttaggtgacttcctgcggtcatgttattgttgtatttaagttgtttttttttaactatctttttagtccctaaataaaaatttgaccagtcttattccttaatgtttttgtccgtcgttaccattaaatcgccaaaaaaattaaatgtcataaactgtaattaaaataataataaaattagtgctacatcagcatttaacaaaggcttaaaatgtagcaaactattttctggcggcttaattgcttcaggagatgccaatatcgtcagactcaaaatacaattattcatttgattgaaattttggtattatatttttcaaattgctataataatttttttaattgaattttcattaatttaagcaacagtttctactttacataaaatcttttaaagtttgatgtttagtggatttgaaaggaagggatatacgacatgcagaatagttgaatgtgggcaactcctaatagctaattcgtactcattctattttttgtttttgctttctctgcatgttttttaattgttcatctaatgagatgaggattcaaagttgtgaatcatctcgatttgttctcgctacggggcagccaagattgttatgtgttccgcaattattgattctccttcttcgattcgttttgatttgttctcgctatggatcagtctcttcaacaaatctgatattgggtttgggttgaggtccaaaatcagcttcacttctacgggcactcgcttctccaaatccctccctcacactgaaacgtcgtcctctggaacgccatcatcttcggcgccgtttggcggaggggaggggcgggtttgcaaaacggcgccgtttgaccgtgagtcgcagcggcggatggcagaggcgaaagcttcctacgactcatctgataatggttttgggtttcgaggtccaaaaacagatctgagttttgggtttcagatctgagtttcaatttttgtatcccttggttgatgctctccttgtcgattttgacggcgacgtggtggaggagcgttgcgttgaacccttcagagattgcttaatatggtttaatcactttagcaggctttttgtcagttttaaacggccagaaattatgatagtttcatattattacttattaaaaaaacttaatggtaaatactaaaactatggatggatgaaaacattagaaattaaaactgatcaatttttttttcaagaattaaaagtgaaaactcaaaaaaaaaaaaaaaattaaggataaaaaacatagttaatcttttgtttttctggccactgggtttcccactcaaaatcatgttgagaccagttggggatacttaaaatttttaaaattcggagaaatctagtttgttggttgttatttcggattctgaaactcatttttctttcttgctttaaaactataaggaaacttgagacactctaggtacactagatttcagattcagtaactaatatccaaggttgaatgagcaaacctccaccaagaactgagaagagtaaccctactttaataaagaaagcagtgcctctgaatggctaagaactgagaagagaagccagaaataatctcttatttagagttaattggggatgagggagaagttactcaattgttgttcactagttttttctacaaaaaagcaataggatatacagtacatgatcatgatcatgcctttggtgttttgataccaagaatacatcaatattaagaattttcttgtataggagaacattaacatttttcaaattttgaccttggtctttgtcaaactgttggtataaacatatttcaagacgtctttcatactcaactttatttctttctttgttaaaatcatagaaacaaaatatttattctacttctaccttcctcttctgtgccatcatttattccaacaaccactcagaatttgttgggagcatggagtgagaaggaaaagaaagtgataggaagagagattaaatttaaactttctttccattggatgttaaaaattagtaggtgacatgaaatttgcctttttattgtttttaaaattgtaattttggtcatctttaatttttaattcgcacagaatatgatagataagggagaagttaatgttaaatatttttattaatttcctttttacacgcagaagataaattcaaaaaagtagaaaattaattatcctcaattttggctaaattacaaatgttagtacttctctgagcataagaatttcagaagactatggtcttcagaatctaagcatgagattaaaaagtatagcatcatctgctgttagattacctcctattttttggttgttgggtagtttctgcattgaatcagttctctatcatgctcaaactggacatatctaaagggaaatagagaaaagactaaaagaaaatggcatggggcggacgacagagtatgttacatgtagctatttacattttacaacttatacccgttcactgttaccatctgtgtcatgtttattcttcatgaacatggccatttgcgtaatttcgtgcctgctatatgagattgagatccaatctaaacgattggagcatataaataaggtgtttgaacccacctatatgccctacgtaccccttgcttaatttactagaatctcattcaacattgaatgcatcggtaaaggattatgatatagagtgagtatataatatttatgagagtatcattggcttttagattttagaattataagattggttgagtcataaaagaataatgaagagaggaaaaaaaatagtaggtatgatttcttccattaacaaaaatgttaataataacaattaatatttgtgcataaaaaaatctctttagtacttttcaatatttaactgactcttttaatctcaatcttagctttctaattaaatttaagaattaagattgattaatctgtttttgacattctcatttaccatatccatagacccaatgggacaactaatgctggaacattaccttctaattcaaaagtatagttttttagcattgaaagatttaattgaaattaatattttccactataaagttgaattcatatgatgtatatgaggaggactagtcatgaaagggcataaaacatattctatgtgattaccagagccaacttggttgtttccttggtgtccatacccaaatcaattggttcattcagattatatgttgacttaagtcctaaacaagcactactatttctttcaaagggcccttttaaaaaaaaaaaaaactatttctctcatggcttctgaagcttgtgctttccttgcgttgtactattttacgatgatttttctttggaatcgtgtttcaattaataagggatatgtttttaagttgtgttagtcatgttagaaatttggcatgttaatcgttaatttgaatgtttatgatatgttaggctatcaagcgcatcattgcttgaatatctaagattactttgtggctctttagttaccacattattacatgcataaaataaaatgctacatatatcaagggcatccgcaagattacaatattgaaaataagacagaaaacaaaaggcagggattaggtaaaacattcacatttccaacctctcaccctttttgtattcagattttgtttgacctcttttttgttaaaattagaatggtctttgttttgtttgtattcagagacaagttctgtattgccgttgctgacatgtcagcaggaagagtggatgagtgtacaacagtgaatgtgtgagaaaaaatggggataaaaaacaaataataataaagcaaagacaagccaaaagggcgtttgcctaaaactgaaaatagtctccagcctaagatgctgctccattcttctatatctctctcttgttttattactattatcttaccttttttcttaaacattttattttagtttcttttagaaatggatagacaaaataattttttttaattaacacaaaaaagggatctgtttaagcaaacacagtaaattgaaagaatgattattttttttaaaataaattaaagatgaacaaaaataggtgttcacacttatatatatatatatatattactttttctttgaagttaaatgatcagataattaaatttaatgtatttgtaattaattcattagtaacattatgtaatttaaaaatatatattttgtagagcatttaataagtcttctattaatatgacacaattttgagttttagtgagtataaaattgatattgatagttttggttttattattctagaattaaagatcctgaaataaatactaattaaaagaaatttaatattttattagaagtattaaatttattaaaaataatttctttaaaatggatataataatttatgaaatatcattaacgatacttgtaaatattgccattcttaaaaaaattaaactttattttaatgttctatagaaaataacaatgctgtaaaatagtaagaacatgaattaatatatggtaagacattgaaattactatattataactttcaattgataattttacatttttgttaataaaaaaaagaataaagtgaaaattaataacctatattaattatatcataactcaaacataaaaattgctcataaagtttcaacaattttaaacaagactatgatagcagcgatgggaatgtcagcataagctttaaaacctgctttgatgctaaaaatttactcaaatgacaaggtgaattataagttataacccagtcaaatccttctcaagcccatgttaatttctcaagcagcacaaataaggcatgccacttattgtttccttttttttggattagtcacctattgtttcaattatattatatataggaaaccattagttgagtagtaagtgtaactgtaattaagacaactcaaattcaatcaatctcctcaaatttaacccagtgtgtggtggtccaagatacaatacaacacagattttattcccatggcataagaaaaacattttatcacacaaaaaggaagaaaactctagtacaaactgagaaaataaaaaacgattgctttcttacttttagagtaacgatacatatatacatacacttaatactctttaccttttttgtgtatacattcataaagatggtactaagtataaacgttttttggttaaagacaagtttgaattaatatgttctcagagagagagtttgaataaggaagcgctttgggtttgagttccggacctgtgctgtgcaagtgtcttgctttgacgtttagtaagaagaacattgacactaaatatgcctagaggaagaagaacaacaacaacaaaaaagaaggggaagcaagccggggatatggattcttctcaatcttatacggcagaatccagccaggtatgtaacacagacacatgctaattctattatccactttgtttccaaatgatgcagcatatttgtggctacgatgattgttttcaacaaagaatgaaaatggtccaatggaagcatttttgtagaaataaaatggcagaaacgtgaacttggaatataatcataatctctacttctcattttcacccatgtgaggttggggaacctattaacaaaacaaaaatctctctctatctgatatattgtttgctgtgtttctaagtacatgattgtggtagcaagtttctaaatattttgaaaaacttgagtgctgtttgtaagggtggaaccgtggaggttgattttgctccatcacacgtgaaaagttactttaatgtcatttccttgatctgtttctctgttattattaaagttgaggaccgaatactagtttcattagcagctgcatggctcgtaggatacagaaatatgaatactatgttgatttttctccatcatactagtttgttattcttttctgccatcttgaaagttgagcaatgtgaatactcattgttgcactaaaacagaaatgtttagtttagtatctccacatctaaaaaagtttatgttttgttggggagagatgaaggatcaataagacttgtacttttggtactcaaaatgcagatgaatttttcagtaacataataaaaggatgtgcagtgacctgtttttttattttctctcttacccttatcaatggtttagttctaatttgcacattgttggcctgtgttaaatgttcagtcagagtcttgggactgccctccttctaagaaaaaacatttgattcaagattcccctgtcatttctaaaacccgctcctccttgagattggcaaagaagaatattgagagtacaacatctgtgcaggataaccaagttccagattacactgtagttcatgctcgttgtgcctctttgagatcagcaaagaagtttactgaaactagaacaacatttgtgcaggcttaccaacttccacaatgttctgtagcagaaccagaatcccttccaagacaagttgttcaaccttgcacattggcaccagaaatcagacatgaagagattgaaaaggttggagattttgttgctccagagaattggttagttgatgtagctgaaatggcgggaaggagtgaggctgagaaccctatggttcctcttgagcttaaacctttggatgctgagggtattcaagaatcctctaactctagggaaagagcagacaagaacaatagcaagtctatttcaatggttggacatacatcctcacatttcagtctcaacattactgaaatggttaatatgtgggctaatgatggtgatgaggttaatttttttggagtaagctcaccgaaggacacagttgaaggataccaagtgaagccgaaattcatacccatgttaagaaaaattctcagtaagcatggagatatttttgagaattctatggtatcaacaatgacattccgatcaatgttcttagaggtgataggtgacatcctctcagaattggaagacaagggtctgattaaaatcagagacgatgagctgcataacatgattgttaatgcaaatgaaatgaaaaatatgaaagtgaacattgagtggcttcacctgagactagaagagatacttgaggcaaagcatattcttaaacagtctggcacgctgaaagaggaaaaagataggaacagaaaggctatggaatctgccaagaaagaattggaatgttgtgaggtagagaagaaggcactggaagcaaagttccaacaattacttgatagaatatacgataaagagacttcttgcaaggagacactagctagaacacaagatgagtctgctaggatagctcaaactataagaaatgctaaatctaaagtgggacgctttgttaattgctctctggtggatggcttgctctagttttgcaatatcttcatcccctccctctgctttctccatggcagcatttttaggatggtttattgggttattgtattcatggatgttttcagttaattatgttaatcattgtttaaacctgtactaaaactgttagcttccatttttataactatatgtggtatttctagtggcacaccaacatactgtttcatagtagtgtagtttctgaataggttgctatggaaacttgtaggaaaattaaatttctgcaggatagtaagccaatacaataggttcttgaagtgctgttaaacattgtgttgagctcacacggtctatgagaaagcatttgttcataaatgctattcatattttagtccaaaatatatgctattcagattccttggttaagttgagtaaatagtgatactgtttgaaataagacctgaggcttgaattttctgatgagtaacgatatcagcaatcaatgtctagcctctgaagcttaaatttagtaaggatagtttgaaatgttctgtttggttttaacctcttataacttatggcggtattatttcaatccctgaatgcataagaagttcacaacccttcactgtcaatttggagtcatgcacttaaacattttaacatcaacactacctttaattcaagttaattgggatcgatgatagatgaactcaatgatagatcgaaaataagacaaagaaatagaaagggagagaggaaggaaaaagtagaaataagacaaaagagaaaaaataaacaaaaataaaagaggggtgaaaggaataggaaaaaaaaggttaaacaaaatgattgtaaattagattttcgagtacacatgaactcttagggataaatgtattattaagacattcattgattaaatataatgtgttaacttattagagtttgaaagtaataacatactaattaatcttgagctgtaaatgatgaaaggaaacatttcattattttttcattggctcttaaaggtaaaaaaaaagttacttcatgttatttggatgctaaggagtattattagaagtctactttggttagtaaattaattataattaatttactacggatttattattgaacttatgaggtcacacataaacgagagtttcaatatttgcaagagaaaataatttatttgataattaaattagataatttaatcaaataaatattttagtaaaatattattgtattctttattagcaccaaaaaaataattaatataaacaaaaagtattattttataaatgtgaaagttatccataaaataagaattagattctatcgctaaatatcagaatcacatcatgtgattatttatcgtagtaaatagtcatgtgattatttgagagttatcattgtcttataccagaaaacttcttaagataacaagatatgaaataacttttattttcaaatataaagataaagagatatgaaattttttaaaataaaatctctcctatttgaaaaagactcatatccatatctcttcaacattataaatagaagcatttaattgagataaactatactagacacaaactagaaaaaatttaacttaattttagacatgaaaaatagaatgatgatttattatttagagttccactcatcaaataattgataatagagattcgtctaggtggatacatacacaatcttcatactattaaagaaaatttttgttatttcaagaatgtgcatctatttttttctatttattattattatatattttgaatgaaaaataaatcataatttttcattataatgaacaaactttaatagtgtttgaatggctgacaaaaagtcaaacaaaactttaattttacataaagttttttttacaatttaattaaatataaatcatgtgtacctctcttcgttaatattcttgatgaagaatgacttactaagtttgttcatgattttagttgagaattggggttcgattgctagataaatcacttaatggttgtgatggttttctgttgaaggatcttgttagtgcctcttttttaaggagttattattattattattattattgccacttcttgccattgagagagagagagagaattcttgataaaacaatctttattttctaagtttaaacaattattgaactatactattagcagcgaacatgtttgttttcttaacactagcgtttaatcatgcattgccaaatcattatgtaagtgagttttaataaggatagagtcgttgacaatatgtttaagtattgacaaatttatacttttaaaaatattttacttgtaataaaatttaagttaaactgtactctggttcttctataatttttgtaattttgttccatcaattttaaattctgtaattttaatctccccaatcttttaagatatgcaacttttcaaatgttacagttaatttaatatttaatcatcatcctctctaatattcctcctgtttaattgaaagtgggagcatgtgatgagaaaagttataacattatatccaatgcaattataaggttggcttgtgattgagaaggagatttaacggttgaagaaacaaaaaaaaaagatggtgagtttgatttttttattaatattataacagaaattaataattaacattgatgtgataaaaaaaatattacacccaatactgagttaccaactcatcgatttaactatttgaaccaactttctagaccaaaaacaaaaactattttgacctagctttcaactggaaaaattaatcgaataagacaattacatgttttaattaattctacaatttatgtcggtgaatttcaaccataggctttctacatcagtggacaaaaaggattcttagaaaggcaagtgataaaatggtgaactcacctgtctggaatacaaggatagaaaagagtttcggacattctaaagcgtggcaaagagaagagagaattttaacgctctatggatgatgtttgacatgacagtatttgatggaatgaacatatctgtaaaggctgaaagtagcaatataaagcagaaaacagaattttaatgagctgggagatcgattcttaaatgagttcatgctcataaaaatcttgaggcacacatcgtgaacaagttgtaactatttatatttatacattgcatgctgcgacatgttttaacatatcctattaaagtcttgcaattctttacgtgagttgcacattatggtcaacattctttctattaaattacatgcacatattgccaataaagaaaaacaacaatatgacatttaaaatataatccacagcctttccaaaaacaaatctacagaagcgtttatatgacatttatatagtactagttaggaattttcatcatacccattaaatgagaaatattgacgctattgacatcctttatatattgtgtattacatccacgagaggagaaaaataattgaatattgattaatgcaagaaagtcacgcacatttctttatctatatagtatatttatatgctcgtttctttatgctgtttttcctttgttccctgtcttcaggcagaagcaagtaaaaaaaactagagtctaattacgtactactctttaattaggtcaatgatgagttgtaaacttgaccttttttttctcagtttgccgtttcaaaaatgttccctgtttaggtataaaaaaaatccttgatatttttttatacgttttccaaataaatgacggtaatcacaccctactaccaccttacatggttctaaaaatatatttaatatttattttgaaaatttaatcacctttttatagatttcttagtgtcatatcacgtctcataaattttttactctaataataaattttattttaagatcttaaatcatttttttaaacttaacaaaagatttaccttctaatatttattttaaaataattaaataatttattatatatttttaatttcaaaaaattataacaaatatacaaaatttattaataattaaaatatttatttatcaatataatttaaatttacataaaaattgaaaaaactatagtaatagtctaaaaaaaggggaaaatttgttagtgtgctatagcttcttaccatcttcttcgcccctttaatttctctttttcctttctttcttttttcttctcttttctcccctcacccaccccctccctcttcttccccctcccaccttctcttcttcccccacccacccctcccatctatgttctcatggtgctccgatggtcgtcattggtcgattgtgatggtgtttggattgttatgtaattattttattttttattatttgttttaaaattatattgttatgtatttgttgcatttggacttaattctattgttgatatgtttttcttcctttcttcttttataatcaattagttagaaagataataaaaattgattttttttattaaaaatacatggtaattataaggattctcttacaaaaattaaaccttaaacataaagatcttgaaggtgtttctagtaacttaatcttggaataataaatttttaactttaagatttttctccacaatcatctatcatggatggtctaagttaacgaatttcgatttaggcagaatattgacttgatgtccgtatgatgcataaacaaatcaaaatttatgttggaattaataacctttcttttgactgctctaatgtgtatgcgaaggaggaaaagatattaagcaaggaatcttcttcatttagaattgtccaacccagtgtcctgtaagcttttctataagaggaaatagagaacgaagttcagcttttaaaggcacctatctatgatgattccgttcataggacaagcaacctaaaaggaacaacaacacgaacccacttccccctcccttttcttcaaactaattttatttcttgttttcgtcgacataatataaaaaaacttaaatatttttttagttcttattatttaatatttttaatccttttaatttttttttatttttaatctttgaaattatacttattttgttttttttatctttatcatgatttagataataaaaatattatctaaaatactttaagataaaaaataaaataaacataatttacaataattaaaaaataataattttgaatgatcgaaaaactaaaaatgcactagattgaaagattaaaatatattttgatcaaataagaattattttatttcatataaaaataaaaaaggacggctccaatatacagtacgtcactgaagacgtggcacaaaactttcaacgtattagtaaaaatcaaacgacgtcgtctgtagttgttgttgttgtttatggttgttgttgcagttacccttcacggggtacaacgacgtcgtttttgtccttctcgagccaggcacttcgggcggcgtctgcatgcgaatcagcgccaagttgagccctttgaagaaggaatgcttcttgacgtcagcggcgccgcgcttcgaaccgagccggcgcgccggatccttgttcagcaagccggatatcaaatcccgcgcgtgtagttcgagattgctcgttggtgtggccgtggggaacgccaggggtttctttacgatgttccgcagcgtggcctccttcgatggacccgcatacggcgtgcgaccgtatatgagctcgtagataaagacgccgaacgaccaccagtccacggcgttcccgtgcgaacggccagaagcaacctccggcgagacatactcgtgggtcccaacaaaggaacaggaccgagccgaaaccggttcagcaacaaaaagccggttgggttcaatagcacgaacctcgcgcgacccggaaagccggttcgagaagcaggagaatggagtcataaaagaatgcgagcgagtgtaagcgataggtaatgataaggaatctgctgaggattcaacggctgggattgcatctgagcaaagagaaagatcgaaatcagaaagcatgatatgaccgtctgatctaaccaacacgttctcaggctttaaatctctgtagatgattcccagcatgtggaggtattccaacgccagcagcacctccgcggcataaaatctgggtaattaacattgtgagttcaataaacagagaaaacgtcatcgttttggataaaggttttaaattttaccttgcggaggtgagagggaaacggttgtgagggtgcttgaagcgcagggagtgcaagtctccaccggaacaaaactccatgacgatgcaagagaaatgagaagcttcgaactcagcgtagagcgtagggagaaacgggtggtcgagcatcttgaggatttttctctccatttccgctctctgagacttcttcttcaatgccactgcgtctttgtcaaccaccttcatggcgtataaacaggaagcatcttcttcgtcttcttcctgcttgttgaattggttgttgttggcgtggcggaggcggcaaaggtagacggtgccaatgtcgccggcgccgatgcggcggaggaggtggaagtcgcggaaagtgagagcggccttgcggcggaaggtggcggagcggatggcggagtaggcgaagtcggaggagcggtgaggcttgatggagagactctccggcgaaggagggaggagatcgaaggagagacggctgaaactggtgctgcaaatgctctcgctgctcatggagcttccaagtgaggaagaattcacggtctccaaactcgcctcagaatcacgttcaccaccacaaccactccctaacatggtagtaacactgtacgaaacaaaaaagaagagaaaggagctcggaaattggaatggcaacagtggtttgtgtggaatgaacgaaagtttctgttagtgaaggctttatgaagggttagggtttagccagcacaaaaaaattgaaagaacaataaaagttggatggtacgaagcgtttcagagcaataagagaggcgcagtttgggccagaaatagaatgaggagtgttaaagaaaggaagcgatacaggagaggtggttgcgttgtatttatgctcaacacgtacgtacagagaaggagggaggcacgtgagagaggaagttttggcacgtgccaagtactaatagagaaaaaggagtgggaactagtagggtaggggtgggtgttggtgttggtgtttgtgaggatgatgacgaattgagaagaggaggagttcccacgtggcggaggtttctttggagcattgcttaagctttcacaacttactgagcaatcactaatgagcgtgtgccggtgcaggtaggggaagcttttttcattgcaatgacggaaatatccttatccttttgtttagttagaaaaaaaaatcataaatttacacggcttccacaccttcacctctttactttaatttttttttttctctgtacattcaaactcacttatgggagagttcaataattcagttagttaaagtgttacagcttgtttaataaatgtataaaatcaaaatttttcattcaaaaaatcaattgtttttactacaaccttttttaaaatcaactttattaactttaaaacaaacggaaaccagagttttctaacatgattaaagttaatcctttgattcaatgaatgtgaagaatttcaactgcaagcaatgtaaaaaaaaaaaagtttctaataattgacttatcaagaaccacaaatttggggttggaatcaaactagcttttggcgacgaaagagagtcatgtcaaatgataagaaaggtgatgaatgacaatataatgcctgtagatgcagagacacagtgaatgataatgttcacgcaaatatgcccgtctattgattctaattcttcagccaaaaacgttgttttaatttgctgaaaataatactaatagcgatgtttttggactcacatcctaacacccaggcaccgtcaacggcagaagtgggataagtggtgctacagactactcaccctgatattttgtatgatttcagaaaatgactagaaagaaaatcgtgaaaaataaattaacttatttaatatgatgatagacatatggaagaaaatatttttatttaaatatttctatttatatactttattatttgtgataaatgatcttatctttacatattttttatatattttctcttttcttgactgaaatggatagaaatgaaaagataattagttaataagattttttttctctcctatcatttaacactaaaatattttttatctttactttatctgttttgacaaactttcgtttacctttaccaaaacaaagtgtaagtcttgacgtggcctttctgactataatccctttcaagccactgcatggcatgggaatcttcttgtgcgagattagcctgtgtcggaaattgagtctaacattacagtgcaactgtacagccaaaattctttcttatacatttttatttgtcaattctgtataaaatgagtaagtactaaatagtgagtctattgaatatttacttttactacctctattctacaatattaatatttaaggttaatgtacacatattaaaaaatattcaatgtctaaaatattcgtctatttaatttaatataatttcactaatacaaaatataaatgtggttcattatttgttgatttttttttaaaaaaataagttgtaagcgtagtgttttttttatgaatattgaatctagttattctaaatagagttatatgtgatcaaaaaatgaaactttaaatttatgaaatatcaataattttgaaatagagagagactaaaacatcaatggcttctaaacgggagtaacacatatataattgtaagactgactcttaaacaggagtagtacaaatgtatttagagatatttattctcaaaaaatgatgttagagtcatatttttcaaaaaaaaaatctttagagttgataataataataataataataataataataataataataataataataataataataataataataataataataataataataaacgacactagtcttatcaatatataatgctagtctaatatacacgttattgatattaagtgcaaactaggaaaacatcaggttgcacatgaacaattgaataatgataaatgtattaatgttgtttcattacaacatctttagataaattaggttgtgtccttctgagatattcgttcagtgtcttataccttttcctagtttattaaacgaataagtcttagatttttctcccggccacaatcttacaaaggaaaataagaattatatttataatgatttctatatattacaatcaagattctcatttcatttatccaagtgaaaaatctatcattgggacaaacggatctaagaataattcatttaagaagcattagcatatgatgatgacctggtggaaaaaaaatgttgaatgaccttcttaagaacatgggagcaaaatccaaattatttagaaagacgttgttttagtgaacaaaattgtcatgatttagatttgaagagtgtatatggaaaaccatctaaatcacattcaatggaaaaatttaactttctaaagcagaaaacaccaaagcaagtgagggaagattttcctagagtgccaattgcatttggtgtgactcctacgcaaacacacacccaattttccatgtaacataatattgttgttatttgtaccttatgtcagtatcataagttcctttttttttctaataacgtggcttgttttctttgatctctttgttcattaaatttttttatataagttattaactatcaaagtttttatttgaatttatatcaaatgaacaaatttttaaattaaaaaagacaaataatcgatatcattaaaaattaagaattttttaaatttatatcaaatttaaaaatttattatttcaaaagtatttaaaactataaaaatacataaataatcaaaatgaaatagaattacatatgaatttttatttgaaaatatagaaatgtgcacataatttaaagtatgtggtaattttaaaagtgattatttatttaaagatatcagaaatatttgtaatgacgttgaaagtgaaacaattttcaagaaactgatcttttttttttttctgaatcgagaaattaatctcataccgtggttttatatattaataattgtgaaactttcgtttgtatgattaaactcacgggcacattaattaaattttaacacgctcctgtttgaatttagattttaagaaaatgcacacttttaagtttttaaaataaaaaatattttaaatataactaaaataattcaaagcaagtccttattaaaaaccagcattcaaaacttatctagagtaatcatttgatgtgatatgaaaatgatataataggtagtgtaactatcaccgttcattttatttaaccgatatccaaaggtggtactgcgtgaacgtattgggtctagagggtagggagcagcgggactaataatggcaattaaatgcagaggatcaccctcctacatcttttgcaacacaaaatatagcaaagaaagtttcaaattaaatagaaaataaaaataattataattttttaaaaaattatcttagaaaatgattttatttttaaaacaatttttttttatttttttatcttcatttcaatcaaacaaaataatattatctgtaaattttcctttttattctttttgtttactcaagcataaacggtctcatatttcttaagaaggatattttaaaaaatttagtcatcacttaaatacgcaatgaataaaaaattattcataaattttaaaatacatctgaaattcttatttttattaagatttttattcaatttcttattgtatttttctttaattaattgattaattttcttatcagttatattttcatttctgtttagtttcgtgataaatatatgaaacaactaatcttagttgaaaatatatataataaataaatattgtattaaacttttaaatatttttttaaaaatagcagctagttaaaaacaaaatggggtaataatatcattgaaaatgtttcgtttacacagatcattatatgttacttattgtgtttaggtcaaattcacatatgacacaagatgagtcagcgtgaaaaattgatttagtgcgcaaacaatcttaatgacaatatgatacagtatatgaaatttcacttagaaaaacatttatatataacctgtatacattgggggcctttcgccttatattttcttgattttaggcactacttgtaccttaaatctttccttattaatataatatacatttttgctgataaaaaaaaacatgtatatattattctcattaaataaacatcaagtacaataaaggatgcaaaagtgcggtccatgcatgcagttgacgggaaataatcgggtcccaataaaaaggaataattccctaaaatccctacatgatatttgtattatttgatgctcaccttctcactattgttgatgtagatgtagaagaaattgttcataagggacccatgattgtttggacgggaattggatggtgttttgggaaagaacaacaaaaagtgtatcaaagggaattgttgtgcctggggggccaacgttatcccaaaaagggaaacccaaatacacattactattgatgttattttgtttgcttttgaggttcatgacaaaatttgaaacactacactaactcaacgcaatgaacctagctaactttcatttcatttactgacgtaccaaccagacacccttccatgcactttaattaattcttactttttgttgataattatgttcataagagattgcttagttactaaaaaaaaatatgaagcaataaaagaatgtgccatgaatgcttttaaagaaaactagtatgcaactgcctaaacgaacgagaggagccaataattgattgtcccgatggcacaaaccatactctaaagcagactaattatcaactgatggatagggtcatatctaccaaaaaatctgatttagcaaaacagaatataacaaatcaaactattttgccgatagaaaaaaaaaaaactcacttattgaatagctccaaattctaactaatctctctcaaaagatacttgtgggccaattaaactcccttatggttggtttggttagaaaagaattaaaagaaatatttaaataaaagtaaaaaaaaaaagtataaaactcatactaaattttgaaaatttctcgttctttttcttttatttcttcacaatcaaacatactattatattctacttttttgcggtatttgccgtcttcacaagcaagcatcatagggaatacaattagtacatacagttagtgtgttattttaatattgagtggtgatatataaacacgttatagtaaattaccataatagcggtggaccaaaggcaataacctcgaggctattgcatatagcaacgactaaaattgttagtaaaattagagcaaaagtataaatttattttaaaatatacgtaaatattttttaacgtgaacagccatttgcctgctggccctcaaatggggtgcttccctacatctgagttcgaagagaggacctttccgagaagggtgatgatgtcctgaaataatgcagaacccttctctctattcatcaaaacaagtcaagtttatttcgaggcaattcatcaacatggtaactcatgtgttagcaaggacagtcatctcttatgcttcctccattattttttctgatatttcaagttgtattgaatcgtttatctttagtgaaacgatatgaggtaatgtcaatattaataataaaaaccgtaacagctatttttattttttaaagtatgtgacagctaggctattgccgttgatttttaaaggtttgaattttttaaatgtaagcaatgacctagtcatccactatgataacctgagctctaaaactaaaaaaaaattacctctttatttcgcattttcctcttttctgaaattttgaaaaagaagagtaagcaaagtttgaaattaatgttattgagacgttgaatttcggcatgacaatggaacatgttggaaatgggtatccatccccatctccatagaaggccggatatgtttgagatagaatataaaagatgtgagtttattaaattttaatactcattattctcatttccatcggattttatcaaatttggaaatactcatggatatccggtcccatcatttttttataattttagttcacttataaggttttaaattaattatgtattaagtcattaattatattttaattcaagtgatatataaaaataataaatatataaaagaattaaaaaaattaagaattgaattgtgttttagttatatatatagttttaaatttattagttaattattataataattttaaaccatttatctattaaaataattatttttatataaaattataacaagaaaatcttatatgggtgtgtgatgtaacaaaaatttataaaaaacatattagaacaagtatggataagggtatatagttatttattcatcctcgtactcattcttattttaaaaaattgaataatagttatatatcatattcatatttatatttgatcaaagcatgtatttttttattatcaaaatcgtgacaaatttggatttctttgtcttacttagttgaaatcaaattatgtgaggcgacattaacttaatggtggcaatggtgttttctccttgttcttcttcctgcttttattttaccttttttatggtggttttaatgattgtttttggtttctatgtggccgtggctaaaaaagaaaattacttgcaagtggtggctcttgagctgtggtaatttaggagagaatagaatgtcatcaataaaaatactacttttttttttaatctttgctatttgaattgacacaacaagcaagaccatcccattgccaacaataaaagttgcgataggagctagactagttgttacgccgacttttgattgtctcttttttatgatcttcttgtagtgacacctctacatatcaaaaactatatatcaatattttattattattattattattattaataattattattattattattattattatgattattattatatcatatcacccattatgtctctgtttaatagataggaaaacggaagaagagaagcagatgaaaattattaggtttttttggtggagaaaatttagaggataactaattttaaaattagtagagttcagtgtactattttaacctattttcacacattttttttattctcatccaacctacttctttcctctttactaaaatgagcatatatctacattttttctttattctctctttccctattttggtgttgaatagagttcgatatatcctccaaactttttctttctataaaacttaattgtgtacccgtattttgaatatatacatcagtgaatatatgtatctaaattaataaaataggcaataagttagttaaaatgacttcaaacacataccccttctcatatatacttcaaagaaatttctaatataaatatttatatcgcaatcgcttatcgtttataaatttttcttacttatgaaacaaatcctgcataaattcctttcgtatcattattgtaaatatatttaaaacaaaaataaataaattttattaatatttatcaaaagagtcaattaaacctataagaatcatgatcgaaaaaggaagcaggggaaagaaacaccctaaataatagtataaaatttcgagaatattgtgattatgagcaaattattgtggaagaatcaaagggcaattacaaggaagcaccgtctatggtagaaagaaaacacccaccaatattcccgctatattgataggccgacaatcagacaaaatatgtcacattagacaggaactcatcctagcttgatgtaatgtaaaattaaactttgtatagaagaaatgacatcatgccaccaacttaagataattaaaaaaaaaaaaaaaaaaaaaaacccagcatctttcatgttctttacgtattaattatcttgtctatgatttattataaacaaaagaaagtttaatcattgtctaattagattatagtttcatgtatgaatgtttaggaaatccagtgataaaaacaaaaaacgtaattagtttaagataattattaaatagctaaaaatataataaacagacaattttattaaaaatgatagttaaattatatacttttcttcatttttgttccttctgtgaccatggctttaaagtaatgtttagctaaatgcatggaaaatttgatgtggaatctcagtttctcctcctcggtaccataataatatgatgtccacgccgtatgttgccgaattcttctacattgtttctatgtcttctttggttttataatataaaaattggttcatcagtggttgttcatctaactacagattttgtcccaccatatgatatatgatattaagcctagaatccaaattaaatcatgtgattagtaaggtaatactaaatcacgattttccgcaacaaagaattttaaatgggatagatcgattgagatcgagtcaaccggttttaagggctttaactgtttttataacatagattttggagatgttagtcaattagctgccgtatctatttttaatacgacttctttgtttactatattactttaataatgtaggaaggtcattagtgacatattttgagtcacatgtactcttcatgtggtagtattaataggatgcaatttaactttttaacatatttcagttaaaaactgtttcacataggtccttatctctttgaaccatttagctattgaaaaactttttaacatatttaaataagtctttagtgacatactttagttcataaaaatgcatggtacaaattaaatgtatgcttttagttcctgagtatcttcttatcagataaatggccgaaaaatcaatcacttaaaaatatggtcagctcaaatgttaaaggcttcatctcttcttaattgatagtaatatatatttttatatacatatattatcatgatttaactcaaaattatatgcttaaggaacttgaaaccgttctattattacatgtccaatgggtggataaagaaatcgaggttcaacaaataagaagattgaatttattatttattagcaaactaactggtaacgcgtgcatgcgcacgggtcaagtttgttgtttatataagtgtttaaaaataattaatgtgtataattattttctttaaaaataaataatataatatattagatagaatcaattatttatatcataaccaaataacatgaaaaatctacttattttttaaaaatgataggaaaccaaacattttgatggaaatcaaataatattattttatatttaaatttgtataataatactatagatgtggattaattggattttttaatagagacaatgtgtaccctctttgggatatgatgttgctcaagccaaataggattaatatcgatatcaaaattctcttttacctagctagcaagatttaaatttgagttgagatcacgtgttaaaccaataatcaaatttgcagttgattcacatattttgtggtttaattaaaaatttaaaattatatatacaaattaaaatgacaaaataaaccagtaacacattaatttttttttaaatcaaagttaaataaaattaaataaagatattaatggtccatttatatatagtatatacacatgttttctacttattgatttatgatacatgttttgtgtacattttttcctaatttaagtaaaaattaaaaatacaaattaaataattcaatactataaaatctacaattaattaaaataattaaataatatacataattatatctaaagagaaaaggaatatttacaaaataattcgattttatagaagttgatatttgaacaaaataaatctgttatttaaagttattatatatgcgggtataaggatacatacaattttttaagggttattttgtctttatatttaagatataggaaaaaattatcttgatacaatataaaataaaatttaaatattttaaatcctggtaacatcaatttcctttgcaaatagaaaaaacacagaaaatagaagagaaaaggagaaagaaaattacacgaggtaaaaaaaaaccactgaatgctaacatagtgaaataaaaaatttaaagggtcaaggttcttttcttcaagcttaaagagtaagtacaaaatacaaataaacaacataaagaataatgtttagcaaaaaaatttggaggaccaaaataatagtgaaacaaaaattaaagagtcatacacaaatcatcctgaatttggaaatcacaaattttaaaaaaggaactcacaacccaaaaaccagaaactcaaccacaacataagtcaaagagaacccccacaaatcataaaaatgaataaagataaaagaaaataaacccctgatgcccatctcaactgcctcttgatgattactccagtcaaatccaaggacagtcaccgttaaaatctgttgagaaaagaaaacaaagataataagatattggatgggctcaaattttgaattgagtgaaagaaagaagaggaaaaaaaaaagatgaggaaaaaagatattttgaggcaaacagaactcaaagaaatcacatgcaaatcatcctgaatttataaatcacaaattaaagtaatttattgtgggatcaacaacatatataatttcccaccccttagatattccttctcagccaaatcattggtttgcattctatgttctaaataattgttgaatcaacagttagttatgatggtctgtcatataaatctcaataaccctgaacatagaaattattgaattccagcatattcaaaagttcttccctgttcaattccagttacatttgttaaatacacatacactcccctttcatttcccttctctaataaagtaaatagaaaataaaaggtggaaaatcaagaaaagagtattatttgtaaatgcagatagataagtatttatagagagagaaaaatgagaaagataatgttagcaatgtagaagttcctttatgttactaacatcataatggggttggctaaagaagcaaatcaaaagggaaactggtttcagtataactcagtatctaattctcatcgtattatagaagtcattcacattgaatataaaaccaattagaaacaaattttctccactcagaacaacagtccacattttctaatttacattgaatgaaaagtctaaacctttagtatcattgttttgatcagtagaaagaattggggatgaaactgggcaacagtgaacatgcttttcaaccaagtgaggacttaaggacttaagctcagcaaatatgatttgttttgtgcactccaatatggaaattcaattaaaaagtaagagatcaattttcattaatctctcagtttttattaacaaattataaatctaacccattaaaggcaaaattacccatgagtccatttcttcttatcattttttcatgctcattattcaaactaaaatagaatgaaacaaaattaaggcacaatatatatatatatatatatatatatatatatatatatatatatatatatacacacttactttatcattacaacctttatcattccaaatggagaatgagcaaagcaactgtattccttaaagaattcttactccaattgtagcaatcagcagcagcagctagccaactaaggcaaagatcggaagcctctctcttatctatattttgtgtccttttttttcctccttgacaaagcacctagaatctcactggatggtcatggccttttagtctagtaaatgaaattgaaaaaataacagattttcaaattagctcgagtgatatataacaattgaaacccatatccaacttatcatctaacttcagcgtgaggagtagtaaaggtggaacatagagaagcacattaatatttactgaaacaacttcaaatcaaaagaatcatacaattaaaataaaacattagaattctactccatgaattgtttcaaaggattacgaaaccccacttgcacataaattatgaagaaaatattagcactgcaacacttattagcattctaagatttgtagaaattcatacctccacttattagcaataaaggattaaatagaacaaataaaaagatgacaaatacaatcaatatttattgtagcaccctggattgaagtgattggaaataaatcgaatctgataaaaatgaaaatacagcaagttaatataaatgataatcagcaagtaaatcgaatctcaacattattagtttgtaatttatatcacagaataagaaattattgagagaataaattctcagataaatatccaaaccaagttggaatttaaaaaggaaaataataaaattctacacaatcacccgacacctgttgttttgctcattttggaaatgaaaagcagtaaatcacagtgcaattattttttttttttttggggggggatagaatcttatgttcatttccaataaagcacatttcttcttccagttggtaacttgaaaggttcacaataattccatattatagagatagactatgtttcttatacatttcaggtcaataaaaaatttctcaaaagaaaaaaaaaacatgattgttctaaactcaaagtgcaaatgaagcagaaggttgaaacccaaggtgaatcgggttaaattgacttttagagccgcaataggtgaaaaatgaaagtgatgaaaaataattatgaaaatgtgatgaccaccataaagaagaaaatgaagttgttgagtgacagttttcaacagtgtaaagcagtttttggtggtggcaacagtatagaagaaacaaaaaaagattatgacttttcatggtaccaaactatttcagcctagtagagatcctctaaatctgctcttcacttggggatctaattccattgatgtagtaaaggtccttcaagcaaatttagagttacaacaattgataagatgactgagttacagcaaacctgatcaaatcgagttacaacaaagcaactaaaccaatttaacatgacagagttgaaaccacagagggggcgtttcattcatagaaaatgaaagtaaagcatcaagagaaactggcacaattcatgactcccatttcctattctctcggactcaattaagatgctgggaaatgacactactaagaaatggcaaatttcttctatatgtgcttgttttcttctattctctttccaaaattattgtatatacattctgataacattgtttagaaattaaagctaggaagtatcaattatgtgtatcataattaagcatcaaagattaatctagacatcagctactcattgaaagaaaattctcatcaaccaaaatacagtaaataagctaaaccactaagccttaacccccttgagcatctatgtattgaacttgtaatcgactctgcacacaaatacacttatagattgtcttttacatataacaaatatcagattgactatcatgttgaaatccaaataaagaacatgaaactccttatattgaaagacaagtaagttgttaccattagcatatttgtatttagatcctagattgttatcattttcatttgatcacttagtttatttgctcattactgctaaatgcttctctcttatgcaacatcttggctatgcaattactatacatttaatttagaagtcttgcatatcacccaatacaaaaccattattaatattggtgtatctcaaattatctttgtctttgattgccaggttttttgttagcaaggatagttttttatttcaattcgtttgataatcttttgatgatgtctattgttaatgtacaaaataaattagaggcacgaaatttcaaaatcagaaacaaaaaaaatagtaattctaaaaagaaattataaaataagtgtgaattccaaacatggtcaaataatctgaaacaaaataaaacccaagaaattttaaaatccaacatttccagaatagtcgatagcaatacccaacatccaataagcagcacattgaatcacacaaaaacaaaatatagacatataagcactcatgaaaaatgaaaggaaaatgttcagaaaaagggaaatggggaattaaaacttatgaatgtgatgatgcaaattggaatcattaagagaaaaatataaagtagaaactttaaaaatgttacacaataaataaattgtccttgtgttgatatagcataaccgaaaatgacatgattttttttttcaaaagaataaataaataagagcaatctgtaaatcattcatatcttgaacaaacaataaccactcatatctctattaatttctagctaatatataaataaataaatccaagcacaatattaacaaatatgttacataatgaaagatcaaatattaaaaatcaccacattagtcttaatttagacctgtgcaaaatttactataaactatcaaaatctggtaaataaaaatgcatgcaactattaaaaatctgattgttgtgcatcaatcctaacgatcattataattttataatttataaactaaattattgatagatcatagatcagggccatttggatgggaaggaagaaaatgattttcagaaatgaagtggtgcagagccaagaaattctggaatcagcttaagtaaatgtaatggcttggaaatggcggttaaaggcacagaaattaaaagggattctggtattcactgtcagcatggatgatgaatccatatgcatgccttgaatcaacaacactgagaagtggtttttcgaggtgaagatggtgaggttttcctgtcagattttatcctttgtattaagttctgatatatagaaagtatgcagatgtgatgagtttttgtgtttatgcttggtactggctgatttatcatgaaaagcattctcgtatatgaatgcttggcaaggagcaagtcatcaattgaatgtgcagactagaagttcattaataagtaatggtagaggatgaatttttggaaatatatatatttctgctcttacaaaaatctccattttggttggggcaaacttcagttcacataggaatttttgggggaggggggaaattttatgatttattgtaactgtttcagcttggttttaactcaccttgtgttagcctttgctttttaataataaaaaaaacgtctggacctttattttttttccaatatttattgccaacctagtgactttgactttttaattttctctttctataatcagttattcaaattatagattttttaatcaattgttattgattgtctaattagctaataatcaattattcaaattcaaatacaatcaaatgtatataatcatatcaatattttaggtgaatatttcaatcaaataattttatcttgaaaatactatgtgtaattttttattttattttgtagaactgagaaagtcacgtataagtttcctttttaaaaatatttttgtatgtacatatgtatagatagtttatgacacttttaaattttacctctcatgtattattataacttattttagcgacaggagaaattataatattataaaagaaaacctcatttttccccataaattccaattataacagtgattctcaaagaaaattaaatcaaaatttttataatgagtttgaaacataatgtttaatttttagatcaattcaaattacattaatttaattcaaatcagatgaaactatttaaattttttttatagcaaattgaattttgttgcactgttccaaataaatggcatataaaacattatcaattaatcaattgataataacataggctttatattgcttgcaggactctactgccttttgtagctgtgtgagcgtgaaaaggctcaattgctcaaatgtatcctctgctgtagtctgtcaaagatagtacttgcttcagaaggatgcattctccttcatcataaataattttaaaacaacaaaaagtgaaaaagaaaaaaaaaatgaaatcttccttcaagtaaccggtgattccattgacactgctactcttatagcactagtgattgcatttcacctttcttcaggagtcagagtactaagtaaagcttggaatattaagttctatataacctttggagcaacttggtcatttgtagctggaaacatgagaaacaaaatgtgccttttcctgttcctgttttttatggaatgctatctgggtatgtcatccttctcctttgttagtaccagtttggtcttgtttgtgtttgtctcttcatagcaatctataactcggttttgcttctctttttttccccttcttgtttgcactttcttctctggtttttgtgtttttttttactagttattgagtgtcttcttacttgctatgcagtgtgcaagtttaggatcacatattctttttcttttttgctaaaaggatcacattttctttgaacttactcaattcagcagatcttagtgttctctgcctcttggtaactaatcaataaatcttttttttttcttttttatttggggtcacttccatttttatcattgcaatattaaattttatagcttctttttaggaaggggaaggggaagggggctcattggtttttgttaaccaggtaggcaaaaaatgttgtgacttatgctgatttttgactcttcaaaaaatcagaggaagcatgtttaatgctcttccttgtactcttcttgtcaagtgggggagaacaaaataaaaataaattaatcctcaaaacctacccaacgacccctttgcaccttgtagttgtcttgtaaacaggaaaaaaaaaaaaataacatgatttttttaatcctttgttgagttgcatttctgagtattgtgaagctgtgagttgtgacaaaaaatttgctgtatcccatttgagtcattattttttagttgtaaccttaattttctttttgtgggctttaaaccctaaacccaatagtttattatttatgaaccatacgaaactgtcaattttttttggtagtttttagtttgaaaaggagggatagaaggataagaatgatggagttcaaattctttgcttcatgccacaatccccacgaaataatctaatctaaatactttatatatcagacatgtataactataaagtgatgaggccactttcttttattcacttgttctttttctcgtgttgttaatttatggtggaccaactgttgatgctatcgcatgatcttcacgaaatacaatactattgaatgattggtttggtgttttctttatttatttaataattagtgtaatgattttactggttctatgtctggcaaaaatatttagccatggcaagaggaattgtggtgcaacaaaagtcagaagctgcaatcccagtgacaacattgtcaccacctgaaggcaacactacattcattgatggcactacttggtgtgtggctcttgctggtgtttcccaagctgacttgcagaatgctcttgattgggcttgtggacttggaatggcagattgcacagccatccaaaatggtggaccatgttttgaaccagacacactagtttctcatgcatcctttgctttcaacagctactatcagataaatggcaattctgatattgcatgcaattttggaggaactgctgccttgacaaagcataaccccagtaagttaaatattaatgtaacccaaattctggcccagttgggtaaacttttcgaaaaattctcaaatagaataaaataaaagttaaaattaacttatacatgagttataatcagtttttagataagttatatgagggagcttttagaatttggataaattaaatgagagatcttctataaaaattaaagtgtataaattgattttaacttacaaaagcttaatttattctatcttcttattttattcacctgtaagtgatattgaaaagtttatctaaatatgatctttgtttagtgctgtgggaaattttatgttatgaaatatgggatgaagattccatagccccaccataaaatatgtggatgcattatgtgaagatcgcaagtaacaaacagtttcgcctcttggatcttgggaactttagtacttttcctctttgctattttgttttgatgtctacgtagcatcctttcccttttggtaccatagtgatgctttattaatagcgttagttgttgtgtgatccttgctgaatttctttctggttgatgaatataaatataaatatgtttatacattgatcagctggttgatgaatatcattttgtaaagttttctagaactttcggcatttttctttcgttcttttttgtttgagaagggtgtgaggtgttgaaaagacgggtggttaagcaactaattctagtttacttttgtttgagtgttttctctttttgcatttgcattattctagtttcttaaagtttaaaattaactagttttctttgtaaaactgcaaaaggtttttataacatgaagtgctgtgatgtgatatactgatattcttttagaagacaccagaaggtttacttttcaataagcaattgttttgagttggtatatataataagtaggtacattggattatattcctgatgacataaaagtgtacatattacgcatttttgttggatgctttctgaaaattaagtgcagagtagtggcagcttagtttcttcccctaaattttattcctgcttggtggaattttgatcttagtcttgctagatgaattacttaatactcaaccattggagtgttcacatcagaatgttcatactttgattttgaaatagaattcattctaaacttctatgtttctcttcacttcaggttatggaaaatgtgtctattctacatctgggtatgtatgatgttaatagcataactacatagcctaaattgaaagaagtttgtatacattttattaactcacatttatatcattatatttttatgcgacagatctttagttgcttctgcgccagcttcactgaggaagcataaccaaaacctcgtttggtcgaaacttgctgccttgctactgctttcatacttttggatgtgactatggtcggccaaaccgaggacaaaaggaaaagggaattagaggaaggttagggaatgtacctttgttagcattttttaattgtgtttttgttgctaaggtattcttagctttcatgttgggtcaggacaagaatctctaatcgtgcaaataatctctttttgcagcttaatttgtagttttgtacattattcgtttccctttgtgtaatgttctttttctctgcttactgcccctgtggcccttttctttgttgttgccattagggactatctcctatttaaatatatatttggtttaagtctaagaaacgtttttgttttaatttttgtttcttaaaaatagtttttaattttaatttttaagataaagaatgcgtttgtttccgtgttttatttctttttatatatagttcagtcgtttttaaataaattaaaaagtgtacagaaactttaaaaataaatttaaataattagaatatatttatatttttaattttgaaaataatataagtcaaaatgaaataatgtttttgcaattaagaatgtttgaatgtgtgtattcatttattatagctatgaaaaatattttttaaataataataacaaacatagaaagtaaaagtaatatctatgcaattaattttttttaattcattattatctacatattttttcagtataatattatctacttcataatattaaaattaattgaacattttttttacaattcagttgtttattatacattattctcaaaagatagttgtaccttttattgtattatttatgtccattaagtataaattataattaaactaactattatataatttacacttaatataaaaggccaccggtaaaaggactagctagttctaaaaaaaatgaatagttattcatattgtaaatctgagtttcgctgtttaaataaattttatttttctttttttatataataaattactttatcatgagtagtattttatatttaaatttttaaaaaatgtatattgatttttctcaaaaattatttttggtgtttaattttatcgtgagaaattatttttatagttatcttttcaaaaatttatcttagttttaaatttttaaaatttgtgtcaatatgttcctgacctaaattcaattggctttataattgatttactttgtgagcgaaggaattttgaagtgtttcaagatcaaaactgaagcaaagaggatatcatgattcggttacataagatggagctggtatggaatcatgttaccaagaatcaagagggaactatcaaaaataattccaacaatgttcaagttaataatttcatttgaaattcatcccaaggaaattagttcactcttaattgcgttggtgctagatctcaagcaaatgcaattatattgtgtgatggtcttcttagaaatgatgtgggtgattttatggcaggctttgcttataatctgggagtgagttcagttcttcaatcagagttataggtcatattccatgacattcaacttgctagatcgagaaaaacagattctgcaagtaggatctcaatctgactcaacagaagatatacatcttatccttgatgggtgcaacgaagatgatgtctgttttcagatctgttgagctataaagagcagcattgagcctccaatgatgatgtctttcaagcacattttcaaagaatataatgcatgaacggatgcctttgctaaacatgctctcagtttgtctcataggctggttctttttcatgcagacccataattttgctatccctagtttgttggcggagaaatcagcaataggaggattgtatatgtgtttttctggtatttttttcgagctgtttaagcccttgtaagtcaacaaaaataatagtagttagactaaatgcattgcgatgtattttcacgttgtcatgcaagcctagtttcaagaaaatgcaagtctggcatccaaggaattaaacaaattactttgcttactcccttatgtttggtaccatttatgctacttgcttattaaattatgcaaaaaaataatctaaaaacatttctaatcataaaaaaatgttatacatttataatgtaaaaagttatataggtcattcatttacaatctatcgtgcatgataaatttattgacttttaaaataattatcttaaaatattttaaataatgatttgtgattgaatgataaaataaaattgttttacattacccatgcataaacattaaattcttgtaattattatgccaattgtatcaatcatgaggtttactaataatttattgaccaatattgtgattgagtcaataattggtctaatctcaatattgctcataatatgctatcaagaagaagaaaaacttcaaataatcaaaccttacttaaaaaattggagattgcggtatctcactaaaaagtcaaagactgagataaatgacaaactaagaaaatatttataataaatataatgaaaaggaaaaaacaaccaatatgatgttagttcaagtggaaataaaatcaaaccccttaaacaaaatattatatttaaactttatgaatgaaaaagtctaagtaaaagaaaaatttactaaagataattaattaattattggcaaagtttggtagcatatactaataagttaactaaatgataaaaatttcctttaaaaagtgaaatttatgtccacaaaatccttaaaattcactatattttaacttttaagccttatagataatttttaatttcaaattgaggtctttaatctttattacttaagtgtgaaataaattttttcgaatttcacatacaaatagaaaaaaactaaaatttgaatatctatttttacggtttaaattaaaacaacttatattttacttatttttatttaaaatgttttgaatttataatttaaaagtacgcttaaatttaaaaaacatacaatataaacacttatcattatatgttattttcaataaaaggaaaaaactaaaaatggaagaaaataagcactcacttcgatgttgtgaaaattgatcggaaccagtacatcagatctgtccaaccagtatccggtggcataatcgaactggtttagttattggaccggccatgtatctaaccctagatgacccggccagaccttaccgattttgcagagtgacttggtgatccaatcgatttttgaaatttggtctaggtttcactttcacttcacacctttgtcgccttcacgctttgactgacaccatcccaccacgttgtcgtcaaaacaagaaggcagaaatcgttgacaaaggtagagaaggcataaattgtcgcttcacgctttaggtttctttgacgtagagcaaataatgtcgtcgaaaaattgtcacttcacgctttgggtttctttaacgcagagcaaagaatgtcgtcgaatagtaacccatggaaggcaactatggtgttataggagggaactggagcaaaggtggtggctctttttcagacgaaaaggcgatataggaaggagagagaatgcacaagagaagaatgatggccaacaacaagagaagaatatatattagggattagaggttttttagttggacttgggcctaattttgctagatattgattcgtgcatcccttttattatgcggtttccattttgcatttttaaaatggacttctacttattttatttattgaaaactagacttgtgttttaagttagataattgttatttaaactcttttatattattaacacattttatttgtgttatcaactttaatatttcaatttttattttagatttttgagtttgaaattatggatgaactttttttaatcaaataatgttaattatatatatatatatatataatataattttaaattttttaaaatagatcaaataaaattgaatcaattattggtaagtcgattggacaactgacctattatctcacctaggggtgggcattgattgaatttttaagaattcaatccatattcaattcatatctatttaaatggattgtattttaaatccatatccatattttttaaaaaataattcagactcaagatccaatccatttaaatggatattgatttggatatatttaatttatattcacttaattgttgtaagatttttttttttttacaaattttagttattaaatgctaaaaagtgaaaactaagtacttgtccatttaaaagctattttcaatggaccttagttaagactatttttttttatagatattggttagtgtatttttgacatatctcaaccaaagcaatttcgacagatatcggtccagacaattttagactgacatcaactaagactatttttttgctgacattagtcagtgcattttcaatcgacattggtcaatgatgtttttggtcgatcttagatagggttactttttggttgaggtcgccaggatttttagtcagtacatttttttgtcgacatttattaggattttgtggctaacattgataaggtttttttttttccgatgtcaatcattgatatttttttgccaacattcgtcaggacttttttttgtcgacgttagctatatttttttgtcgatgttggttgaaactatatttttgttggcaacaactaggatttgttcgatcggtgtcaatttggagaaatattttggctgacgtcaactaggttttttggctgatgtagatcgatattttttaaccgatgtcggcaaaaaattgtctcgtctggcgttgacaaaaaaaatcatagtcgacgttgagcgaaaaatctacttgatgtcgacaaaaaataatttcgacatacatcgataaagaaaaacctagctgatttcggaaaaaaaaatagtatcgactgatgccggacaaaaaataatctcaatcaatattgactaaaaaaatcttactaacattaattgaaaaaatagactcaacaatgacagtttaaaagtatcattagttaacgtcgaccaaaaaaatagtctcaatcaaagttgacaaaaaaaattgacaaaagaatctacatgatatttttgccaaaaaattagatttaaaaattcaaacaaatattcaatccatattcactttatatccaattaattggattagatttaaaatctaaaaaaatatatttaaatataaaactaatctatttaaataaatttaaaataaattaaattgaattagataaagattattatgtggatatgattttttttttccacccataatctctacaaatcaataagcgggcagagttttataacactgattcacttcactttacctggcgcatcttcgagacgagggcaaaagacaaaagccgcccaagggagggcctgagagaaagtgtttgagtgagagtgaggtgcttgttgtggggcacgccctaaccggaagcggttaaccactctgaaccgaactgaaacggaaccctattcaatttgtaatctcagaacactagaatcagagtttgtattttcgtgtgtgtaagagaagagaacgatgagtatatggaactacgtcgtcacagctcacaaacccaccaacgtcactcactcctgcgtcggcaatttcaccagtcctcaagacctcaatctcattatcgcgtatctattcatattccctttcgttttcctagggtttcatttcttctctttcaatttcgtcaccgtttatttaccctttcacttcgttttttcttccaggaaatgcacgcgcatcgagattcacttgctttctcctcagggcttgcaggttcttcctctattccatttcacaggcttcttgttttaatcatttttatttgaatatgcattctttttttggattttgttgtcttctgttttcaacggaaacctctctttgcagcctatgttggatgtgccgatatatggaagaattgcaacacttgaactcttccgccctcatgtgagaaaattaaaagcatacgtgttttttgagttattgtctaatgttgtagttttattcttccataatgtattttttttgtttgtttgttttggtttcaaacagggtgaaacacaggattatctttttattgcaactgaaagatacaaattctgtgttcttcaatgggattctgaaacttctgagcttgttacacggtatgtgtgaggaagcatcaattctttcctttggagtggacttccttttgttcagcttgtttttgtatagattgaaatcaacattgtttttaattttaagcaattatgatgtaggggttgtataagctgttagctggggtattaactatctcaatgtgaattttgttatgcaataatccagttagtttagaatagggtactttgtatgcagtgtgtaaaagagagtttcataactttgaagcatagtatctttgttaattgactaactacttcattagttattactgctaagctttctggtgctgccagatgaaggaatggggagaaaatatgtttctgacatgtattttgtatttgcttgcacttaacatagcacattctttctgtatgaccagaaagtccagattgatatgcttgagtataatgagagatatttttggatgaaatgctaagtgttttctcaacactcagcttctcttatatatcaaacttagcttacaaaggaagcttttacaggaaactcagaacagagcagatacaaaaagtcaaaaagaacagtagcctagtacaatggggatataataacctattttctaacattccccctcaagttggagcatataaatcatatgcaccaagcttaggacataaaaactgaatcctaggtcccctcaatgacttagtcaaaatatctgcaatttgattatcagagctaattttttcagttctaatttcctcagccaacaaattctctcgaacaaagtggcagccaatttctatgtgtttggttttcatggaatactggattagaagcaatatgaggtgctgcctgattatcacaatatagttgcatctgctgaacttcacaaaatttaagttcttggaggagttgtttgacccacgttagttcacaagtggctgaagccagcaaaaaaattatgtttcttgctcttccaagaaatcagatttcctcctatgaatacacaatatccagtagtagagtgtctgtctgtaggagagcctatcacaatacccagtaacatgggtatttcccctgtcttcatacaacaattcctgtcccagagcccttttaatgtaactaagaatgcgaattacagcatttcaattatcaatgtgaggagcctgcataaattgactaatcggtgataactcaaacagttataaataggatgggaatttctggtagatcgaatacctttcttaagagcaattgggcacccagagtcatcctcagttggaaccgttgtacaaatagctgaaggtgaccaacatgaagcaaaggactctccatgtgacacaggactagattactctatttgtgtctcatactagtgagtagtgtgaggtgatgaagaaaggctggttggagaggtggcttgatttgtgtccataatagggatttaatgaattggagacaatagtggatcaagtgatgggacaggtaaaacttgttggactaaattgaaatcttgcattgaagaagagaaaaagcgagtttcttcaaagaagttgacatttgctgacatgtagtatcatctagtgtttggtaagtagcaatggtaccccttttgtagacgggagtagccaagaaaacgcatttaatggcccttgcaaatagcttgtcccgacctggagaaacattgtgaacaaaacaagtacaaccaaaaatacgaggagagacatgaaataacggttcacttggaaagagaattgagtaaggaattttattctcaggagatgaagatgacattctattaattaaaaaacaggcagtaaggatggcatcaccccaatgatataccatttttctttctgctatagcattttgctatggtgtgttaggacatgtggactgatgtaaaatgccttgtggttaaaaacgaagagagattagaggagaaatattctttggcatgatcattcttgagacggtcactggatgagggaacatagattgatatggtttggacacgtcatgagacgatcactggatgttcccgtaagaacaagagtttgttaccaagagcttaacataaagagaggtagaggtcgaccgaaacttacctaggaaaaggtagttaaacaagacctaatggagtgggacatagattgacggacgatatgtcttaggacggagcagagaaaaactataagtttggtggagggttaaacgaattagtagtttcatgttccagtcgttcccttttttagttcttttcctcttcttttctcctccttgcacccttcttttattttagtttatttttcctttgttttgtcttttttccactttttcttcccctcaccctttctcattctttgtcttatttccgatttattattgggttcgtccaccatcgatcccaattaacttgggttaaaggtgttgttgatgttgattatcattgtcttatttcaaaaccgggtcttgatttcattaagaaagacatgaatataggtaaaagttcaaatcaatctttcattaaataagcccaagtagatctagagtattcatcaataaaggtaacaaactatctgaaaccaaaagatgtggcacgacttggaccccaaatatcagagtgaaaagtggaaaaagaagagttacatcttgtttttagttctctttcgggacctaacatgttttcctaattgacatgattgacactctaagacctgacgcttgctgagattcgcaaccattttcttcatctctgacaaatgtggatgacccaagtgatcatgcaaaagtttaggagacaaagatgcaaaacaagacatagatgtgttggcttcaagatagtagagacctctgaattcatgtcctacgccgatgaaccgattcgttccaagttcctgtataacaaaggagtcaacatcaaatgctacagaacaatttaatgattttgtcagttgactaagagaaactaagttgagggacaattaggaacaaaaagaactggatccaagtttaaagaagcaatggagactttgccaactcctttagaggcgacattggtgccatttgctagggtgatcagatgaggaaattttggaggagacatagaggtgaataaagagtcattaccgaaaatatgattagaaacacctgaatcaattgcaaatggaccttgactatccacaaactgagaaatgcaagttgttgaagtactcgggcttgaagatgattgagcttgactgttggacttcagtcgaaggtattcttgatactcctcttcaaaaaacttaggatcaagtgtttctgattggtgacatttgttgttttatcagtccagccaattatgtagtagcatgtcttgggtgtggcctcgcttcttacaatgtgagcatcaaaggtttgaattcatgtttctaccaccaccatgtcctccacgattcccatgatcccctcttcctctagtagcaccattgttgaagattcaaaatgctcaaatgagtttccaatattccttggggtctgggaacatgaagaaggcgtgtcatgaggcgatccattgaaggaacttcttgactagtcagaatttgatcacgaatatgatcaaaatctggattcatggcacgtaaggccagcaccatatacagattgtcatgcttccttttcatttccttcattgactcaacatctaagagcatatttagtccttcaactgcagattggatttgagcaacaaacaaggtcatatgatgatctgtttgcttataagatgtcaactaggcagctgtatcatacaatctctgaatgtcattggcatagatcttttgggccttttcccaaaaagagcaacaagttttgaaggacctcaaggttcctaagatattttgctccacagactgccacaacaaggtaaaaagctggaagtcaagtctttccattgttcctaactttttgctagtacttcagtgaactctttctccaagtgattgtgatgcccttggccaaggaacagagttccacagatatagaccgggacaaataattgttactatcacccagcttctctgaggttatgacaggtgtcctcgagaaagaaattgtgggactaacagaagaagttgtagaagaggttgtagaggcatcttataacaaggaggagttgtgcaaaccaagatgccaaactcgcacagacagaaccttcaagaaaggttccaacttgagaacccaacactactaatgagagataatgaagatccaggaccagatctaggtctagggagatttgcgagttgttctgtactgttgtggcaagtttccgaccagtagagggcggcgcgtagacttcacacgccaaacaaaaggctctgtacaagtggcgtgtggaggcctttttggctgtgtgacttgctgggttaggtcacgctcactaaggcgcatcaaaccttgggttcgccggatatttggccggcggcagcaaatggtggctctggtgatattttgtataacctctttctgatgtgttagaacttgtgaagaaggaaattagtatcccttagaacttgggagggaaacatttagttgttgggtaaattgcatgcatctgacttccctagacggagtcttgtgcattaggctgcctcttttactttcttttgagtgggattattggttgataactttgtactttgagtagtgtcttgagcatacaagctaggaatttctgtgaaaaattaagattgaaatgttgtcggggtcttgacattaccttatgttaattgaataggtcttgtcggggtcatttaggaccctaacaggactttggagttggagttaagctgggaattgtaagtcaaaataagaataaaatcccaaatccctaacttaaatgtgtgagttcatgtaagtttgagagaatgtacatatggggcaggagacaggagaggaaatcctcctaaaaaatgaaaacaaatagtgagccaaagtagctcaaagaaacagttaggctgtccaatttctgtatattatatattataaattgaaattccttgtaagggcatgaatggttggctcatttatttgtttaattctctttgttattgtaatccagggcaatgggggatgtttctgaccggataggacgtcccacagataacggtcaggtatttgaattgttttacttatatctactgataaaacttgggtagttatagtattctttcagttttgatatttttaacatttatgctttatctagtctaggatcagttgaaagttgttcagtgcatttcagctgttattccattttctttctgcagattggcattattgatcctgattgtagactgattggactccacttgtatgatggtttgtttaaagtatgtaactgcttctcattcactattctgtaaaaatattagaagattagaatgacaatatgtttctgtttagtgtcacgttaaagtatttgaatgattcactgttcattgatcttccaggttattcccttcgacaataagggacagctcaaggaagcatttaatataaggtaaccatattattatcttggttttctaaacatggattctatttacaatttgacctttaatataaggtaaccatattagtgtctgttctgctttgttcttggtagggtgtattcatagcattactacttgcactgctactactatcttttattaatataattatttttgctgataaatattttttcttttacaatttgacctttgctaggtatgcctaaatgtagtgctagtaactatgagcctatgaccttgattaaggattaccagttaccaaagccctggttgtgtaagaatgaaatgcgaacctatgtcaagttggatattgttggtgtctttacataagattgaaaaaagtcgattctgcatctcatgcatcaatgggtcaatagtgaacttagatatagctttctttgaaagaacaaaatgaagtatgaatatacatttattagttggtttaatctatgtgtttaattgagatggttttaaaatccaaactttctcctgtacagacagttaaaaattatataataataataaaaataatactggttcgaccatggttaaactaatgccttaattggttcgatgatcggtccagttttataaacattgagcaaaattgtggatgtcatggtggagctaagtcatggatgtaaatgggtgtctgtacagtttagtttctttgtatctttttttcatgttatatccgctgtgactatggacaatggctgtgctgggaaaacaaccctagctttgtttatgctttgctgatctcatagtggcttgctagtttgtttgctttcagttttaaatgttatgttacctaagagaacattcataaaatatgggtgtaagttatttgtatcttttttggttgggagcatagcagtatacttttgctctaggatcaagtttactttcatttggttcatgcgtatgcacaaaaacagtacagagtacacccaaatattcttagaggtaaagtgaatgagagtctattatttggaaaaaaaccttgtgagaacatcaaagagttttgaagctcaaaactttgctatacttgtttttgatcaaataagttccaattaagattgctttcaccccaaagatattttggtgctacattttgaaacaatgcctgagcaacttctagtatatgcttattttttgtttcagtcactccattttgttgtggcgtgtcaacacaagacatggtgtgcagatacaagatcagggctgaagctttgatactatataattttaggagaagaaaaagatattctgtattattgattgatttgaatttacatgatttataaaggcagagctgacaaggagagatcctaaccaccctgattatggaataaacattaggataagatatggagaaaataagggagaatcagatcagattattttgatcttgattgttactacctaactcttcttgaaaccttatttgaaatttaaaagaaaagcaaatactgttggcattttttaaattgaaaatgtttttatttataatttattttttgtaattttcttccctactttttctttttcctcttttttgtttctagttctgatatagtttattagaattatgatgcatttgttttcaggcttgaggagctccaagttttggatatcaaatttctttatggttgttcaaagccaactattgtggttctttaccaggtttctaattttattctacctattgtcattttgttttgcttcttttctttactctgctcttttatttttgtctttgggtccacgctaaatgcatttagaaatctagtgctctataacaggaggctaaatttgtgtggctgcatgcagtttaagctgtcctttggcatgtgtagttggagcagaatgcttacacctttaagggtgtattgttgccccaaaatttgttatgagggaattatgcttgtgcttcacaattttttcctgatggagtcttacctccatttggcctaatgattgtttatacagtcagcatggaatcattataataccatgctctttctctgctttttcaaaataattcttttcaatttctaatttaatatacatttgagacacagaagaagaaaaaaatacaggaaagttcttcacataatttgtgttttagaagtgacagaagagtaagtatcacatcattcacatgaacttgtattagaattgtttacacaaggtttgagacaaatttaaagagtgctgaagactgaagagggtttgtaacccatatgttataattgtcttgttttagtttcagtttatgggtgggcatattcatattcttgcataatttgtgtattcaatgttgctatgatttgatcatctatgaatatgtctgctgcatattttaatttttttcttgcatttcctttatgcaatactatttgttggaaaaatggtgtttagcataaacaattttgattttgatggatttgttactgttttcatcaatgacaggataataaagatgctcgtcatgttaaaacatatgaggttgcactgaaggataaagattttcttgaaggtccatggtaccagaacaatcttgataatggggctgatttattgataccagttcccccacctctttgtggtgtgcttattattggggaagaaaacatagtgtactgcagtgctaatgctttcaaggctatcccgatcagacctgtatgttaaaaattattttttgtacttccatttaaatcatctgtgattttttgaaacaagtgcatttgtacaatacgagttattggacttcccttccatcttaattgtaccttttgtgcttttcagtcaattacaaaagcctatggaagagttgatcctgatggttctagatatttacttggtgaccatacagggttgcttagcctacttgtaataacccatgagaaagaaaagtatgtgatctctcattctcggcatcagtatattgattgaataaacaatctgtatttttataaacaaacaatagaccactattttaactgttgaatcttatggtttgtcatttacatttattttatagggttactggacttaaaattgagccccttggggagacttccattgcatctacagtatcataccttgataatgcattcgtctacattggttcaagttatggagattcacaggtgggttaatgaactggaaaattactttataaattttcgttttgtgagaacataacgtgaaagttaattatttccaaatttccgtctccccaagcactagttttgaactattatggaagctttgacttgtttcattattttaatgtgaaatggaatctgtagcttatgttgggttgattacttattaattgtattcagatttgagaatttatgactcttgaatgtacttgtttaaatatagcttagagagcataactttatttatatagtaaatagcaaggctgtcaaacttgagttgtaaacttgagacttttgaaatattacttaaaatctattgtggaaccccaaacataatttaacagcatatatataatatataatgggaggggatcgacttacttcaagagtaattctcctcatcctcaccattcattttcttgagatctaatggttaagatcagttacttattacaaccattagatcttaagaaaatgaacggtgaagatgaagagtaactctaaaagagttactcttggagcaagtggatcctctcccatatataatataggcttaaatactgttttagtccctgaatttggggtatgttttttttttttttaaatccctcaaatttaaaaatgctatttttagtccctaaattttgaaaattgcattttttagtccctgatataataaatttacactttgtgacggtttttagctgtcttaaattaatttttattttttagccacttgaatttgcatttaaaaactgtcacaaagtgctaaaaaaacctgccataaagtgcttaaaaattgccacaaagtatcaatttattatgtcagggactaaaacgagcaattttcaaaattcagggactaaaaaaagcatttttaaatttcagggactaaaaaaagcacacccccaaattcagggactaaaacagtaattaagcctataatatataataaatattctgacattccaactccataacaaagtaaatgaaatagtacagtaagaacataagtacaaaagggacctgcatcaccaaaacaatcaagtgtttttcttaggatattttcttttcttctaatttttttactctaatataagataacaaggaagggaaagaacatatctgtatcaggaagcttttgcaatatgtgaagtgttttcttcattgccttttctattcatgttgctttaaagtctttggaagtgtagtatggcatatccattgctgaatacttatgcttacatattcagacataacatattgacaatctctgatgttaaaatgcagctaataaaactaaatctacagcctgatgcaaaaggttcttatgtagaagtactggaaaggtatgtcaatttggggcctattgttgacttctgtgtggtagacctcgaaaggcagggccaaggtcaggttgtaacttgctctggagcttacaaggatggttctcttcgcgtcgttcgtaatggaatagggattaatgaacaggtcagctccccttcctccaccacagtgtggaacatttgcacccaagacactttcaaaaggaatggaaattgggaaaataaatctttatatcaatgacaaacaccttacaaaatattaatttttttatgcatgtatttggtctaggcatcagtagaacttcaaggtatcaaaggaatgtggtcacttagatcctcaacagatgatccctttgacacttttctggttgtgagttttataagtgaaacaagaatcttagcaatgaatcttgaggatgagctggaagaaactgagattgagggattctgttctcaagtgcagacattattttgccatgatgcagttcataatcaacttgttcaagtaggttcttaccttattttcttaccatattgattttctgtttatcttgatttaacacctacatctctctgactaaatttaagagaagtggtggttaagaaaactatttatagctgcagagttcttttgtcatttgcttatggatttgctatcaaattttactgttaggctgtctatttattatgttttcttacaggattgctttcctttaattttcaaactgtttctcaaccaacccaatattgatcactataaatatataccctttttggtataataaaaccttttattttagttttctatttttctaaaataattagtggcatgttttatcttctgcatataaaaattacctgatatcaagatatcagtatagatgtgtgtataatgtgtttgtgtatatttttatgttttgaattttgacaaattttgatttcttgtcaaagaattttttttctctgtaactacacgagacagaagacaggactgatatcttagtacctactatgatgtatgttttcaacaggtttcttcaaaatacaaaatatttgtgtcagcttctttttggtttctttgttttaaaaaagattgtccattttgtgaaaaattaataagaaatttatttagagtttttggataatacaaagctgtgggtaggtcaaaatcggaatcaaacaataagaattataatacgttggaactttaaagaaataaagatttaaacttacataatgtgttaataatcttgaaacttcttttgtaagcttaagttctgcatgctcctttgtagttaatttgaataattttcataaattgattccataaattaattaatgctattctgctgtacacttctatgctttttttgtttattttattttgttttatggcagacacctgccattagctaataaatcgaaattacaggtcacatcgagctctgtcagactggtcagctccacaactagagagcttcggaatgaatggcatgcaccatcaggctattcagtaaatgtagctacagcaaacgctacccaggtgtgatttgggtgctttacaaaaaatgttatgtttaaaaattataggcgatatttgtttagtggttttttaaattccaattggttccctcgtcaatgtggcttatctgagtagaggcagatcagagtctgacacattccccctcccacttgttccgatggaaataattttgatgtacattagctgtcaggacgatggaagtagtgacatgagaagctccttatcattaactttaatatgacttgagcccctgttttgctattagctgctagagttatttgggtgaaattattgtgtttagaaagctataggatcattgaagtagaatgtaatgctaataaatgctaccttgggttaattcttaaagataaaaggaggaagacagctgaaggcatgttgaattagtaattgtgacatatttgtcattggtttatggaatattttttaagtaaatgactttatgacttctgtaagtatgaaagacgaatatttccttttcagtctatgttaggtgtgagggctctagttttttaatgcctgcttccaatttttcatttacttagagaatcatgttctttgattcttcaaggattgttttttggtgttcagtgaagctctaagcatgaaagatatttcctgaaggtgcagtaaatgttagttaggtgcgaaggctgtagtttttaaatgcctgctcccatcatttcatttacttaaagaatcatgttctttgattctccatggattgtttttggtgttcagtgaagctccaataataagttattctacatgaataagaatgtcttttatactgataaatttgtttgttttctgttttgatattttaattcagattgtgtaatatttattttgtcctatgttttttaataatataaaacaataatccaataacagtggaaagttaaagctaaaacaagttaatgactcagtggcagtgtatattttacttattttaattccttaaagttgaaaggattttgcatcactgcaagactcctccaaagggtagagaactccagattctgatatcttaaagctacagacaatctacaaagtaatataatttgtggcaaattccttggaataagttttatataacataagaccgttgagccaaacatgattttgtttaattggtatagaaatactagaattaattttgaccagaagtatcagtatttttgctactggtcaaacaaatgttgtgctttgcagcaacttcaaaacttggcctttgatgtatctccacgagtagttttggtatggtatccaatcaagctccttggaataagttttatataatataagactgttcagccaaacatgattttgtttaatttgtaaagaaatactagaattaattttgaccagaagtaacagtattttgctgctggccaaataaatgttctgcttggttgcaacttcaaaacttggcctttgatattatttctggatctctacgagtagttttggtatggtatccaaccaagctctactaaagttaccatttaagagaatttgcttcaatctatttcattacttttacactgcacatttccattgttggattttattatgacaatacatattgagtttgcaattaaattggtaattattgttacacttggacacaggttttgttggccacaggaggagggcatttggtttaccttgaaattggagatggcatattacaggaagtaaaacatgcccagctggagtatgagatttcatgcctggacataaatcccattggtgaaaaccccaatcacagtcatctagcagcagttggaatgtggacagacataagtgttagaattttttctcttcctgatctgagtctcatcacaaaggaacaattaggaggggagatcatacctcgttctgttcttctttgtgcctttgaaggggtaggctttcgttgagttattttttgtacttggttttgtttttttgattctagcattctgctttcttattttatttcttgtaagttcaatttgaggtagagattttggatttttacatgtgtggcagttgtgaggaatatacgaagatcagcaacattaatatctttttactcttatgctcatgttaaattgaggcattgcttagctttcaatgtcacaagttttatggtagtttccttaaaaatatcctattaaagtgtgttgccttgtcaatttatcctccagatatcgtacttgctatgtgctctaggtgatggccatctcttaaactttatgttgaatacaagtactggtgaattaacagataggaaaaaggtatctctagggacacaacctattacactacggacgttctcctccaaaaatactactcatgtgtttgctgcatctgatcggccaactgtgatttacagtagtaacaaaaagttactttatagtaatgtgaatctgaaggaagtgagtcacatgtgtcctttcaattctgctgcttttccagacaggtatcttggtctttgttagtttgacttactagagttattgacatatccccttgtgctgttcttggatcttgttcaatttaatgtaaaataatttactggtaatggtactcatctacttttaataacttaaacagtttggcaattgcaaaagaaggtgagcttactattggcaccattgatgatatacaaaaacttcatattcgctctattccactgggggagcatgcacgacgtatctgccaccaggagcaatctaggacttttgctatttgtagtttgaaatacaacccagcaagtggtgaagaatctgaaatgcactttgtccgtttgctggacgaccagacttttgagttcatatcaacttattctcttgacacttatgagtacggttgcttcataattagctgctccttctcagatgacaataatgtgtattactgtgttggaactgcatatgtacatccagaggagaatgaaccaaccaaagtaagttgagaaatttgtattttttcggctttgttctagtcaaagcttctgatatcctgcttcctgtggccattttaaaacatgtagggaagaattcttgtttttgctgttgaagatggaaaactacagctaattgccgagaaagagactaaaggagctgtttattgcttgaatgcatttaatggtaaattgcttgctgctattaatcaaaaaattcagctgtataagtgggtgctccgggatgatggtacccatgaattgcagtctgaatgtggacatcatgggcacatcctagcactttatgtgcaaactagaggagattttattgtagttggtgatctgatgaagtcaatttccttgttaatctacaaggtaaattttaaactgttgtgacactattttctgtctggttttgttaaatttcaactgttgtgctgcttatcgttttggatgaataactgatttttgtatatataatgagtataccatgttcttttggaatgataaatttttccttattgatagcatgaagaaggtgctattgaggaaagagctcgtgactacaacgcaaattggatgtctgccgttgaaatcgttgatgatgacatatatctaggtgcagaaaacagttttaatctgttcactgttcggaaaaatagtgaaggtgccactgatgaagagcgaggtcgtcttgaagtggttggtgagtatcaccttggagaatttgtcaatcggttccggcatggctcccttgttatgcgcttgccagattctgatgtgggccagatcccaactgttatctttggcaccattaatggtgttattggagtaattgcttctcttccacatgagcaatatgttttcttggagaaacttcagtcaaatttgaggaaggtaattaaaggcgttggagggctcagccatgagcaatggagatcatttaacaacgagaagaaaactgttgaagccagaaactttttagatggagatttgatcgaatcatttcttgatcttaaccgcagtaagatggatgaaatttccaaggcattggacgtttcagtagaggagttatgcaagagagtagaagagttgacaaggttgcactgattttatattgttttgtagttttgtagtttcgttgttttgttttttttttttctcatttaactttgttctttttgagaggttgggtgggggttaaaataacatatatgtttgtatttttccccccgcttttaacttctgtttgcatttcacaatacatggagatcacatagtgtatgatatgaatgtcatgttctaaggcatgatagtgctttcacttttggacacgctatcattttcctaatatttgctttcaagttagttatacgttgcagttctgtcaagtgtcatgttaacaagcgaaacacgcatagaaaatctggtcagatttgacgtccaatatcaagatgtattttaacattgttcaaaagttttagttgaacattaaaaaaaaggtaattcgaatgatttttgagacaaatttggtccttgaaaaaatggtaaatcaagttgattttcagtcattggaggactgtcactttgatttcaccaagcagtagtagtcttttaattattttaatttcaacatatgtaagtgttaagttgatctgtttatgtaataatcttttaagaaaaaaaagttatttggaaaattcattgatggcaaaaataagttattttaaaaaaagatcaatgttatgaaaataagctgaaatggtagatcaaattgataaaattgaaatggcaaaatttagatttaagtattttattacatcgatcaataatatttgaatattattcaaagtacatgatttatttaagaattaagaggattaaaagggacattatttaaattttgtccgtaaaaaattggttttggactggtcatctacaaaattggaatatgaaaaactgataagtcagttgtgaattgtgatcatgaagcgcttaaactgtacagttttgtcactttcaaatggagaaaaaagttgaaagtctcaatagcacgagtggcatcaagtttatattcagaataatataaatggcatgcatttaatatcttacacgacaaaatttaacttttgggacgcgaggacaaatgccagagtaagaataccaaccgttcctgagtatgaattcccctttatgaattaattaacaggctacctttcaagaactagtttttattttattattacaaaaatagggcttaaaggcatgtatcagcttatttttatcgtgtgtgaatttgaagagagaaaaaattatgcaactctttctctaattacaggataaagatactttaattagttcagcaaaacttcctcatgggcataatgaacaaattcatgcgaatttgtttttaaaaatattgtgatttttgtcaaacacctcccataaccccagaaaaaaagatgctctagaactataagcatctagtcattgtttttaaattacattttcaactaccataaagattctgagatacccaaaatttctttcagtaaaatgaattgtagctatacctgtgtctatctaatcttcaaataatattgagctgtaaaccttattccataatattacatctaatcagaaaatgctctcccttgctaagatagcattgctgatatatttggtcattgacagatcttcacaagaggcaaaagcgggttaaaagtagtaatatgcaaacatccctcccatctaggacagatttcaaaattgtcactaagtcaaaccacattaacataatggctaaagagaaatatcacattcacatatatcagcaagggttttgtagagggccatctgaatcatattcagaaaacatggaatctgattcgtcctcagaactaagctggttagtttttttagcaaggcaaacctcctctccagaccctccaccaaattaatgtctatgttttttttgtatacacccctactcctatccggtagccctttcttcagcaggcttgagaattcctctctaatttgtagaaggggatgattcagcaaaggttcctgaccattataggcctccctaagaacaactgtttgggtatcactcttcttggaaatataaaaaataccaggatgacactcaaatactttaggctttgtttgggagagggattgtagaggagaagcgaggtaagataaaggtttaggtggtgacatctccttgtttgaaagttttaatttttgagaaaaatgatttgagaatttttaaaactcatctgaaattcttcaaagcctaaaaattgttgttctaccaatttgagagtttttagaaggaaaaattataattactatcctaccccagtcagtgttaataaaattactatcttactccagtcagtgttaataaaacaccaaaatataaagcactgaatcacaattcaagagcaaaattgtaaaaatatcttattaactcttcatttccctctcttattatatttttaacttccaaataaggaggaaggaacttccctcattttcttccctttcctttccctcccttcccctttaatctctttccttcccttcctctcctaactcccaaacaaagccttaataaacttatgaggtagagccaagggtttacacaagttgctaacgttcttgcgctcagtttgcttatgaagtgtgaggtgaaggagctcatggaagaccctaactattctttttctttttgtgagaggcattgatgtaaggtgaagtataggggagtttctgccactctttcaaccactccatgcattttcttttcaaaccaaaaccccttgtgaaactaaatggaaatgctaaggatccattttttatgtcttctgccttttgttgtagagaagtattcttctgtaactgatgacaagattgtcatcccaaaacaacaatttcaagccaacacaatcatcaggaaggcgaacatatgagaacctttcagggtgatttggaacaaaagaatgctggtaatcatatggtaaaaccaagtcccactttaactggtcaatggtttgtagtggaaggatcctatcacttgtgagcataagcaatttgcacagcctatcccggagttccaactgattttgctgaaggatgttcatttcctcgtgatggagctccaaggcttcaggactcaaactgaaacacagaacaggagagcctccactatcaagaaaagaggactcaataaatatattgggatatcttctgataaaggtggagagtttgaggtcactcggaagactgatttgtccactgtggcgagaaagatggtatattggaaggcagtattcagaagaagaataaatgacggagacaaggatcccagctgccttaagatccctctgaccagcaacaacaacatccaatgtcctatctttcacccatttcaactttatgttcaccaaactaaacttctgctggtaaacatatccttgttgataaccacgaataaaactagaatttcttgcaataccaaaaagccaatggaacttaatataaactgattacagatagcataactaacacaaaaaggtgccctttgcacttgagttatcagaaatccacactttgcttcaagaaatgctctgcatatgtaaaatttggatttatgacaatttaaacaaagtgagaaatattctcctaccactaggaaggcattactcgacacaaaatcagatctaaaactaaagctagaaaccaatatcctgggactacaaataaagcaaaattataacaaatataatcacatgtttatgagctaattatcataataagtatgacctctcaaagacaactatatttcttcacatcacactactacaacccttgaaaaccaaatcaatgaaacaataatacgtacaaattactcaagtcaataatcttatgagatcagcaactgaacctttcaacccagttgcttcagtagaaatggcagaaggctcagtctgctcagataaattagctggtctaggacaaatgcaactgtaacgtcataagaaaatggatttgttccaaccataagcattcccccctaaaaatctctactttatttattctttaagtttacatttttttttatctataagaatcaaatcgaagataatataaagagatttattttaattaaatttacaaaatggtaaagtattcttaagtttaatttatatatatatatatatatatatatatatatatatatatatatataggaatcgaagataatatgaagagatttataacattcatttatcatccttaattgaactaaatcctcttaattacacttacatagtttaacattatttaaattaatattttttctttctttttaataatcaccaaacaaatagcgctcaagacaaatgctaacccatgatttttttattaggatgtatgaaattgtactctttatgatttttttctgcttatctataattttcatattaaaaaaaatttccttttaattttttaagacactagttagcgacaataaaaaaaatatataatcatgtgaccgacaaagtaataaattagtattaactttggcataatttttatttttatatagattgtagtttggtaaaaaaaaaaaaaaatatatatatatatatatatatatatatatatataatgctttgtatatattttctttgcattctaatagcatttcacaatatataaaatactataggtctgtttgagtaagtttctctagaaacacttctagaagaagaaaataaaaagaaaaaataagatgagtttttacataaataaaaataagtttttcattagctaatttttagaagttcaccaatataatttctctaaaagatgagatgatatctacaaattaactaataaaaaatttattttaatttatataaaaactcatttcattttttcttcttttaaaaatattttgagataaagttacatccaaatagaccccatatgtattttcttacaataaatattactttgcatatatattctcacacataataagcacgtgagactatttatttttttgtggttgatctctaatctaatctaatatcatacaaaaattatacttgaacatccaatatatcaatcaacacctaataagagagttaaaagtgggaaaaatatacataaaaaaagagatagagaaagaataagtgtttaattaaaacatatggatactcataaatcatcacttaatattatatatatatatatatatatatatatattatatgtatatgcacattacgtttaggaaaaatgttggattaacatccataatggcatgatattattcaatatctagtgaaagagaaaaaaaatataaatatgatacgatttatgatgtaatacacaagtaaaacaacttttttgaacctatgtagtcttttcgctttgcagtccctgttcaacatggttcaactcttggtcatgaacctgattagtagtaatattactttcactctcagactcctttgccgtgtcataagaagcatgcaacccaacaagagcatagtaaaccaagagcaacaccgtccacaccccaaacctaatatacgagtccacgtcgatagagccaagaaggaaaatgttgatataaatagacaaagcaggcagccacggaaccaaaggcaccccccaaactttgggttttttggccattggaacaccaagccaaagccctccggtccctaaaacccataacggcacacaaatcacgtacccaataatcccatcactgtttgcccaataagccgaaacgccacacgaagacccaaatattagcacaaggcacagaacaaacttcacttgattctcctttgttgttaccccacttgagtaatatcgcctaactagaagcgccacggccacaagcatgaaaataaagagagtggaaatggacaagaggttagagagaacacgaaagtttgtgaagaaagcaaccactgaggttgctgtgagcattgctattgtagcattcaccggcgtcccggtcttgtcatccacgtggccaaaccaaggtggcatcatgtgagtacgtgaaatgtgtgtcaagtaacgagactcaccaactatagtcacaagcaaaacagtggtcattccctttaacgcacccaatgcaacgatgtactttgcccaatcccacccaacagcgttaaaagcaacagaaaacggtgcatccacgtcaatatccttgtaggactgcacaagacatagtgataaagacaataagcaatacaccaacgttgttatcgtcatggacccgacaagtccaatgggaatgtctctagcagggttcttggtttcctctgccattgtcgccaccgcgtcgaagccgaggtaggcaaagaagagaaccgccgaggccttgaagacgccgcgggctccgaagggtgcgaagggagttaggttttgtggattggcgttgattaatccggcgacgatgatgaagacgatgacgaggcagtggaggatggtggcgatgttgttgaagatggaggaggctttggtgctgcacattgcgagggtggctatggcgatgaggaccaccacggctatggggtccaggtggccgtagtcggggttcatgttggggactattatgcggaactcgtctgggtggtggttgcatagggtggcgaagtaggaggtccatgaccgcgatatggcggcgccgcctattacgtactccaggaggatgtttccggcggccatgaaggccacgaagtctcccagttccactcttaagtatgcaaatgacccacctgaaaaacacacaccacaaaaactatcgtatatatatcattgctttcacattcttaagtaaaacagtgattatacattaggcatttattatgatacatatctattaattcttactttttttaaaataattctattcgaatccaatagaattaagtaacagaaaatttcctccaatgatattacttattataggtttctttttctctggtatgtagcgccattttgcttttaattttcaaaaacaaaatcttaagttaaaagttggaagattttatgtagataaaattaaaacttcatctcagtactttaaaaagaccaaaacccccatcaaagaccttgattaagatatctaaatatcaaataatctgtgtcaacgatttttactatttcttaaagtatttttgacattgtgttcttatgaaagttttcatctctataatatataagaaaagaaataatcgatacaccaaaagattaatagaaataatcactatgatcgaatctacaagtctttgtcaatctcccactaacatgtaattactcaactacgtaatttgtggacattgattaggacaatgaagtcctagttgaccatttcacagtatctccgaaaaaacaccaaactgaaagtaagctttgtcttgtcttaataataaagtagggcaaaaacctgcgacgggaatttcgacggcgaattcggtgtagcagaagacggagagcaaggcggacatgccggaaacaacgtaggacaagacgacagctggaccagcagcctcacgagcctcgaggccggtaataacaaatatgccggagccgatgacggcgccgatgccgaaccatatgagatcccacgagttgagcgtcttcttcatctcgttgctgctcctccccttcatctccaccacctccgtctcgtccttggatcgggtcgtaacccgatccttaaacctccacggcgtctccctcaacgcttttccatagttaccccaactcttaaacgattcctccgggaagaaatcgtttttctgaaacgtgcatccccttctccttgcacccctgctcccaccttcttccatttccattctgttcctctctctgtataaatcaaaatatatgcatgcgcgttacgtaattaatggttcagtatataattattaattaatatagtttacgcaggaagtaccaaacaaaacctgaattagcattttgtcttgtctttcttttcttcttatgtcatgacatacatgcatgcatgatgttcttgtacgtgttacttataactaataagctagaatccaagcctaagagagcaatattatagctagatgcacgcatatatatacaacatgtctgaatttctgaatcatgtttgagatatagtatatataattattaatctctgaagatcatatctgagacgtgaaaatcacatgtgaaattaatgtagaaataaacacgctaatacacacacgcacaaggtgtcttcttctcaatgcttacatattctcaaaaagcaaatatatatagagaggaaactactaagcaaaatagtacttacagacaattatggaggggaacatgcaaaatctaattaatggaatgaattaaggaagtgaaagtggagaaaaaagcgatcatctggtgcgtgagagaaagaaagcgtttcaagagtagagggggtgcacctggtggagaccctgaggggttgcgctttaatttatatatgcaataaatagcagtatataacaattcatgatgaatgtgtgtgcctaaattagtaattaacaagaaaagcctcgcactactttagggtcatatattattgtatttttaacagtacggggtatacaacttgatttactataaattaatatgtccaggttccttattaatttaatttgacgtatatattgttcttttgttttgtttttatggaaaatttggtccattttgatgtgtacccctctagttgaaaaatttagaatgtatttctttagagtatatttgaacgaagtattttaaaattttaggaaatttaaaattaagggaaattaaaatacatcaattaaaatttttttattttcaaaattttgtatttggataaagaaattgaatttcttcatttttaaaattttgaacctcattcacggaaaaacacttaaggtgaatgttgtcttgagagcagtggaggtcgaagtatgtctatgattgagacgaagcaaaaagttgtgcatttagaacttctaaaaaagaacagaatttcaatttctcaccttttagagggaaattcaaattccacaaatttaattgtttaaaattctcttttaaaatttcaaaaatttaaatttctcatataaaaatattcaaacagtgaattttaaattgaagaattttaaatcccctaataaattactttccccaattaaaattctccatccaaacacattcttaatgaaatgccgttggatgggtaactagattgagctacctctccagtctatgtttctgctgaatgcaatatatataacaaaaaccagaagcgaaaaactcattagttttatattcaggtgtaacaaaatttaattatgttttcttgttctatttttatagtgtatgtcacgttgtcattaatgttggatggcatcaacgatctataactgatctaataactgaaaaaaaaacttgttgaaaaatatagaatcaaaacgatcgagttaattaagagaaattgataaaatgcttgtacttgattggatgagaaaagttgtgatacaaactccattatggtatagcttacataaaagaaagccagtaacacaccataactaaatcaataatgttaatttcacctagggtgtgaaatatgagtgaaaagaaagggaaggtagaaaaaaaacagataaaagaaagagagaaaattaacgtgagagatacggttgagaaagaagagagaggggatgaaaaataaatgtaagagaaacagaatgtgaagaaaaaataaaattaagatgctaatcaaatatatatatatatatatatatatatatatcagcaaatgttaataaaatatctatgaatactctaacctgttataatttaatcttttctttatttgtaggaataaaaaataagaattatgagatttataataactcactttttattagtttataacttttaatttttatttattaactaaaaaatttatttgatttattgataaataagatttctttagtagtttttttagtaatttttatgtttttaaaattttacttgaagtattaatttttaaatattagtctttaattttttatatttttcttttttatctttaatatgtttatcaaatttttttattataccttttaaataaattattattttattacttttttttcattttacattttataaatatgttaccgttaattttactaaacacttataatttaataagttaactttttaattaattttatcaaatataatcaaaatcaatataagcatcagaatctcactttccttgaaaatcaagtatagctaaaaatatttttctattaccttcaaataaacataaaaatatacattttgatcttcgtatttacaaaaaaaatttataaaattccgtgaatacctcctataaaactaaacaagtcatgtaatttatatgtgtcttctcctttctttatcccatttgtcgaactcaactctattatttatacttgaagacaataattaattttttctatatgtataaagatattgataaaatatatattattttttaaatgatttattttctattcatctaactttaattatcaacaacaaaagttacttagctacaccttagtgtaaactaagagaatctctatgtcggctcaggtgaaggatattatagtttaaactaaatttttaaatttattattataaggtcaaatgtggaagtataagaacttttttttcatcctttgactactgtctccttgatgtctccacatgattctcttttcgtttccgactctgacttttttcactaaactatcacccacttacttcattccgtcaacatttgtttttttgttaattttttagacagctttgttttttgttaattatttcataacaagggctaagcacattattacaaaaaaaaatatatatattaccggaaaataagggggctaagcacatcgcatgtgtataaattgtgcacatggagatgtcatttatagaataaataaatagataatatttttaccaacaaatcattattcgagtgatcatgaattttattttttatctaagttttcgaaattaagcaaatgaaaaaatgtgtttcaaaatagagattttattaaaatttattagttagattctttgataaaaattaattattatcaaaattaataaatattttatgccaatatcataataaaaatatatagacaattttatctattcctaaaatggtgggaacatgtcatggcagctaaaagtgaatacaataatgcgaaataaagtccttaatacagcagcagtattttttttgtttttccaaacatcgtacctatttctctccctgattattttccatgtcccgttcctgcaataatttaaattcgattttttaatgcgtgcaaccttacacacgagtaattaattactcaattttatctaattaattcaaattatattattatatttagtcaatgattttggaattgtataccatgcaaattaagcatttttagtgatagatctcaaattggaatcttagaccattttttggtaaacctcatagtaccatgtaggattgaagatatctcaagatccctcctattttgttctttaatggtagattttattttgagatcttagggagagagaaagaggaaaaaaatttattcttttttgaacaatatgcagatcttaaaggttcttctataagaacccattctccatgttggagatctctctacctcctttattagaagatctagtgaagaccagatcttgagctcaagatccttacttaaaatcttgcactaaaattactataagtctcctctataaataaatatccattattctcctcatgactcttcttactttggatccataataaccacttttcagttttcagttcggaagtgagaggagcaaaacataagaaacggtggtggagatgaaggcacggagcagccacgagatgaagatgctgaactggtgggacctcatgtggttcgtaatcggcgctgtcataggttccggcatattcgtcctcaccggcctcgaggcaaggacggtggtcggacccgccgtcgtgctctcctacgtcgtttccagcgtctccgccttgttctcggtgttctgctacctagttcgccgtggaaattcccgtcgcaggttcggtctcttgcactcttgcttttttacctattgacctaattgcggtcgcgattacatgagaaaatacagctgataggattttaattacgattgcgttgttgtgagttaaaatactttgacattacggccacaattgtgagtgcgaaatgccatttgaaatcatacctatttgcagtgttttaagaaccggatcaaccgattcgataggtttgactggaaacagtttggcacactagttcgatttgctaagaagatgggaaatgtattttcagatgcttcatatgtgatttctggctcaaaggtagaaggatgatcaacttgtacgtgttggaagggattctacttctattagagaacattctgaatctgaaatctggtagtaagtcttcacagatgtttcttctagttcccataaccttgcatgatgatctcaacctcgcacgaatcccacaaattctagtggaatctggaatcaaacactttttgtttttggcagaaggagtgccctcccaccaagagtctgactgaacatcatcaaacacagaccaataatatgtgcaaattagaaaaacaaacatagttgtcataatatatgtccaaatatacagatcacatattcagtttgaagcaaaggttggagcccaaaatagagaaacctctatgtgttgtgtgtgtgtgtgaaacacatcaaacgagttatgattatgattaaatatgtgcaaattagaaaaacaaacatagttgtcataatatatgtccaaatatacagatcacatgttcagtttgaagcaaaggttggagcccaaactagagaaacctctatgtgttgtgtgtgtgtgtgtgtgtgaaacacatcaaacgagttatgattatgattatattccaagttcacttttttagctattgtttccacaaaataatgcttcatttttcattctaagtagaaaaaaaatcatatatttgctgcatcatttggaaacaagttacatacctgctggttgtttgatgagtaagagtgatcagaagaatccatatcactcacttgttgtagttgtaaactgcggacctcaaagcaaatgtttaaactgcgaaatgtaactttcagtctgaacaacatatatccaccgttgtgggaaagaaatattgtccgttagatttatgagttttctgtatccaccgtctgggattttttcttcttctccttttctcaaagtttccaaatttatccctccatctccctcaaccccgtgacaacactgcccctgtatctcctccttttctctctcttcctcaacaacactgttatggctgctacaactacaataaaatcaaaaagcgaacaaagtaaaaaccacacatcaaaatcagcccacaccaaagaatcagtagattcttttaagcaccaaagaaatattattaatatgggacaatcgtacgtgtacaagcatagcccctattgcatttcccagcaagtttcctaacaacagcatatggaatatgccccaaaaatacagcacggcgccattgaatacatccccaccccgaaaacataatataccaattagtggctactctttttcttaattgaaagaatcaacagatgaaatcacttaagtgtgtaataatacagcactttttatattattttttttatcactacgacaataatgtcgagtatccactaatttttatttaactaatttttacccgaaaattttaactaatcacttttagtgaatttttcatctcaaccatatttttttattcacaaaactcaaatccattaatacttatttgtattatcattacatacttaagtgatgctaataaataactaatgtaattattaattaaatgtttgtaataaaattaatttcaatctctcacgaatatggtaattcattgatctattactaggttataacattgttattgtaaatagaattttttaaaaattaactttaaatttgaaaaacatcctttaacaatgacaataataacaagtattgttgatgatattttataaacattacattcattttcaaggagatatttttttaatataatttaatacttctaataaaatgcttattagtatttcattcagtatctttaattttagaaaaataaagtcaatataaaattaatgctcactataactcaaaattgtttcatattaatatttattattttttaattttccatcttttaaaaaattaattgttgggattcagataaaaaagacaaaagtgatttcatattctaaagtttgttcaaattagctctcaataagagaactaaccactgtctttttcatcaaaatggtctgtttccatagatcatattatttttttaatgaagttttagctctatattcatgtcaatgccattttttttaaaataaattttcttatatttttttaaataagtgataaggcttattaaatactctttaacgatatatatttttagattccaaaatgttactaatgaattaattataaataatatattaaaagtactcacctaataatttaagttaaaattaattttctatatataaagaaatcttaaaggcagctacgtcaatgaggcaggtgcctggtaccttaacattttccttattatctcgtataatatccaattttgaaattgttttttccttcaaatctggtactctgctgatttacttctttcatgttcatgattagaaagcacccatttatcttttgtctaaactatacatttggagagcaaaataaaaactatacacttgcttagactttgatatctaatagtttttgttagggtgatatctaacattgttgaactatagtaagtaaaggtataattaactgtactttgatatatagttttttttttttttatatatataaaaaaactgtactttgatatctaaactatacatttggagtacattttcggaagatctgttttctgtttaatgggtccttgagccaatttcagtttgttacttgaaatctgagcctaaattgggagcataaaagtgctacttgagcatcatctcatgaaaaaaatccatttttgaataatcaatatcttaaatataaaaattcttagttaaggtaatgatatccaacactttttagcactcaagtttttttaacagataaacgaatgaaaagtttttccatccttcccccccaagaaaaaaaatcaaataaacgctttaggctaaaatgtgaacaaaaaaaatatttaactgaaaaatatcataactatggtttaaaccgttactaacaaggctataattaggttttctttttttacagaaggctacaattagttaattaagcagagttaacgaaatttgatggttttgttttaaaccaagctttaggaaaaatttagtgatgtaaaaaaatgagaaattataagagggtaaaatgtaattaatcctaaaaaataatttaacttaacaaacagtagatttttattttatgtaataacgggggcaaagagccacaaagttatcttagatattcaaccacacaagcaacgatgtgtttgatacacaattccaatgaaaactcacgatgtgtgaaataacattaacgtgattctaccaaaagatttctccattttattttatttctattttcaggtaattaaaaaaacatttttaagaaagaaatgctggccaacaggtagcatttgagcacaagtaattgcaaatgttcattattttcctggaaatgtttttcaacattatttgtttacctaagtcaaatgagaatttgtataaatcaaatttctaaagcagcctgggtcttgtccaaattttcaaatgactggtaaaaatctatgatatcagtcatttttatcaagcaatgcttgcacaagatcatcaaatattacaacatatgtaactaacagatcaccaagaaaagcacaagcttcacaagtcatgaaagaaatagtagcatttactagtctaggacttgtaagtcaacatataatcagaatgaaccaattgctttgggtatggctagcaaggaaacaacaaagtaggctctggcaatcacacaaaacaggttttatgcccttttcacggcttgtccgcctcatatacattcatacatacgtgcatgatatttgtccagctcttatattggaaaaatatcgatttcaattcaacaattgcaggctgcaatatcatatatattcatatacacaaacaatatcttcctgtgacagcaactgtggtaaggcgtcatggcatgaactgtaccttttatatgtgaggacgttatttcttatctgttgtaacgccaacaacaacattgctcacctgtaacatgtcaaatttattttaaggaaaacttgctatgctcaggggaatcatatatgaagaaagaaaatacaagtccaaaataaaaatgaaaagcaataacaattaccaatttcccacttgaatcaacagacattggattttctaccactactgtttgactttgagattggggcattgactgcaggtagtgaaatagaataatataatcagaacagaaaaccgctaatacatccttactatgaataatcacaaaaaataaaaattaaaataaaagcatactgttgaagtagtaggtagtgttccagcattggttgtcccattgggtctatggacagggatcggaagccttccattgtttgtctacaagacaggaaaggggagcaaaagcaagtaaacagtataaaaatcaactcagaaaaattaaacataccaaatagatacattcatattcacaaaaaatagaagttgagaatgacaatctcataatttcttttatcagcaaatgttagttgttagtatttgttagaattttagtggagggatacaagcatacaacctctcccccctccccctcttctcccttcaaccttaaacccccttcccaaccaccaagtcaaccttataactcctgacaatctcataattatatattcagtatatcataacctttacagatgcatctaatgttaaaggacatcctagtaagttagtcaagaggtagggcatataagtgggttttgacaaattataggctccaatcttttaggctggatcccaatctctattagccagcatgagattactcaagtggtcatgcttgtaaagaataaacaggacacagaaggtaataagactaataccagaatagctaataaaaatataaattatctatatataaaagcctttcctattagaaaacacaggttatataattacctacacacaacatacactgacccataacaaatttttagcctaaatattcaatgctcagataacatagttctatcaataaaaacttacactgacattagtaataaagtgacaaagagcacatttgactgagggagctccataaggatacatgagtgttgtccggcagttcccacaatggacatgagctacttgattagatgctttataatgcagatacaaagcccagcaacggatagtcaggaaacaattaattgaataataagcataggttattaaatataacaaggatttcatcattagatgggcatgagtataagaaaacagaaccaattaaagcaacactgcataaggatcccaacatcttgtagttaatatgcaattcaaaattaacattggaattggaatattccaaaaaatgacaatgaaaaatgattatgaaagtatattcttttatcaaagaaataaaactcaatgacagattaacaagtagctggctataaattataacaactgtttgccatttatactaactcttatgtttttatatctttgtgattaagattgttcttctccagagtccagactgtaagcaaaagcaatagggcaaggacaaatgttaagaatcaacattttcattgattgatcatgaaggaagaattgatgaatgtggctgctgctgctgcttttttttgggagggggggattctgacacaaacctatattctatgtgatttgctggaaaatgaattcacaaaaagataaggttccaaaatttacaaatcatacagtaccacagaatcacagatagataagttccaagggaaaccaccataaccattttgccactagagtaatgttcttagaaactaaaccaccaagactaagacctcattcttttctagccttacaacaaactggcaaataaccagatgaccatattacaatctccaaccgcatgtgaaaggaatctcacataattttttcaacttatcttccaccctataggaatttgaacaaagagggataatagatgaggaagactgaatcgaggttatgtggtcatgagtcatgacctccctcaaaaagggaaaccttctttctaatgaaaggtcaagttggtagcaatctttttaagtagcaagccagatgcatcccaaagaatacacaggaaataaatgaataaataaataaaaggatcaccttaatgcaccccttgctgaccccttcaccaggatttggtaacaccattcacattaaccatatattcaataaccaagtaatccaacaaaacatcaccacaattataaaatagaagatttatattaacaagcaaattaacatacagtccaccaaaatcaatgctaaaccactaaggtaacatactaacatgtagtggtttttttaacaagaacatactaacattcagtacctggtggaacaaggtttacagtgtgacagcacgaacatctcacacttgtagctccacgtgtgtacattagcaatgtcctacaacctccacaataaagttgagacatttccatccctgcaggttattattatggtagagttcctcagaataagcatcaaaatggagtctgactacatgtaaatattaaatccagaaggcaacatgatttgtttcaaattgaataaatggcacataccaaatagataaagacgggagacacaccaatataaaatgagtgagtttacctaatcttaaaatttgcaaaaacagaaacaaccaatgagcttaccaggtggaggaacagaggtaattgtgttgcacaatgcacaacaaacattggttgcccctcttgggtaaagcagaaggctcctacaaccattgcacacaacttggctctgcatagctgcaaagttaaagaccattcaccaggaaactcaaccaaaatgaaacgctaagactcacacgcaaatgaatcaataaccaattgaaccaaaattcccactaatttgttttacagaggaaaccagacaccagaatgcctgatccaagtcaaaaacacgtagcacctgctccgcagacaaatatgaccaaccccaacattcgagagtcaatatgttcaatataatatgctccaaaaccaaaaccagacacatatgttccataaccaaacaaaacacacccaaaacagaaaatcaaaacaaataagataatggaaataacaaaggatctggcaatacctgtggctcccgaccctgctgcaacaaccgagtcaaataacaacaagaagaagaaaaataaaaacaaacaaaaaaaatcttagttgtttttgtttcggcgaaaacgaggatgtcaaagggggaaaacagaaaagattgagagaggaatgaagaaatctgtaatgaggattgagattagattctctttagagaaatgaagaagaaaacaaattcaaccctctctctctctctcttcaattacttctaccaatgtttcctcatcatcttctcatcgcacacacactttcggaaatttcttcagcgactattagtctacgtttcttttttctttttttttaatcaaaataaaagtataaaacattggtcccttttacttattcttttatcatggtaaaataaatatcagataaaaattaagagcatcttcacttccttaaataaattatttatcttaaattttatgatgtcattaaatttataaattttatacaatttttttttttagcgaggaggagcaaagcccaaaaaagaaactccaaatataaaggacagatcatagaaatcctagataattacacaaaaaattacttgaatattaaagttgataaagtaattatttaacttaaatcatgttaaattttataattgaaaaatgttcttttaattgttaaaaatgaattaaataataattatttatataagtaacgtattgtcaaatcatatacttagtaaaaatttgttaagcatagttgtttaattttaagaaaacatcaattttaaaaatatccttaaataatacaatattaagtttaaggatatttaattttaaacaactcatgaataaagtgtgttagacatgctttgatactgtaaaagtgaattcactattatgaatttttaaattatttaaaatagattaatttcatcaataacttattattttcaatgtaataattttttttttacaaattgtaataattataattatacttacaaaagttatgtgaagtataagataaaaataatattatgttacaatttaaattaataaagttatgttatggataaatttacgaaactgttttttatatttcaatttcaacatgctttatctgtgaatgatatatacgatacatacggaaatgacaatagcatattgtcaaaacaaataaaaggacataatccatacataaatcaaataagggaaaagaaaaagaaaaggaaaggaatagtagcaaatgttaaaagaataattagttacaaatgtttagtaaaagtgtaaaacttcaaataaaaataagacaggtgtttagtaaaaaggttttactaaaataaatattaccgattttaatttttatcatgatttgaaagcacttttccataattttaaatattaattatttattattttttcaatatgtatcttaataatattcatgaaatatagaaaattaaggtgtattttttatgagaaactcttagatagatatataagtctaacacatgattcttaaacacaactaataagaattttataactaatagaataaataaataaatcagaatgccaagtaaaattaaatctgatattttttctgttttttataatcgtcttcctatttttttctaaattgtattgaaattaaaatatatacaagattataataagaattcagaaaatataatttaaatgtcaaaataatatgatttggtggtgtaaaattgtagagaatttaattttaaataataaatttattaaataaataaaaaaaacacgttggctttaagcaatagtgaaactttgttgatgttgggtttataattttaatttttagaatacaattttaattaggatttataaatatttctgtaatattaatattcagtatattaaaaaagaaagatatattcagtttggtacaacatatcatatcaaaagttaaaaattaaaatcaaactataattataatagttaataatttttaaaataaaatttataaataaaaagttgaaattaagaaataaaatcctcaatatgaagtcgcatatttttcaaggcacgactttttgtttataatttttctttttaaaaaattattaattaattataattataaataaaatgaagcttcactccactttcttgaaactgctgcatctcatgcacttcataaaattaaatttctttaaaaagtttgaattacctttaacatgaatattatatattaaaaaataattttagagaaattttttatttcaatttttgtcattataattcatttattcaagttatctatttgcttttacaatttgaattataatttgaaatgtgtattcttttataatataatttgtgtaggtgattagactttttcttatcataaaaaataaatattactaatttactttataaaatattttgacatatttttatattcaaaattttattataaagaacaaaaattttgtaggttttattttcttatttaagaagtttcactcataatctgtatcagactgtatgtttgatttggaaaaaaaaaaaaaagaaagaagattaggaaaaaaaactgaaataatatcaaatttatttttatttgacattctgaattttttttattaattttaaattttttattaatttagtataaaatgatatgttaagtttgtgtctatctaacatgctctcatttttttattttaaataattaccttaaagatgtaaattgaaaatcataaaatatattttacttgttcctaacgcttacgcaaaatgtcccatgacagcaatccaaagtcaccattatttttagccttatcacaactcacaaaaatcttgtttattatagaatactattcaaaaatttattttcccaaactgttcaaaattagcagactggtctaaaaaaatcaaataaatctttaaaatcgtttgttgaaaaaaaatgaacaacattcagttcaattttttttaatgttcaaaatagaaataaattaaacaaaaccataaatatagtaaacttgcattagtttcttaaaataaacttgaaattgttttaacttgtaatttgtaatttatatcaagttatggtttgtgatgaaacttagtatctgaacaagatttttatatttactatatattttattttttatttaataagtatttttccttaaatgaaaaattaaataatagaggaatttatatgccggttcaaaattctaatcttatgaactttcatttgtttattgattaaaaataacgagttgtccattaaaaaatatataatttatttaataaaaattataaatgattatatttgattaattaaatttgacttttctttgcgtataggtttttctaaaatgatcaaatggaataaattaacttcaaaatcaatctaagccaagccgtaaaccgcgttgaatttgttgatatactgatgacggagataataaattattaataataaaatttgttcaaaataaagggtgtgtttttttatacgacgagtaatctattggagatgtagtatttgtttaaaattatctttcgttgtcaatagggttgtgtttaaaaataatgttctgaaaatgtgtgtaaaaatttgaaaagttatatttacagtatttttttttttatcgtgcttatggtgggtggttcgtatgtaaagtataaacagccataataagagagaaataatgggtaaaattattatttaaggaactgttttattcacggtatttttttattcatttatggaacttattacatatttaattaatatattgatctagtaataaaataaatataattaattttatttgtattaagcattctgcttcttggtgtaaatttaataagttttagggaaatatctctaaatttagcgtagataaaaaaacatttaaatataaaaataatacttacattgttgagagaatgagagagagagagagagagattgcaaatttgcaagtgcatcaaattgagataaagttcaaatcacaaaataaaacacaccgtgatttcaaaaacaaaaacaaaaataaaaaatactactacaacacaccattaaaattgtttatcttagcctcaaataaattgacttgctctgttgctcatttagagaagccggtataataattaataacattcactccacgcacatcttcatttattcaatgtcaaagttaatataaagtttgaacctgtaacaatatgtcaatttattcatgttacatgctcatcgattattaaacttttaacattattgctataattgttgttgttatgaaacataactttattttttatttttaataatatagaattaaaattttggagttgcagctactcacatatttctcaccaattagcaacaactgaatttagttggtccgacaaccttaagaattcagagacagaacccacacttggcttcttagacttaacaaatgatatggttgatcaattttgctttatcttatattaacccatccttctccttaggccatctgcattatctccgaccattttctcactacggtaatcaactggcaaatacttgcacaatggcctcagaaaatggagacaaactagagcttgctttcagtgctgttcctgatcccaagcccatgaaggattgggtcattttgtcccttagggtggtcgcattttttgccacagcatctgctacacttgttatggcattcaacaaacaaaccaaaggcatggtagttgctaccattggcaccaacccagtaacaattactcttactgcaatgtttcagcacactccagcttttatgttagttctacaaatcatatggtttaattttcctttgttttcgtttacactttttttaacattgcaatattatagtactatattagctagacatgttgaccttcttatgtgttatttatggtgaggcagattcttcgtgatagtcaatgcaattgctagtttctataacttgctggtgataggagtggagatattaggaccccaatatgattacgaaggacttcgtcttggactgattgcaatattagacgtggtactgaatggatcctactttttttttagtcaccttcacttttacacatttttttatattcaagttaagaatttaattagaatttacaataatatatataaaatataaaaatctttacatagttctctaatcatatataaagtcatcccaagggattccttgagtagagtaagacaggccttatatttgaattctcatttgtcttgttagaatgagataaagataagtttttgtaaatattttttgagtccagaggttttctgtgaaacaccatctccttcttgcttccgctaaaatttctcaaccaaaaaaaataatcacatataaagtcaatttcggacctaatctagagaggtaatggcccgtggcccaagacaggaaacagattaattttcctgaaaaaaaaaaagttcatcagttgaaattgaataataggcttttttatattattttcataaatagattaaaatttaccactttcattctttttaaagtcaaattaaaatgtggcatgtttatttggaagtatcacccacttaattattttttatgaaatgaatttataaatcatttttagtaaaattatatgtttatattttcttatgaatacacgtatgtaagggggttttatttattgttttacttcagatccataaaatgtcaaaatcaactcttataatagattgtcatataaataaaattgttgattttcataataattattttaaaaatcatatttaaagtgatttctaattatttgataatttacaaattgttatactaacattttatcaaaattaaattattaaattaacaaatatatatgaaaactatttgactatatatccttttgggtgaagatgacgatggctctagcagcaactggagatggtgcagcaacattcatggcagaattaggaaggaatggtaattcacatgcaaggtgggataagatatgtgacaaattcgaagcatactgcaaccgaggtggtgttgccctcgttgcctctttcgttggtctcattctccttctcgttgttacagtgatgtccatcaccaagctgctcaagctaaatcacatttagcaccttcatgcttacaattaatgcatgatacatattgatatcctgctttctatattcacctgtttaagtgcaatccagtgtgtgatatatgtgtatttagttgtgtcataggaccacaaataaatacgttgattacatggacttttataaaaatttcttagtttttgtgtaaaatatgttggtggcatgaatctcctctttgtcttttttgccaactgtcttgctccccactctcaactgcattggctgttctgaaattaagttaatgtgttttgtttgtccattataattcccaacagtaatatataaattagccaaagtatctctacaagtgtgggattatatcttaataaattagccaaatactaaaaagaaaggaaattaactgacatggaaattatgagatgcatgtctcgattgagagaaacaaaattaataaatgtgattcttagtgatctaggacttataataaccaaaattatgataataactagtaaaagaataacaaaataatactaatattactattattaataataacaataacaattctaatacttagtctatcataaaaaaacaattctaatacttagtaataacaaagattattatagttattttaagatagagtaagaagattacagtgtaataagatgggattctccataaatttcaaaggagaatatgattagaataatttaattatgagaaagcatttccataaaagttaataaagagatgagaataaaattataaatctcaaattataaaaggagagagtgaaagtaagatttgaagcaatgagatgtggtaaattacctatatcttgctgtaattaatttttttattgtttatttttttaattattgccctcaattctcgatcgattagtaacaaattaatgtatttaatggatataacatagttcacaacgtgttaagttttaagtttgtaaagaaagatctaaattcaatttttatataatacatcatttatgatagacgatgaattttaaatataactaaatctagaaccgaagattaattttataatcaacttaaagggtcgaagtttgtgaagatatctagcttggaatcctacaaggaagacgaagattatattttaattttatttgtttattgacaaatattaattattaatactgataatttttattggcaaaagattcgaacttgcaacttatatcccttcatttttcccttcattactatatcaaccttatatctcacttaaagacctaatcacagtggtaaaaaaaaactaattaatataacttgatgaatttgttcatactcatactcatgtgcatgacaattaatctttctgttaaaagttttattttaaaaacaatctttatgttaaaattaagacagttgaatgattacatctactaaataagaattattgataattattgtaataagtattttttattgatgtgctagtttattagcttttgtcagtgaaaaagatttaaatttaagatgttttttttttcttcttcattcttcagctattaaatcaatcttataacttaataattattgtaatattagaaattgagattaagaaaaaacaaaatttctttgtaattttttttaatggatatcaactctaacaaaagtgcctataattatatcattattgctggacttagggtccaaagtagctacaccctttgatgaggcgccaatcttgtagttgagggcagggagatcttgagagcgtttatacacatctcacatgtggatgagtcgttgtcgactctaggttatgattaaggcagtaacatttttgatgaatcactacaatttatccattatcggtgtagtgtactatcacatacccaacacctactacaaaacacactagggtttctaatattcacgtgctcggttaaatcagttaaactaaattttttggtaaaaactttgtcgcttcaatttaattataaataaataaaaattgaacatttaatattaataatatatactagcattatattacgacaaacaattacccttagtcacagtgtcacgcaccctgctacctgtcttatttttcttctttccaccatatcacttctattgatacctcaattatatttttcttttttcaattttcacacgcattaattatttatatatttatataatatttttacttttttatttactttcttttaaatctttccatcatattacatcacataatttattataattttcggtgtatatagaaataagttattaaaataaaacatataaaaatacagattaaattaggaaaatcttagaatccttacaaatgtgtatatatatgtgtgtgattaattttaaattaaatcccaatttaaataaaatcattaatgatcatttattaaattttttatttatatttttctttctcctttttcttatactaaagcacaaaaatattctcattatttactttttcacaaattacattggtgtgggactttcatagggtcacgtggcaatgcatctgtgagttgatactttgccacttcattttttatgtaatttttttgagataaattacattttcctttaattaatgactatattttcagttatgtcaattttttcattaattttttttataatttgtcaaaaatacccataaattgataattggacaaacctacccttctttgggtttataaaagttctggggggtcaagaaaagaagaaaaacaagtactgctctcaaatttaaaaaaattcatcagaggttattttcttctcactttagcttaaaaaaaattaaactcttaaaacatttcacgtcgcacatatttgattgtgttaagcaaaatctgtcacaatattgctgtgattacgatcatctttttgtgatttttttttttcattttatgactacatttaaaatttattaaagttgattttctgccatgaagtaaatcttcgtatccaaaaaagatttataagtgaagataacattactgttaaaagagatctgcaaggtcaaggtatgataccttcgtactaatttaagaattgaattcatctttcttttttcttaaaaatatttatcttacgccattttattgttgatcttgaattgcttcaaagtaaaaaggtgaaaaacttcttgaaacttgatattatgttgttgattctttatttcttttggatataactgtcaaatgatagacatgcttgtgaggtttgggaggacattcccaaatctcttatagggtaataaacatgtataattatttatgtaaaatttctctttacctcttttcagttatattgcatgtactttaaatttatttttgtgtgaaaaattgaaatttttattatataattgattgttcgttcataaatatattattaaaggatgaatataatgggataaagataaaacgtcaatttataagtcaagaaaagacattaaaaatgtcatattttattcttattgttgtcgtatgtctagacataagattttcaaattaaaaaataggcacatgaaatttcatcaattaattttatttatttatttatttacaataccattgtttatatatttatttgtgcaatgaaaagggaaatttggcatcaaatatcaatgaattttaaactagatcgaacttatgagaatgatagatatgaaaaagcatagtctttccaattgattgtagattgaagcaagagcaattgaggtaattcaaatgtagaattcaacactttcgatgccaattaatgtgaattcaaaattgaccttatttattaatagtttttagattctacgacacaccactacttcatgtggtctgtggtgcaccattgttaatagtctttagattaatacctttggtgctcgttggtctccatttggttccttctttgaccatttcctatgggggatatagttggtttcctcgacgaggttctaggagttaaggttgatgttgatggtgctgcgaagcatgagattaatggagggtccgccaaaggtgacaaagagggaaggagagggagaagaagcagaaaatagaagaaaaaaaaagtggcaattctgtcccgaaattgcctttgaaggtgacgcacaacgaagagtagtggtaccaagaagaaggattaaggatcagatgtggaaaatccatgataaaaagttgcactataaattaatctaaaagctattaacaatgatggtgcatcatagaccatataaaacaaaaatgtattatattatctgttaaaaaaaagtccaatacaatattttgagaggaaagggaaatacaagcatgaggaagggacattaacccatttaatagagggtgagagaaaatgtatatatattttttttttggaaaaataaaaggaagttttgaaaaagttaaaagaaaagaattttggaaaagcgagaatgctaaataaaaaatgaaaaaggtaaaaacaattatactttgtaattaaaaaagtaaataaaattggagttataagattgactttaattaagagagaaggaacataaaaaaagattgtgagttctattccttcttattaacaaaaaaaatcaacatattagataatgacatcgactttaaaaaaaggataagtaacattgtcaaagaaaattgtacgttaaaagactttctattttctttatctttttatgtcatagattaaaaatatattaatctgtaagggacatattaaattcattttagataatcgtttttttttattgaatttagataatcgttttgaatatatttttacgtgttgattgtactttcttaaaaaaaaaaaaatacttttcatatattttatttttaacatatttggatgtgatggttatacaaacatggttatatctgccgaagcaaatgacaaatgttgcaaacgccagtttgttgtggaatgtggaggagtaggaaagccaacgtgtaaaccaaacgagacttaagaaagcaagccaagaaaatgtgccattcattttgtggttcgttgggttgtttcatcactttcagttaatattgcgcgcactacacaccttcaccttttaaattgacattcacttagattatttgatacaatttagactacgatgaattttatcataaataaatctactaacaaccttttaaatatttgaggaattttatcaacaataaatccactaacaaatttttaaatattttttattagatgatatgctgagttgacccattcttagaaattagatataaattattcatagaaattattaaatacatcttttaacaataaatatattataagatcttttaatgtcattggatctgtttcttaattcaatttgaaaatttattccttttttctgttccaattcgaagagttattaataccaattctatcacatttattattatgctattaataatttttatatactctcataataataagtcaggtaaaaaaataataaaaatgaagttatgaaaacgtgtaatgatatttttgtgagttattatgattaattttaatttatatattattattgatgatggtcgatactaaaggtaacataaaaaaaaatgttattaagacttaaataagtgataagacaacgcaataaactcattgctggtatgaaatcgtttatcttcattttacaaaacattatcttagaagtagataatagttaagttattaaaatttataaaacgacaacaaattttattggagcaaaagtgttcaagtacaattgcacgtctttcagtgtagaatcttagccgcttcccgctgccacagcagttcactttcttttctgtccccttattttttcaaagatattaaaagatttgtttttctttttcagaataacttttataattagttttaatattaatattattgtcgcttattcggtacaaaaaatttattatcattattaatggaattaaaatctttttgtagtgtagcgtaactgtacaagtagtgttgttggggtttcacctgggacttcgtatccattccattattttcaatcactatttatttaattttgtttcccattacacctgtcaaaatatatttacatggtttttatgtcccactctattcttttgtttctatttttatcgttattaaaaggtcctctgctgctatttgattttgggcattagaatttagaatccaagatttgtagatttttgattcttttgcaatttcacaacaaattttggggtttgctacattcatgcattggtacatacttagatacaataaataaaataaaatatatatacatgcaattcaatttgcatttgggttttcgtttgatttgtgaaggaattttcgtggttaattcttttgtacgcaactgctgtgtttttccttcagaacgtggaaacaacttttcgggaagaattttgctgcattgagtacgtttgtgttctgcatttgttttgttgtagttttttttagcagttttaaggtttgtttggggtcagttagttgggtaatagatagataagtgggaaactgttttgtggaatgtctctttggctaattgggactctgataaggttagttacaatggtctctgttcttgttgcaggctcaataacttattcaattgggtttatctttcattttgcattgaatgaaacagttgaaattggctgcagaatctcacgccgaagaggttggttctttcttttttctcattttgtgatttaaattttaaaccttgacaatgtggtacgtgttctagagcgcttttcatccatgtgctgctactctgttcaaattttccatcctctgttattatggatcatcacaaatttcagatcttttctttgtttatggaatttgaaaactgttgttatttttgtgtatctcttccttccttcattgctttctttctttttagtcttttctcattatgtttaagacattgtgattgtgttttcgcttgtgtaatatttgatattactagtttagttcctgtgctaatttctgctcctcagaaggatgatgttaatttactcaggaattgtaaacccttaattttttttactgtaggctggtctttacatgttatgtgacttttcgttttttggggtttggaaagattggaaatttctcaccctggtggtggtggctggtttgtttagctttccggaatgttttattatgtctggcattggatcgcctaatcttttgatggttcctgttttgtattgaattgcatttacattatttggtttcaagagcattgcatgcatttgaactttgaaaatactaatctaatgctctctgagtctatcttattaaagcttaaaatatgaggatgtttttttgagctataaaaatgtgattcacttaaatttagttaatctttttgtaaccgtttgaagtgtatttattcaactatgatgtaagcaacctgaatgatgccaaagtacgaaaaccgttttggttttacatttgataccgatttctttttttttttttaatacaagattgcatcctgttgtctttgaattctgagagctatctccaaccttgcatcaatgatgagtcaatactgctagttgaggcttcaatcaaacttaaatctgtctcatggcatacactgcttataccttaccagcataagcaaatgaagggcatcaatgttgtataacttgttttagaagattagatggcagtaactgcatgattgagtcgctgttctgcctttacctgaaactccataaattttacatgatttctagctggtgtagcaacataaatgcttgaaattaatctgttacagtgtttgaataaatcctttggaaaggacattttgtgttagacgttgctagactttgatgtttctcccaatcattttttatcagagtcaacaaatttagcattcatacatgtgatattttgcaggataatcctcttaggcataaaccagaaatggaaaacacacttgagtcttctggcagtccacgacatagaaaggtatttagcatgatctactgtgctgtgaatttgtcttccaatagagtttggatattttttatggtgaataaatatcagtttggatattcaatagaaaaaaatgatttaaaaattactatgcatatatgttgttgtcatggtgacttgttgatgtcttggtgacttgttaatcatgggttcgaatccggaaacagcctctttgcatatgcaaggataaggctgcgtacaatatccctctcccttatctgcgtatagcgtggagcctccgggcaatgggatacgtagtttttatttttttatatgttgttgtcatgttgcagatatcagccagatgggatccggttgaagcatgccggcctatagttgatgaagcacctctgttttatccaactattgaggtacttataattatcactatcatagtattatagtttttggtggtggttatattgtattttgaattaaatttttgtttatactcttatcaggagtttgaagacacacttggttacatagctaagattcgcccccaagctgaaccttatggcatatgtaggattgtccctccagcttgctgggtaccaccttgccctcttcaggagaaagatttatgggaaaatgcaaaatttcccactcgtattcagcaaattgacttgcttcagaacagggaacccatgagaaagaaaattaggggaaggaaacgaaaacgtagaaagcagtcaaagatgggcatggatacgagaactgccaaatcaggttctgaagctaatgttgcttctgagcctgaggagaagtttggattccaatcagggtcggacttcacacttaaagactttcagcaatatgccaatgtttttaaagattgctactttggattgaatgatgccaatgaatatggaaaagttagtgatagtagtcaccagcagagatggaaaccctctgtggaggaaattgaaggtgaatactggcgaataatagagcaaccaactgatgaggttgaggtactaattgcggttcattgataatatcattagtcttactgtcacataattaagcaaaaaaattatatattattctgttatttttgaaggtgtattatggagctgacttggaaactggatcacttggaagtggttttcctaagacatcatccttaactaagaatgagtcagatagatatgccctgtctggctggaatctgaataacttcccgcgactgccaggttctgccttatgttttgaaggaagtgatatctcaggagttgtagttccatggctgtatgttggaatgtgcttttcctcattttgctgggtaagtagtgagaattacattttctttcagtctaaatctatgcaagaaacaaagtttaaggcataactgatgatattactgattttctttttaatcactttctgtatctgtctgtggagttatagagtttaagttatttttcatgaaagctgagttgaaatttttaaaatctgtctgttttataaaaaaaatataatttcattaaaggttcagcggagaaaataaaggactagaactagtgtaagacatagactagaatccagatagggatccctacaaactgcataattattgaatcatgtatagtataatagaattctcggtatgcttacactcaacatttttggttccactgctttatgttgatttgtttgaaatattgagctataaaacaagtaatattgtcttcaattttgcattgcttttgtttcagatcttcatactttccaataaaaactaacacctttttcttgtttctttctccttggaacagcatgttgaggaccatcacctctattcacttaattatctgcactggggtgacccaaaagtatggtatggagtacctggaagccatgctccaggtctggaagatgcaatgagaaagcacttgcctgatttatttgaagaacaaccaaatctactcaatgaattggtatactactcagaattgtactttcctcctaaatttcagttttttggttgccttcattctgtttcaatatagaaatttcataaacaaacagagattgtagttgatgctaaatgtgtattttgttggaagtttgctaggaaattttaatgccacctgtgaaagttaagaaactaaaactatgatgacattttgaaatctttagacttcagagtgtcacttcatgtgtgtttagttaaaggcgtgatgcatttgattagtttagtgtatgatacttttatttataaaattatatatatatatatatatatatatatatatatatagcggaagctagagttattaggtaatcaatttatgagtaaggtagagacccccccctcccccccccctctggtttattctccctgtgctggaaatgaaaaactattcttgaccctccacttgagaaaagtttttaggatatccatgacatagtatttgagccactatgaacaagtggtcaagattatgatcctaactattttcactaggtatgatggacttatgcactatccacacttcaagccttagcttcccttgtgtgagccatcttgtagatataaaattgttattatgtttccacttaataacttaagcttctagaagagttaatccttggccttcccaagaatcaaagttcactagttcagtatagaatctacctggtaagctcctattgagtttgggataaagtgttgattaggagtaagtatcatctaaacaacttaatggttcctgtagacaaatgtcctgcggtgatgtatactgtacgacacataagttcctgtagacaaatgtcctgtggtaagtgtattggtcatatcatttagaattagagtcaacacgggttcaaatcacgggtttgatatgtttccaatcatcttaatgtttgagggtgaaccttctcttcgagggacaaaatgatatgtccaaaaggttgtgagggtcaggtttgaccttgtggcttttgcctaataatggcttaaagccttaaatagggaatggtttgcgtttaatgtaggatgctatatgtcaaaagtttcacctttgctaatagatcaagcttttggcatgatggtaaacgctcttggtcatatcacctgcatttgtcaagttacccttagttctttacaagtccattaaagattttaaaattatggtatagttatctgttttatgacctttctctcgttatgtagtatgctgaactttgacaattctgtttctaccaaagcgaccctatcttatctctccagaactctctagcacatctgttcatctctcatacaagtcttggatattttagttctctttgtgtagtagatagagtttgggaactgtattatgattctagtggttatgatttcatctttgagcaggtgactcagttatctccatcaattcttaaatctgagggggttcctgtacatcacactgttcagcattcaggggaatttgttgttacctttccaagggcataccactgtggcttcaattgtggcttcaactgtgcagaggctgtgaatgtggctcctgttgattggcttgtgcatggccagaatgctgccgagctttacagtttgcagtgccgtaagacttcattgtctcatgacaagttattatttggatgtgctcaggaagccgtgcatgcccttgaagagctaactcttcatggaaaagaaaatctaaaatatataaaatggagaagtgcttgtgggaaagatggagttcttaccaaggcagttaaggtaatgattcttgcatactctttatctttgatcataacccactccacatatttataaagctttataacactttggttggcatttattatttaattttagttcccatggagatacctgttcttcatttcattattttttttttccacattttgttacccttatttttgacagacaaggataactatggaaaaggaaaggcttgactgtcttccaactcatttaaagatgctgaagatggacagtaaatttgatttgtttgaggaaagagaatgcttctcttgcttctatgacttgcacctatctgctgtaggttgcaagtgctctcctgactgttattcttgtctcaaacactcaaatttgttttgctcatgtgaaatggacaacagatttattctgtttcgttatactatgaatgaactaagtacattggttgaagcattagagggagaatcgcatgctattgaagtgtggtcaaatagaaactctggaatggtttctgctaatgctgaggatgcttgcatttacaaacaagatgtggagagcaccatttgccaaacccagagttacaaagaagggaaaaactcaacttgtacaggaactaatgataagtcaaattcaactatacctagtagttcttacagccacatttcagcagaattagtccactcatttcaccatgaaacttttagtgcaccatatggcactaaagactgtcataaagacaatttgaatgaaaaagatttggtcatggacgataaagttacggtggagaaaggaggttctgtggatttgaatattgatgttatgtctggtgaacctgaaaattattttctgcatgctgctgattaccatcataataagggtgttccatatgtggaaaaagtcagctttgcagaggccagaaatgaaccagacaacatggaacctggggctgattgtattgctggcaaagaattttcatcttgttcaagggatgttcaaaattcttgtacacttgatggttataaattgtttggggtggatctgcagatgcattctgattcaggagagcaactcaacagtgtatctaaaatgggtgacgttgaaacctccaatacaagtatattgttgacaaaccaaagcttcttaatgcagaagtttggtatttctgttgagcctgtaaatttgggctctgttatttgtggaaagctgtggtgcagtaagcatgcaatatatccaaaaggtaagctgcagtgtaggatcttttctgggcttgtaatatgcctttaattttttttgtgggagtttaacatttcatttgttttggtaaatttatgaaggattcaagagtcgtgttaagttctttagcattcttgatccaccaagaatttgtaactatgtttctgaagtctatgatgctggatttcttgggcctattttcaaggtattattcctgatgtttctgtttcatgttaaaatcatatcgactactttctgcttgtagatatatgaacctatttaataatataaataggagttaaggtgtacagggaaattcacttactcatttacaaaaatcaagggtatctctccgcaatcctttttttctctcttgaggggcagtaggcttgtaattttttgatcaagtctgctgttggctaaactgctaaaatatggtgcatttgtcttaaagacaatgctaaacattttcagagaagactttttttcttggatatttttttggagaaactcagctgctgctaattttccattgaatagaaaagtttatgctgagtttctgtatgaaaattcatggaatctgacaatcttctaacataatataatggaactaagtgataattgatttcttgttattctattttaaatggtatttgcatggacatttttcagttggaagtatatttctttctcattcagtaaaatatatttcaggttaccatggaagaacatccaaatgaggctttcacaaacacctcagcagataggtgctgggaatcagttcttgacagactaaatcatgaaatcaagaggcaaaggagtcaaggtgaaatagaacttcctcccttggaacttctgcaaagcattaacggtcacgaaatgtttggattcctttcaccatccgttattcaggtaatgcaaactcatgaatgtttaagctattcacacccttgttttgctaaaattaatatcactggtgtattcttttctaatatagatttatagtcataaagtttggaattcggatcttatctttagccagttttcttgaactagtttaatgtagcttatcatgttttgacttatgatgttttaatcaattctgaaaaaaatttccaggccattgaagctgaggatcccaatcatcaatgcatcgagtactggaatcacaaagaagttgtctctgaatcctcaggcagtgccattgatgactgtaagttcagtcatggttcaagcaactccctaggtgatgtcaagactaagctttttgatgcctgtttgataaagcaggagcaagatagcatcataggaagttgtgattcttttgaagagatgaaattggtgctacaaggattcttgaaaaaggcaagttctgatgaattaagtgccatgcataagttattcagctctgatgcacagttcactaagtggagagcggcatttgtatctctgatagaggaaatccagaaagcttgtgcataaagtgtaacatctcagctctatctgactttagataagtcgtatttcattttagttcttagtgaggtcctttctttcagtgaccaattgaactgaagatgatgctgggtgaaaggccagataaaattttgctacttgctcggtgtcaataacttagagatggataatgacatggaccaattgtaggtgctaatgccattgacccattccaactttccttttgagtttacatttacttctgatggcctggcctgcagctttgatagtattttagtacatgtttcatccttagtgatcttcatactctccaattatgtatataaatagaaaaacaaatgttactgctataaatgatgacaagagtaggaacaatacatggagagttaaatttggaataagttccttcttggtcagaatattgaatatctgatcttttttattgatagacattgaatatctgattttagtttgaagcaaacagcattcataaatctccacatgctgttttctgatttgtaggaaagttagctctgtgtggctcctgtataactaataatcctctaagcataaactaatttgggttcaacccctgactacatgtcaccaagtcccttataggactgcttgatttgggggattaaatactagtcaggttattaaccaaaaaaagaaagtttgaactctttcctaatcaataatcatgttccattacgtcaagttatcctaatttaatgagatcatactaaagtagcaattgcctatcaatatctcaatgacagtcataattaccataatttttcagtatattatgctgaagtagtaattattgatcaatctctcaatgatattgtcaaaagccatagtcatattaagagagagagttaaactcactatgattttaggaagcaacaaatagttgcatttgtactaaactcaccatgatttcttaccaccaaaccaaatacactgagtagtacgctcaagcctcaagagaagggctattgcatcctacagctatgattgcattccagaaaatccattttgcatttcagaatgagctttccggaatgcaatgggaggtacaggatgcaataatgggagtgcaggaaacaaatgcccaagagaaggggtggagatgggaaacaaggaaggaacgttaattggaccagatcgatggacaggggagtgaggaaattttgggccagagtcacgggttgggcggacagatcattagtaatctggatttgtggaaatgaagaaatagcttaaattttacattagaaataaaagagtattgaataaagtgaacactggaaaaaaaaaattaaaatagatccgacggatgattctgaggtgcctcaaatgagaggaaaattctagataatgtgatccttagcgataattggactaagatgaagaaagggatgtttggataaactttttcaaacttatttttataaaaagaaaataaaaaaaattgaatttattcataaactaaaattaacttatgcatgaatttaaaatcatctttttagataaattaatataagaaaacttctacgaattaatttattaaattattattttttattttcttctcataaaagtgtttatacaaaaatttatccaacacataacacataaataaacaaagaaaatacttatataaatactaacaccaaatattataacattacaataaaatgtatttctaattacttgagaagaaaaattaagtggaatagactgtaaaacgagataattcatatttgatttaaaactaattagtaataatgaagatttgttataaaatttaataaaaatgagaataaaactatcaactctaaatttaagagtgagtgaaaatttgtttaaaaaaagagagtgaaagtaaagaagaacgagagaattttatggcaatgatcgagataagtgtagaagcttgacagagtttctccccagtactttgatgtagaaactctcaaccacttaaatttcgtaaaatatatatcttagtagatatgatcagttttaagaaacttataatattgtatttaaatccctactttttatgatgtaagttagaaaaaaaattacatttatattttcaaagataggacggatgtcacataatctttatctgctattattaatattacacttgcgtctcgtttatttaggtctaggtttttatctttttatgcatagttaggactcggctaattcaccaattttgcttttttttttttttttaatgtcgtttgactattacaaatgtactcaggtacttgacattgtcaagggtttttgtttgagaaatagtaagtaagttgctataaattatttgatattattttttgttttttttaaattacttttgacatttttagattagattttataaatattttataatgaaaaaaaaggaaattaactacttacagattttgatttggaggtccaaaaagtttgaagaaaagaatagaatcctgaaatttcggaacttcatgggattgatacaaaattgcaattggaacagaatctcacacccaaaagcctttcttctggtattggggacacatgcacaaagtcatcatttgaaatagaaaagaaagccataccataccataccaaactgcttgtagtagtagctagaatcgggatctttcgccattcgaagaagcacttcaacagatattttaaaagattgttcctaaagtgcggagaaagatggaatgataccatggcctatcactttgaccaatgttaccgaaaaagccagtgagtttatttttaagtaaataaataaaactatatatatatatattaaaattaataacttatgagcatgatatattagactaagagaagacacatccatttgctagactagaaaaaattatcatcttttgtgaaaatttatagtaaaatttacctattgcttatcaacagaaacatttttaatactcgaactcatcaagttacaactaacatgagtacaagacttgatgagatttaatgtagattagttcttagtttctaactgggatactctagttaaaaaaagaaaatgatcaatgtaatgggaggagataagaaagtaatcttataaaaaaaatatgtaaataatataattgtcttaaaataatcttttattttatcagtcttatcaacaacttttttagtaaaccatattttattagtttacttcgcagtggtcattgcacctcaactatattttattcacaaccaaaaagtttcatataaaacaaaactttatcaaaatatggcagtcttgcttcttggtctcaaatagccaccaaagagtaaaaaattgaggcatgcgtggatctcataatgataactaatcagcaaagcaatttttttttttttttttccaaaacatgcatttttaacttagaatgctatgagataacactttttgcaccgggtggaggtgcactatcactatgacatgtgcgcaaaggcacttgcacttgaaatgccaccgaaccattatgtatccactttctttggggcacagccaaaaagcagtgccttaaatatttgtaatgttaggttgaaggctacacgtacatgccccactgaaaccttccctttataaatgttatctagatttaggtttagtataggaacattcaatattccataagtcagtatgcaatggatatctcagtataatctacgtacactaaattttatgagaaaaagttatataatgtaaatttttttaaaacatttatttaattacaactcatttcattatgtatgtataataaattcattaatttttaaagtaattattttaaaataatttaaacaatttatgatttaatgataatataaaattatttatatattttcagtacataaatattaaactaaattttatttacatttcttttgtgtcttctgaatacatttttttattgaatgaaattaaatatgtgaaatccattttttatttaatagatttcatttgaaaattagttaaactcataaatttcaacaattaaagagaggatgtatgttaaggcttattgttgaataaataattcatgtatgtattactatgctactatactatactactactccacactgtcacagcacccgagatagtttaagattctccatacatacttgacctgttaattccgaaccaacctgctttaatatcattgttgagttggctccactttccacttccacttcaggcttcagaacaagctgcaaaaccagacacagtttttcagtatttactcaactttcataaatactattaaaggtcaacaagtcttacagttgaagatggactttactacgtgctgctgaactgaacaatagttgtcatcactcttgttcatgcttggtggggctttggctttgcattccaaaacccaaacggaaaacatgcattggtcacagcatacacatttagtggtactgtttttcttgggaatggttctgataccttccgtgtgtcaaagtgatgcaactacagctgtgtacattgttactctgagacaagctcctgcttctcactatcatcatcatgagttgatcacagtgggcaagaactctagacatggttcatctgggagaagaactagagttcacaaaccaaggtacccccccatatttgttttcaatgttaacaaactgtgttcaaagtgtattaattgttacattccttttatagctgagggtgaggcttcttgttgaagttatgtatttgtgttatgatgataagatgaacatttgtttaaatgattgtcatagtatctacacaactcgtgtacaagttgtttgaaaaccttatcattatagtatttgtttgatactctaaattcctgtactttgtaccatatttttagtctccaattttttgacttttgtgcttaattgtgcattcatttgagagatatgaatggtcttttttttttttttcagacatcagaatgttacaaagccagttatgaaacgtggttcgtactttgcccgagttcacgactcgttattgaatagagtgtttaatggggagaaatatctgaagctctatagctatcattacttgattaatggattcgctgtgctggttacccaacgacaggtatggaatggttttacttttcaacatcttgattgtgtccttattctgtgaagaaatatgtgcttcgttgtttgagttgtttccatttgtgcatattttggtttttgtatttgtgatctggtaaacttcttcaaccaacatgttcttgatttttgaaatcttgaaggcagaaaaactttcaaggagaagagaagtgtccaatgtggttttggatttttctgtgagaattgcaaccacacacactccacaatttttgggtctgccacagggagcttggttgcaagcaggtgggtttgaaactgctggagaaggaatcactattgggtttgttgacactggcattgatcctacacaccctagttttgcagatgataaatctgaacatccattccccgttcctgctcatttctctggcgtctgtgaggttacgccagattttccggccagttcttgcaataggaaacttgttggggctagacattttgcagcttctgctataaccagaggaatatttaactcatcccaggactatgcttctccctttgatggtgatggccacggcacgtgagtgtttcgtgtttccaaatgagtcttgtgttcaaatgttgttaaccacaattggacatctggtccattctcctcctctttttgtccatatcaacaaatctgtctttctataattttatctttttgaagtttatttccctctgcttgaactttgatgaatcatttctatctagcttctgtttatcagaattttgaactcatcaattagttctccccctgttttgtttagctttaatagtttagaaagaaaatatattgaaaaatggtctggaattgctactcgccgatatggatttagccaatgcttgaaagttaaaaatgaacttacatattcatgccagactatcaatcatgtttctttcattcaaaagttcaaaatatgataggtatttgaattaagtgtgccacaaaactaaaacttcattttacttgttttttcactgaatgtccattctgatatatctttaacaggcacacagcttctgttgcagccggaaaccatggaattccagtggtcgttgctgggcaattttttggaaatgctagtgggatggctcctcattcacagtaactaatcttgaactttatacaagttaaaaactcatgtgtcattttggaaaataattgaagatgagatgaaatggaccaatagacttaaaagggagaaaaaagaagagaaagttgatatctagtgatagaaagatgtaatttatctcagaaacgcttaatgccttttgctttgcagagaagtgctcaactaggtgctaaagctgagtatctatattcttaaagagggttccttccttgcattgagcttcaagataacataggctagtatatcaatgcagttaaaatattagacctctagatatttattaccttgcaagggtatgtggttctatgtattaagtcagtggtctgtgcatctagaagatttttccaagtcatatttacgagattgattaattatcaaaagctcaggatgctttagaccatttaagccccgaaatgagacttgcaatatgattttcagaagtaagggggaaatatttcctgtctctcaaaattacaagattttctacaagaaaaactgaaagaaaactccttcaatggttgggccaggttcagaaccaaaataggtagctgtcctaggagatggaccactccattgtccctgtgtacattacctgccattcataattaaattttccacatattctgtcatatgctctactttattttctgccttggtctctatcacttatctctttttctcccctgtggaatgcttcaattccatagaattgatctccatgtacagtaaccgacaatttatgtaaatttatttggcacttgaaaaagattatagaaaattatattaacggtgtatgtaattctttttattcaagaacaaaatgaagagtggatctgttctaacctggatttctaataattacatgcaagcataattaatttttattctatatatgtaacatttgaatgcattccatttcaatattttacagcattgccatttacaaggcactatacaagagatttggaggatttgcagcagatgttgttgcagctattgaccaggtgtctgtacttttgtatgccatttatgtgtcagtaatatttgataattttactttaggtcatttgttgacacttgatatattttcttgtttttatcatcttaatgttatctcttcctttctctagtactcgccaatatgattgcttgattaactacataattattgttatccatttttcaacagcctgtttattggcttcaaataattctgattcagtgaagagcatgtaatatagattgtattaggattctaaatttaacctgtgggttgatccaatataatttacttttcatttaaagtttgttaatgtatttattcattcatttatttaaattttcattgagggtatgcatggtcttgaattgaagagttactgtaaagtgtaaaaagtactttccttgcatgtgttcctttcaaaatctgtttacttaattgtatccccaattttacatttatggtatggcttatagtataatcaattgtttacaggcaggtcaggatggggttgacataatatgcttgtcaatcactcctaataggcgtccttcgggcatcgcaactttcttcaatccaatagatatggcattgctatcagctgtgaaagctggtatttttgtagtgcaagctgctggcaatactggaccatcacctatgagcatgtcctccttcagtccatggatctttactgttggtgccacctctcatgatcgagtttatagcaactccctatgtcttggaaatagtgtgaccatatccggtgttggactagcacgtaaaattctgttgctctaatcctggttagctatacatgaatttgtttaagacaaacttggccttttggccttggtgggcatttggtcttgaaattaacaaagaagtgcagatgggaaagtaattacttggatggggtaaatctggtgtgagtgagtgatttcaaaaagtgatgtcatactttatatatgaatccctaccaagaacaaagaaattcaagatttaaaatggacactacactactgaaacaactactttttgttacctttaagaccttaatcatgttacattggggaagttccttgatgaacaataaaatgatttaattattaatttgtgcaagtataatttgttacatcagtacgcctattgagatttttattaataccctaattttttttcatttttgtttaattactttccccagctggaacatatgagaacacgatgtttaaactgattcatgcaagacatgctttgaacaaaaacacaacagttactgatgatatgtatattggtgagtgtcaagatgcaagtaagttcagtcaggatttagtccagggaaacctcctgatctgtagctattcagtccgatttgtggttgggctctccaccattcaacaggcattagaaacagccatgaaccttagtgcagttggtgttgttttctccatggacccttttgtgtctgcttttcagcttaacccagttccaatgaaaatggctggcataataattccatctgcaaatgattccaaggtgcattgttcattttctcccttgcacatgtatactgtcttttttcttattttttttcgcttgtattttattatatgggtgctgttggtactgttcttcaatcagaattggagtttcacctgctaaataatcctttaatgcaaacattcaattatgcaaattactgaggtgaaactccaattctaattggagaatagtgcaagcaacaccgaatatctgcatgaaaaaccatggtgtggatttgacatttgtcaacagtcaacttatttctattccttgcttacatgtgtgtgggaatgacactgagaccaactattcactttgcttttttaactgtgcagatattactgcaatactacaattcttcactgcaaatagatggggattcaaaaaaaattgttaaatttggggctgttgctagcattggtggtggattagaagccaactacaataatgaggccccaaaggttgtgtattactctgccaggggaccagatccagaggacagtcttcctcatgaagctgatattatgaaacccaacttggtagctcctggaaattttatatgggctgcttggagttctgttgccactgattctgttgaatttctaggtttgtcaatacataagcttatttttactagaaaacaaaacataaacaagtttaaggtgtttatttggcctgttccaagttaaacataacatctttttaagttataaatatttatactaggaaataggaattttgatttattaagcatgtcaatatactgatatgtgaatatctgatctacactattctaacaggtgagagttttgcaatgatgtctggcacaagcatggctgcacctcatgttgctggtcttgctgcactaattaagcaaacgtttcccaattttagtcctgcagccattggatctgcactttccactacaggttctctgtatgacaacaatgggaggccaataatggctcagcgatcatacccctccatagaccaaaacctatctccagcaactccctttgacatgggaagtggttttgtgaatgctactgcagcattaaatccgggattgctttttgattctagtaagtctcacttgactaatgaactttcaaatcattataatttccatgcaagttcaaatgtttcaaaaattcagcaacgattgttgttcaaatgtctcacttatctagctcaaatttatgaaagctgctggattaataaacaagcctgttttctgaatttccaaatgtgtttatacatattttctttgtaggctatgatgactacatgtcattcctatgtggtatcaatggttcaactcctacagtgctaaactacaccggtcaaaattgctggacttataattcaacactatatggccctgatctgaacttgccctcaatcataatagcaaggttgaaccaatctagagtggtacaaagaacaatccaaaacattgctggaaatgaaacatacaatgttggttggagtgctccatatggcacgtctatgaaggtgtctcctaatcacttctctcttgcaagtggggggagactagtcttgtctgtgatcttcaatgcaaccagcaacagttctgctgctagctatgggagaattgggctgtatggtaatcaaggtcatgttgtcaacattcctgtggcagtcatttttaaaatcttataaccagctaattaatatgattagtgtctttaattacttcttcagtaattcattttttattttgctttgttttcttaatctagtctttgtttaaaaaatgtattaagctattttttcattcgttatacttaatagtgtaaagttacgtttgtataataccaaattgtgcagcacttattaggtagtatagtctgtggctcaaaaaaaaaaaaaaggtcgtatagtctggttgcatacgtgaggtgggttatttttgtccggtatgcacttggaggacacccagcccaagttgttaacaaggacactacaagcgattagtgataattgtgaattctcatatgctttgttgagtaactgttgttccatctttatttacctttaaattttagggatcatgcacttctagacgtttttttttttttttttttttaccaaagtgaacctttagagctagtaactcacttttgagagtaaaataaataactcatttattatgcataaccaattataaatgtgttggatattttttgatggaccaaaatttcttacttgatcctttagaggaatttaaaaatctaaacttttagttggttaagattaatgatatgctttaaattaaataaaagtaaacatatctaatttagaaataagctcattttcactgtgttatattgctgtgataatcactttgatcactatgataaactataagttggaaacacagcaaattttaattggaaatttttgtttttttcataaattatagagtttgattagaagtattatagtataaatatttgttatacggttatcaatctttacattgaaaatacatcaaaataaattttaaattatattagtattttaaaatataacttttgagggaatggcccttcataaactcgtctgacagattatgcaaacaaataatttaaaaacaaaaatcaaggaggtgtgaggttatcatatgaaaaagttgaaatgcagcagtagcatgtgtaaggaatagatcatacttatcgcgacacaaatacaaatataaagcagcctgtacagccacctagtgaggaaatgtatttgtcacagtacaaaattcgctcaaaatctgtatcaagcgaaccaataacataattaacaaacctccgtaacttttattatatatgttgtaagcgcagcaattgttgaacgcgcagtacatgcaccgaaagcagcagcaaatgttgaaatttgcttcaacaaatcacgcgcagtaccttttggcatattaggcaccgaaaagtgcacagtaacaaatgttactgtgcacacgcgttttgcaatctatataaagcgctttgcattcggtttaacgcagtgaagcagcgcaaaacaagagtagaagaagagagaaatatttaggagtgtgtgagagtaaacaccaagtgaggaaaaatatcaaaatactcacttctgtattttttcttttgtacccaattttgtgtgatatccttgtgaggattattgggtgtatttgggatttgggttttgagtgttattttcctcttttgtactcttcttcattctagtggaactcttgatctgtcttcgcccgtggacgtaggcacactgtcgaaccacgttaaatatctgtgtcttgtctttgtttcattttactccccattttatttttctccatctcatattttgctttatccgatccaattttcgtaacaaactggtatcagagcatatcggttggatatttgagtggaagtactgttcgtcactattcatactattcacgtatacggcactattcacagaaaaatagtgtgatccggagcagttactatttggagtatcgtcaacaccatggcggcaaaatttgagattgagaagtttgatggcaaaattagttttagcctatggagagttaaaatgcgtgctattttggtccaacaaggactacaaaaagcacttttgccaagagaaaaattgtcagctgatgatgatgctgcaactgcaagcacaacaactgcaacaaaattagtgtccgctgcggagttgacagatgttgatgagaaggctcgcagtacaattattctcaacctctcagacaaggtgttatgcgaagtggtggaagaagacactgcacttggtgtgtggcagaagcttgaaagcctctatgccacaaaatctctcaccaacaggttgtacctcaaacaaagtctttacacacttcgaatgaaagaaggtacgcctattaaggaacatgttgatgaatttaatcgggtaatcatggatcttagaaatgttgatgttaaaattgatgatgaagatcaagcccttattttattatgttcgttacccccttcatatgagcattttgttactactttgctctatggtaaagactccattagcatggaagatgttaaggcatccttaatttctcaagaattgagaaaaaaggtttctggcaataacaccgatgaaattggtgacggtcttattgcgagggggaggagtcaaaataagggaccagtaaatagaggccgatcaaaatctagaccaaagaaaaatattgaatgttactattgtcacaagaaagggcacattaagtgggattgtcctaaactgaagaaaaataataaaaaggacaataacaatgaaagttcttctgttgttgctggagttgtggaggaaaattcctcagatgataatgttcttacagtcactgtttctgattctagctcagaaaatgagtgggttcttgattcgggttgttcctatcacatgtgtccccataaagattggttcaccacttacagatcaataaatggtggaactgtcttaatgggaaataatatgacttgcaaaactattggaataggtacaattcaaattaagatgtttgacggtgttgtgagaactttgacagatgttcggcatgttccagagttgaagaagaacttgatctctttaggtactcttgactcaattggctgtaagttttctgctgaaggtggaacgttaagagttgtcaaaggtgctctaattgtgatgaaaggaaaaagaagaagtggtctttattttttgcagggtaatacagtttatggctctgcttcggtgtcctcaacagtagatcctgattctgacactacccttttgtggcatatgcgcttgggacatatgagcgagagaggattgatcgaattgagcaaacgcggtttgctttgtggccagaaaacaggtaaaattgacttttgtgaaaactgtgtttttggcaagcataaaagggttaaattcggtactggtgtgcataataccaaaggaactctagattacattcattctgatctatggggtccttcacaagttccatctctcagtggtgcaaggtatttactgactttcattgatgattattcccgtaaagtctggatttataccttgaagaataaaaatgatgtgttccagaaattcaaggaatggaaggctatgatagaaaaacagttcggtaaaaaggtgaaacgtttacggactgataacggtttagaattctgttcaggagaatttaatgagttttgcaggaaagaaggcatcgtaagacaccgtacggtcaagggtactccacaacaaaatggagttgcagaacgcatgaacagaactcttttggagagagcacgttgtatgctctttactgcaggtctgccaaagaagttttgggctgaagcagtcaatactgctagttatttggtgaacaggtctccatcgactgctattgaatgtaagacacctgaggaactatggtcaggtaaacctgctgattattcttgtttaagaatatttggttgtccagcttatgctcatgttagtgaaggcaaattaaagcctagagccaagaagtgcatctttcttggatatggacagggggtgaaaggatacaggttgtggtgtcctgatcctaagtcacccaagtttctaatcagcagggatgtcactttcaatgaatcttttatgcttcatcagaaaaaggattcatttgatacagatgcaaattgtagtgaaagtgacaaacatcaggtggagttacattttgatgcttcggaaacgatgcccgaagcaattacaaatcagcccacagaagaggaggtgcaacatgaggaagcaccaccactgcaacaggacactattgctgctcggagacaacgcaggcagatcaagcccccccagaggtatgcttatgcagatctagttgcttatgctttgactatggcagaatcttttgaagaagatgagccttccaattaccgtgatgccattacaagcaaagaatctgctaaatggactgttgctatgaccgaagagattgagtctcttcacaagaatcagacatgggagctagtcaaaccgccaaagggccaaaagattattggttgcaaatgggtcttcaaaagaaaagaaggaattcccagagttgaagatgctaggtacaaggcgcgcttggtggcaaaaggctacagtcaaagagaaggtgtggacttcaatgaagttttttcaccagtggtaaaacatacttcaattcgtgttttacttgcattagttgccttgtataatttggagcttgaacagctcgatgttaaaactgcttttcttcatggtgagcttgaagagcaaatttacatgcatcaacctgaaggttttgttgaacagggaaaagaagatcatgtttgtttgttgaataaatcactgtatgggttaaagcaatccccacgacagtggtataagcggtttgattcctttatgattgaacatggttattctagaagtaactatgacagctgtgtgtatattaggaagctctctgatggttcatttttgtatctgttattatatgtggatgatatgttaattgctgctaacaacatgtcagaaatttctaagttgaaatctcagctcaactcagagtttgagatgaaggacttaggtgcagctcgaaaaattttgggcatggaaattcatcgagaccgcaaagcaggcaagctgtacttatctcaaaagaagtatattgagaaagtacttgagcggttcgggatggaaagttccaagccagtctgtacaccacttgctacgcattttcgcctatcagcgaagttgtcaccacagaccaacgaggagaaggaacacatgtcacgtattccttatgctagtgcagttggaagccttatgtatgccatgatttgcactcgccctgatatttcacatgctgttagtgttgtcagcagatatatggaaaacccaggcaaggaacactggcaagcagtgaaatggatacttcgatatttgcggggtacttcagatgttggtctggtcttcgatcgtagcaatattaacacttctgaaagtgttgttggttttgtggactcagattatgctggagatttggacaagaggcgatctttgacaggttatattttcactctctcaggatgtgccgttagctggaaagcaactttgcagtcaaccgttgctctttcaactactgaggcagaatatatggcgctaactaaggcagtgaaagaagccatttggcttcgaggtttggtcactgatttgggcttagaacaaagttcatcagttgtctattgtgatagccagagcgttatacatttgaccaaaaatcaaatgtatcatgaacggaccaaacatattgatgtcagatatcactttatcagaaatattatatctgatggatctgtcaaggttgagaagattgccacaacagataatccagcagacatgatgacaaagcccatcacgacaatcaagttcaatcattgctcgaacttggttggcgttcgtaaaatataatcctttattaggatttcttggagaagactgtatcagaaattttattgaagtggagttcagctcattgctttatccccatatctgctggagggggagatttgttgtaagcgcagcaattgttgaacgcgcagtacatgcaccgaaagcagcagcaaatgttgaaatttgcttcaacaaatcacgcgcagtaccttttggcatattaggcaccgaaaagtgcacagtaacaaatgttactgtgcacacgcgttttgcaatctatataaagcgctttgcattcggtttaacgcagtgaagcagcgcaaaacaagagtagaagaagagagaaatatttaggagtgtgtgagagtaaacaccaagtgaggaaaaatatcaaaatactcacttctgtattttttcttttgtacccaattttgtgtgatatccttgtgaggattattgggtgtatttgggatttgggttttgagtgttattttcctcttttgtactcttcttcattctagtggaactcttgatctgtcttcgcccgtggacgtaggcacactgtcgaaccacgttaaatatctgtgtcttgtctttgtttcattttactccccattttatttttctccatctcatattttgctttatccgatccaattttcgtaacaatatatttatatgcatcaaaatcccaccacagcacacaaaacttgttaaaataaaaagataagaatgaaagatttttcaaggttgttcaaattaaggtcattggcaatgaatgtcaacgacatggacccttcaaggtgaatgctcgtatgctatgtccttgtccttgaagacttgcatgatttgtattgatttttgggcaatgaatgaagaaatacatgctcgggtcaataataaatggttcaacaattcaattcctaaaacatatatgaacctcttagccaaattaaatagtacattaaaggagcatatcgaaacgagtttgtttataaacgcaagacgcatatagacccgagagtttgtgccatttcaaacctggcactcgagataaaataaagattaattagttgctaacttgtggtgctggcatgaaactagtatccaacatctttggaagcagcttaattaaaagcatacaccatttactcaatatattaaaaaagaacattttctattcagattttgttcatcaaacaagtggtgttcaactaaattcagcactcacatagccaaacgtatgtactaacccaacactaacatattcagaaagccttatcacatgttttaataattttttccttaagcattcatagaagaacaaaataaacttaaaattttaaaattaatttatacataattcaaaaataaacttttagagaagttaatttgagagagatattttaaattaacttgtgcataagcttaggatctatttgaggtgattgtgagtttttggttatcaaatataattttgaaaataaaactcatttgataaaaataaagttgaaatgattttgattcatttttaaaatcaagatttttttttatcaattttgtttttaatttaaaaaacactcactttctatatttgacatagcttttttgatgtttctaccactatagtcactattatctccatcacctttatcaatattagtactatacaatatcattattgttattaatgtaatcatagtcatcgcaacaaaaaacactattaaattaattttaataaaataaaaaacttttaaaaaataagtatattttgaaactaaaaataaaataaaaaacataaatttaaaaactaaaatcttgtttttttaaaaaaaaataaaataaactcaactaaaaatcacctcaaaacgggttagactttgaacaagtttattatatttttttcttttcctaaatattagtaaaaaagtttatttgaatagacccacaaaaatatattatattgaaattattttaaatttcctaatataatttttattattaattatttgtcttttatatatgaaaagcatataaaataattaagaattaagtaaaaataagagcataattaaatggtactatttaatattatcttgaataattaaatagttcagtaaaaataagttgtttttcaaattggacaaataagaaaaaagtaaatattttagacgcgcactgtgataaatatgagtccaaattttattattccctgaagacttattcaaatgcattaatgtgaattaatttaatgcattgaagacttgaattctacttccggtggaaatcattcaacacaagaaaactacaggaagtgggttttctgctgcggtatcaaaatgtttggccttgatatgacatttagtgttcgattgcaacgtactatctcgtaaggaccaagtaaaaatagaaatctttctattaaagtatatgtaatagaagatctcaatttttagattttaattactttttttttagattttatagtattatattacttttaaaatattttttattttttatttaatttcaataatatatcatattttaagatttttaaataattaaatacaaatcaatttatgaaaaaaaagagtaaaaaattattttttttaaaatagatgcaaatcatattttacaataattaaatctccacataaaaattcataaattttaacaagattaaaatttgaaactaaggtctgtttacaaatcctttcattgcgacacatgtcatgatgtcaatatatcaatacataagttgctgttgctggtgtgccattttcatttttctgtcaaaatgcatatttgaccttatggcattggtgttcaattgcaagttgcaacgtatctcctaggtaaggtaaagtgaaatgaatttttttttatccataaatattaataattaataaaaaaaattataatcaaccacctatcccttctttcatccttcaagttcaagacaaccttccatcttcttaaatggaaatcttctattgctgttgcggtagcaacgtaactcgtaaggtcatagtgaaatagaatattctatttactatgcactcctgttaaaaaaattaaatgccctcaccaggaaaaaaaaactcctttttggacatatgaaccaatttttggattaattatatttttagttctgaatttttttttaactttttacttttaatttttttaaattaaacaattttaatttccaatatttacttcagttttcttttttcatccttgacgttaaaaatctgttctgtgttgaaataacagttggattttaattatttcaaaatatttgtaacaatttactatgtgacaactcaaaatcttaagtaataaaacaattttgtttatgtatgaaagaaagttctcctgttaatttttctctaatttctctcacaaagagccaaaagatatttgagctccaatggtcatgtttaaattaatttggataatttttccataaacacttactatgagaagaagaaaaatatttttttcaaaaattaaattaatttatgtataaacagtcatttttaaagtttctcttatattacgtttctttaaaaaactcatttttaatttatgtataaattaattttatctttaaaactcatttttaatttgtgtataaattaattttagttttgaaagaaattaacttattttattttttcttatatttttatcttataagtgttcatgaaaaaattcatccaaacaaactcaatcttttgttgtattcaaaatttaaaaagaagggggaaaagaatataaaggaagtgagttttattgtgtggtggttcctatttcagcttatttccttctaatttggaaagaacaaggagaaagagtgtgaaaataagtgaaaaaaaaaacataaataaccttaagtaataaaataatttttcaatttatattgttaatttgtttttattttattataagtagtaaaatgtttttttaatttattattatccttttaatttatcttagcttgtatcttgactagtttttttttttttttgtattacagctaagagcttaattttatattcttattatttttattatattttttttaaaataatatttatgttattttacagatatacgttttttttcttctcagtttctacataatcaaataagatttgagtttttttttttttttttacttttcactttctttccttatattttttttcttccatttttttattaactaaattaaggttattgttaaaaaccgatgccatcttgcacccttctatatcatgtcctctgtcattaaaatgatttcttaaatcttatttgtcattatcaagaggttttgtttttgtcagcgaaataaattttagtcattagtaagaggatatttggataagtttatctataagaacttctaggtgaaaaaataaggaaattttttattcttatattaaaattagtttattcataattttttttatagaagctttaatttctcatattaacttcttcaaaaactgattttaatctctctctctctctctcacacacacacacacacatatatatatatatatatatatataaatttaaaactatgattttttccctgtgtttctagaaatttacctaaaagaagaaatcaggatgttaggaaaattataactaattttgttatttaatataaatattccaaaaattatattttgcattgaccttttcataacattatcacctcccattatataatgcaacacaatcttgaccctgacttttggcttttatgtttttgtcaacaaggcctttttcatgacgttattgggacggagaggatacaaggaaaattataactaaactggcattttaggcagcacattacatatgataaaatatttatttcatatgattaaaattgataataaataaataaataatttaaaatatataaaatatattataattaaaatatgtaataaataatttttttacatataaattatattttagatttatgaaaaataatttatattatgatatattattgtttttaattataaaaatattattttaaaaatattgaaattaaagttagaattaaatatattaaaaataatagattgaaaaaagataaaatgtttagctaaattattcaattgatgtaaaaagcataagagatactataatatcgaatgcatgttaaaaagtgtattgtaagatataaatatgaaattagtttttgatatttaggaacaattaaatacttaactcgttcttgatattaaaagtatcatatgcatgctacgtgcgttaaatacacacttgataagaggtagaggagaattcaaatgagaacgaataagagtgatatagtaatatacaaatttgtttgacaaaaaaacccaatcacttccactacttaaaaaaatgtagtttaagggtattatagtaattgaaatatgtttgttagaaataatatttttctcttttctccactgatcattctctcctgtctctcggttccatccctcacgttggtctaacccaaagtttcaaactttgcatgcatcttcttactccaaatttgtcatcggtccacactcttccatcaacaattctcatttgcacaccaaaagaaccgctcacacctgagtttgttgaatgcgactaagagagagaaataatattttaaacaaacaaatttgagttattaactatatttattaaagtagtggaaggattgattttttttgtaaaacaaattttggtgtagattactaatctactctaactggaaaagaagtgtcagtgtgttagtaattctcatatataaatattttaaaatatatattttattacattaatcttttcatattgaaaggtaaaggaaacatagagagatagataaatggctagccgtggagagactgcagagaatccaaattctttcactgtcactatcaccttgaccttgcattgtggaatgcaacacaatccttgacccagacttttggtttctttatatttttctcaacaacttggcgttttgcctgacgctcttaactaggagcatttaccttaccttaattttcggtggcttttcaattgctatttttataatccaataacttcattgtttggtgtttgccaattatttcggccaataaattggattcttcagattatctttttgagttctcaaaacttttttttttaatttgagtagaattattttagatagaatttaaaaaattattttcataactaatataatttatttttaaccaacaaatgactaatctgagaaatgaactcggtctcttaaacaagtttttgatttaagtcaataatatgataaaaaaaatagaattaattttaaatgagatttttttttgaaaaacatatttatattttcaagatatttatacttgctattatttaaagtatttttttgttttaaacttgttttaacatcatcttaaatataaatgcatttttgaaaatattggtattcttttgaaattaatcgataaaaatataaactaaaagtagacaagtagtgaatgaatgcataacccaacatttagtataaaacaaacggataaccaatcatttagatatcaatcggaattatctcccaacctgaatagactggtgaggtgcgttagcgtgggagttacttcaacatgttagaaaacaatatacttgagtaaatctgctggactatatcttcactaagtcggaagaactatacattaagcaaaaaccattaatttatcaaaattatcattttagttgcaaattttaagataattaggtctgtaaaattattaaattttcaaaataatttcggaaatatattgtacattgttgatgaaattaatcgtctaaaatgtaaatgtctaataatcgtttctaatcaactaacattagacatgctaatgtgacacaaccatgttgcctgacacatgatagcctagtcataaaatattatcattttaatatagcatgaaattgtaggatttctaaaattcataaaattcgtacgttaatttagttcctacaattatcaaaatttaaaaacaatttctaaaattgaaaatcgtggttcacaagttaatccaattgtcaccttcttaatcaactaacaatgtcaaacacaaatgtagtaggttaagtgttctacacgcctccaaatttactcatatgtgtcagtttgaccaatgacgttttctagctataacattcgctcctgttttttttttttttttcttcaaaaatgtgcattgaccctagaatatgcataattagagccccaagaagaaaaatatagacgcgatgtaggaccagtcatgtagttaaaaaaaagacagtgaaaattttagtgcatttggaagcttgatggttaatgacttggaaaataataattgtaatttgagagaattttttaaggataaattgagagttgctatggtacaaataagtataaggattttgctataattttttttaccaatgattgaatgaatttgagcacactaataaagaagagatagggacagagaagagattttcaatagcagtccaaaaaccctcagattttcaaggatgcgcagaatataatatgaatatttcataaagggaaaactttaatattaacagtaaccaaagataaaaaaattaagaacaaaatataatatataaataagttaggtgtttaatgtcattgaaaaaataatagtatagtgacacgtagtatttatgattttactcaaaaaaaattcgtgaggtaaaggttagacaagtttcacatcatatattctttaagtaatctctaaaaattctcagtagtttagcattcaggtgttgaaaatcgacaatcacacacaaattgaaaaaacagaaaagagaataggaaagagagatatgacacagtgatttatcctggttcacccaatgtaggctacgtccaacttgtctgtactataatcacctcaccgccactcgttacaaatcacacgatttacaaagggaatataaataggattaaaagaaaccctaacagtagctattcatgggctctagcccaaactactaataaaagtaaaatattacaaataatcagaggcatatccaacattaggcgttatcatttttaattgttagaattaagaaactaattctattatgtatgatgttttaccgctaagaggacaacgcattttattaggagaaatgttaacgatattatttttattattaatgtgatcaactaaaatttaatttaaatttattataattattaaattttatgagtcatatttattatttgatgattttatttcataatttaaatataagattcatcaaaattgattattttttttttaaaatcaattccaaaaacagtgttgaaaacaaaatttgaggttatatttctctttattatatataaaccattggatcttagtagcttactagttactttatattaacattaaatatatgcaaatttatgtgacatatgttaaaagtacacctgttattaaaatatgtttttatttatgtttaatgttgcattgactatgctgtccaaaaacctgttgcattaactgttacataagactttttctactggagaaaaagatactacctcgggattttatatataaaaaataaaagataatatttttttattaaaaagtaaaagataatatcttcttggccttaattaagaattaaaattcaatttttcttgacccactctgcagcattctttcttgctgattattgactggttttctccgattctaaccagtttttcttcaagttgattttattgattatttgaaccggtcataagatcaattcaccagttttttggtctgatcggccaattcagttcgatttttatactagaaaaggccacaagaagatgagagagaaaattgtaagatatatgtcccataatagataaaacaaaggttaaaataaaaaaaaaattatatataacagggctttacatgtaaatgatagaactatattattcatatacttttttataatattatttttatctttttcaattatattaattattttacttcgcacttcaattttttattataaaaatatatacaattttgtgcaaatatatatatatatatatatatatttaaaagaatctataatcaaaacaaaatttaatttctatgcatgtcaatgtaaaaaaaaatgacacactcaaccaataaaaaaaataataaatatgacttttatgataatcaataatattataaaaactctccacttatctccacgtgttggctaaataaattttcagaattttcttaattgtcatttcacttttttcctctcttttttatttttgtaaaaattgtgcaatagtacaagcatatatttagttattgttaaattcaacaaaattatcatatatatatatcatatatcgacaatttgtataatataaaaatcttttaccatcgattagtttatatatgatttactcttaaataaatatacttatctatttatttataatatataaaagttgaaatatgaattgtggtgttgacgtttaaactacttgattaacataataaatgtcgtagcacatcaatggtttatcatttatgtcatgtcttggttaagtatttcccttcctctcaagcaattaattagccacactcccttcgatcaattatttatctttcttcttaatgtatgatttattacatttctttcattatgatatttcaattactcttttgaatgtaagttactgacgttttcttcctgaataacctatttatataatggaattagtctgcttcattgtctacatgagatcaaagcaccaagtatcaacaacaaaaaaatgttaggataaagaaaaaatatatatattaaggacactgttttaaatttaaattattatcaaaacataattttaaattacatattactttagcgtaacaattataatattaaaagaaaaatatcttgaatttaatgactatgcatggttaaagtaaaattttatataattaactaatcataaattagtacaagtataacttataaaatagttattagaagagtcattaaacttatatcatttgataataatataaaactactttaaagtataagtattggataataatatataaagagaaacaatagaaaaagtacaggtataaattatgacaaataatataatttgatataaaaaaagagaaatagaggaaaagaaagtgtcaaataggtattaaatatgagtatccattttttttggctaaaagataaatgggtacccatatatcattaggaaaaatataatttgataccaaaatatttgctgacacccagtgaaaaagaaaaaaaaaaagagaaaaatataaatatgatagatgaaataatgtgattaaaaaaaaattgttaatgaaatattgatatgtgaaaatatcactacttatatcattagtgatcattactcatgagtcataactatatacactatttgtcaaatatttaagcgtacgcgtaacgggcgggtaaatatctagtaaagagaaaagctaagcaatgcattgcatgccagctgcagccgaactattataaatacacatcttagtaagaaattaatatcataaacaaacctaagaagcaaacagcaaagtatggctttgttttctcaattacctgttcattttgccttattactctttttcctctttcttgatctacacaaccttttgcttggtgtatcatcagccactttaagcatcacctctgacagagaagccttgatctcattcaaatctcaactgagtaatgacactcttagccctttatcttcttggaaccataattcatccccctgcaactggactggtgtcctgtgtgacaagcatggccaaagagtgacaggcctggatctttcaggcttgggactctcaggtcacttaagcccttatattggtaacctctcttctcttcagtccctccaattgcagaataaccaactcataggactgattcctgaccaaattggcaacctattcaatctgagagttctaaatttgagcactaacatgttagaaggaaagcttccttcaaacaccacccacctgaaacagctccagattcttgatttatcctcaaacaagattgccagcaagattcctgaggacatcagcagcttgcaaaagcttcaggctttgaaactgggaaggaatagcctctatggtgcaataccagcgtccatagggaacatttcttctcttaaaaatataagttttggcaccaactttctcactggctggattcccagtgacttgggtaggctccacaacttgattgagcttgatctcactctcaacaatctcactgggactgttccacctgttatatacaacttatcttcccttgtcaacttggccttagctgcaaactctctgtggggtgagattccccaggatgttggtcaaaaacttccaaaactcctagtgttcaatttctgcttcaataaattcacaggtggaattccaggctcattgcacaacctcaccaacattcgggttattcgcatggcttccaaccttttggaaggaacagtgccacctggtttgggaaatctcccatttcttcgcatgtataatattggctataacaggatagtgagttcaggtgtgagaggtctagacttcatcacttctttgacaaacagcactcacctgaactttctggctattgatggtaacatgctggaaggtgtaattcctgaaagcattggcaatctctccaaggatctcacaatattatacatgggacagaatcgtttcaatggaagcataccctcctccattggtcgtctaagtggcttgaagttgttaaacttaagctacaattcaatctttggagatatcccaaatgagttaggccagttagaggaactacaagagctatctctggctggaaatgagatatcaggaggaattccaaactcccttggtaatctcctaaagttaaaccagattgatttgtcaaaaaacaaacttgtggggagaatacctaccagttttgggaatttgcaaaacctgctttacatggacttatccagcaacaaactcgatggaagcatacctatggaaatactcaatctcccaactttgagcaatgttttgaacctgtctatgaactttttgagtggaccaatacctcaaatagggagattgattactgttgcctccattgacttttctagcaaccaattgtttggtggcatccccagctcattcagcaattgtctcagcttagaaaatttgtttttggcccggaatcagctttcaggtcccatcccaaaggctcttggagatttgaaaggcttggaaactttggacttgtcctccaaccaactctctggagccttacctattgaactacaaaatctacatgtccttaagttcttaaacctctcgtacaatgatttagaaggagcaattcctagtggtggagttttccaaaatctctctgatgtccatttagaaggcaatagaaaactctgcttgtacttcccatgcatgcctcatggccatggaagaaatgcaagactttacatcatcatagccatcgtggtaacattaatactatgtctcacaattggcttgctactgtatataaagaacaaaagggtgaaggtaacagcagcggcagcaacatctgaacagctgaaacctcatgcaccaatggtctcttatgatgaacttcgtctggcaactgaggagttcagccaggaaaacctattaggagttggaagctttggctcagtttataaaggccatctaagtcatggagctactgttgcagtgaaagttctcgacaccataagaactggctctttgaagagtttctttgcagaatgtgaggctatgaagaactcaaggcatcgaaatttggttaagctgatcacatcatgctctagtgttgacttcaaaaacaatgattttctggctctggtgtatgagtacctgtgcaatggtagcttggaagattggatcaaggggaggagaaatcatgcaaacggaaatgggttgaaccttatggagagactgaacatagctatagatgttgcttgtgcattggattacctgcacaatgatagtgaaatcccagttgtgcactgtgatttgaagcctagcaacattctattggatgaagacatgacatcaaaggttggagactttggattggctaggtcgctgattcaaaactcaactaatcaagtttccattagctccactcatgtccttaggggctcaattggttacatacctccaggttagaatccttacaactttttctttatcaaccttttaattaattccattacaaattgtgaaacatgataaataattagtattgttacttgcccaatgcagagtatggatggggagagaaaccatctgcagctggagatgtatacagttttggtattgtgttactagagctcttctctggtaaaagcccaacagatgagtgtttcacaggaggcctaagtataagaagatgggtgcaatcagccataaaaaacaagacagtgcaagtcattgaccctaagttgctgtccttcactttccatgatgacccttctgagggaccaaatctgcaactcaaatatttggatgcaactgtaggagttggcatatcttgcactgcagacaacccagatgaacgcattggcattagagatgctgttcgccaactaaaagctgctagagactctcttttgaaactgtctgatgagagtcctacaagagataccaagcgttacttccatgtttcaataaagtgaaccctagactctagtcatgtatggttgaaatagaagcatttcgaccaccaacctttaaatagggtattaattaaataaataacaattgtgtttatgtttatgtgtaactctatctcttgtaaaacttacttatgactataaagaagaatggtggatcacactttgtgcgaaaaagatgattattggcactgcttatatattaattcaagcaatttttttttatcagttaattcaagcatttttaattaagttttttgttagttaagtagtttattttgatttacaataacattatttatttacaccaggatatctctctattgacaagagagtagaaactaattcttttagcaaggaagtctaactttttattattactattatttttggaataattaataatattagtaatgttgttccttttattgttatattatactataaattctgttgataaataatattgataaaaaaactcgactaactatttttgatagaattttttctctcgatatattttttcatcacttgaatctaacaccttgattaagagatctgactttagttttaaaaaatgtaatattagtttgttgttacttttttattaattactatcattgttttggttattattttattcatctgagtccaagaaacactaatgatgaatacaaatattctaattaccactgctacattattttcatattaatatcggttatatatatttttctcttgtaatcttgatttagttttgtgatagaccaatccttaatccaacgtgcatgcatggctgcttggaagaagaaaaagaatatacctagagttgttgcgcgcgcctagcccagaagcacagctaccatccctcaaatgaaattttctctctagccacaacactgacattttttggaactacatgtacatgcagttctgattgtcacactctgacgcaacgaagttttaaacaatcttctgtctcggccaagcaatatggcgtcaccgagaatagaaaaaaaattatgaaacaaaattaaattaatgatagaaaacgtgcattgggctagcgggaaaataaaaggaaattaacaaataaagagtgaaaactgaaataggttcaaaagattcgcagaaaaaggacaagagtaacggtttcagtgcttcatcaaactcatgttagcttcaagagagaaagaaaaggggcttaaatttttttgatcgaaaggaatcaaaccaagtaacttaaggtttataataacttacacgtaagactaggttaagacacttttggcctttggtagcctgaatagatgtaatgtaaaataaagtaatacccagagacgtagaaccttaattggtataaattttggaaatctatttcaaagtcatataaaaaatctgtacagcttaaattacaagttttctaattataacctttctaagagggctgtttgctcttaatttcctatataaaaaaaaaattggattttctaaaacatagcactaaatttcaagaagacaaataatatatttaataagtcaagacttaaattatatttaagttgtaagtttttttttcaaaattaactaaaataaatttttgttttaatgtgaagaagaaaaaatccattaataattgcaaggataaaaagtactaataattatcacaatacaaaaaggaaaagatgttacattttgaacaaattatatgccatcaaccaccattcttctttacataagttttataattgacaaggttggcggcagaaatgtgtctcaatttctaccattcatgactagagcgattaattggcctaaaatagtaaagtatttgatcattacatggtcaacaaaagtattattatattatatattattctttgcgcttatttcaacccgaacgtttcaacttgtgcactactagtatttgtcaaacatggctgcaaagtgtaaaggaccgtacggtgccaaccatctatctgactctttcctatctcggaacagttcactttgctgaaacatggacgcaagacttggtatctctagtactagtaggtgtaagactcacgtcatcagactgattcaaaagagagtctctagcagcttttagttgacgaacagctactctgataccaatgcgttcatctgtgttgtctgcagtgcaagatatgccaacccctacagttgcatccacacaattgagttgtacatttggtccctctgaagggtcatcatgaaaatgacttgcactgtcttgttttttaatattgattgcacccatcttcttatgcttaggcctcctgtgaaacactcatctgttgggcttttaccagagaagagttctaatcacagtgcacaactggaatttcactatcattgtgcgggtagtgcaatgcactagcaacatctatagctatgttcagtctctccataaggttcaacccacttccctttgcatgctttctcctcccattgatccaatcttccaagctaccattgcacaggtactcatagaccagagccagaaaatcatttttttaaagtcaatactacagcatgatgtgatcagcttaaccaaatttcgatgccttgagttcttcataggacattctgcaaagaaactctttaaagagccagttcttagagtgtcaagaactttcactgcaacagtagttccatgacttagatggccttcataaactgagccaaagctttcaactcctaataggttttcctggctgaactcctcagttgccaaacaaagctcatcataagagaccattggtgcatgaggttttagctgttcaaattatgctactggtgctaccttcacctttttgttctctatatatagtattaagccaatagtgagacatagtatcaatgttaacacgatggctaccattatgtaaagtcttacattttttcttccttggccgtgaggcatgcatgagaaatgcaagcagagttttctatttccttctaaatggaccgcaaagagattttggaaaactccaccactaggaatggctacttctatatcattgtacgagaggttcaatagcttaagcccaagtaacttttgaatttcaataggaatggttccagagagttggttggaggataggtccaaagtttccaagcctctcacatctccaagagcctttggaatgggacctgaaagctgattcctggccaaagataatttttccaagctgagacaattgctgaatgagctggggattccaccatacaattggttgttagaaaagtcaatggaggccacactactcaatctgccaacttgaggtattggtccactcaataagttcattgacatgttccaaacattgctcaaagttgggagattgaggatttccataggtatgcttctgttaagttggtttcttgataagtccatgtaaagcaggttatgcaaattcccaaaactgataggtattcttcccgcaagtttgtttcttgacaaatcaactaggtttaacttcaggagattaccaagtatgttagtaatacctcctgatatctcatttccagccagagatagcgcttgtagttcctctaactggcctagctcttgtggaacttctccggagattgaattgtagcttaacaacttcaagccacttagatgaccgatggaggagggtatgcttccattgaaacgattctctcccatgtataattttgtgagatccttggagagattgtcaatggtttcaggaatcacaccttccagcatattgccatcaattgccagaaatttcaggtgagtgctgtttgtcaaagaactaatgaagtctaaaccactaacacctgaactcactatcctgttataccgaatattatacgtgcgaagaaatgggagatttcccaaaccaggtggcactgttccatccaaatggttggaagacatgcgaatgacctgaatgttggtgaggttgtgcaaagatcttggaattccacctgtgaaataattgaagcagatatggaatactatgagttttggaagtttttgaccaacatcttgaggaatctctccccacacaaagtgtttgaagctaaggcaaagttaacaagggaagataagttgtatatagcgggtggaaccgtcccatggagcctacccaattcactgggaatccggtcactgagaaagttggtgccccaactcatacttttgagagaagaaatgttccctagagatgctggtattgcaccatagaggctattccttcccagtttcaaaacctcgagctttttcaagctgctgatgtctcaggaatcttgctgacaatcttgtttgaggataaatcaagaacctgaagctgattcaagtgggtgatgtttgaaggaagctttctgataggaggtggggtcaaacttatgcaagggggtttagatagcaatttaatagttagtataactaagctgagttagttataaataacagttttagagagaaatgtataagaggggagcttggagaggaaaagaggggggaattggaggttgtgaccctcgaagccactgtgtaatcaagaattgtgcttgtgagttgaataaagcatttttgttctctctatattctgtaccagtacctaacactggtatcagagctccactcctggagcctgtgaggtgaatgggtacgaaaaacagcaacaagatggatgccagaattgacgtgatggagagagcgctagaagagacgcgcgaggctagggagattgatcgcgaggccatggaggcttatcaggtcgcaacagaggctaaccgggtcaagatggaaacccggttagacggaatcgaaagaatattgcaaaggttggctgcgactctggaaccaccgacgagggaagagcgtaggcaagccggagaagcaagaaccaagaatcgcgagagagaggagctagaggcgcgacagtggcggcagattgagatgccgattttttcaggggaagacccgataggttgggtggcgcgggtagaacggtttttcctgttacaacatgtgagtgaagaagagaagttagaggcgatattggtagctatggagggagaggccttggcttggtatcaatggtgggagaattggagtgcgcatcagtcatgggaagatttcaaaacagctgtgatacaaagatttcaaagctccaatttgggaaatcccttccaggttttgttatctttaaagcaagaggaatctgttcaagaatacattgggctttttgagaaacatgtaggtgctggtaaaggtttgggtgagaattttttaatggaagtatttgtgaaaggattgagagaagaaattgggactgaggttaggttacatgaacctaaaaccttgctggatactatgctgaaggccagacaaattgaagagaaaaacagagtatgggagagggtacctagatcaacaaagtggatacctcctgtggccaaatctaattttactgggtccaggaatggaaaagattggcagcaagggggtggaagggcagtggaagttagtagcggggctaaaacaagtggtgagggcccaaacaaaaagaaaacttttcaaagattgtctcctttggaagtgaatgagaagatgcgtaagggagaatgctttacttgcaatgaaaaataccatcccacacacgtatgtaaaaacaaacagctaagggtgatgattttggaggaggatgagagtgaagatgaaatggagaatcatggaggctgtgaagaagaggaggtggggaaaatacatcagctgtcattgcatagcattgagggatttacttctaaaagatcactcaagctatggggaagaatcaaagataagaaggtagtggtcttgattgattgtggggcaactcacaactttatttctatgaaattggtgcaggaattaaaattggaagtcactcctaccaaaacttattatgtggaggtaggagatggacataaaataagctgtcaaggggtgtgtaattcattgcaaatggagttacaagggctgcatgtggtgcaaaattgttacttatttgatttaggaggggctgatgtggttttaggtgtggagtggttggctgggttgggagaagtgaaggctaattttgataagctcactttgattgttaaggttcagaatagaaaggttgtgcttaaggctgaacctgaattgcttaaatcggttgttagtatgaaactgataaaaggaggtatagaagaggatgagcagaggtttatgttggaagttaaaactgcagaacagaaacaaggagcagaatggatacctgataaggtagaacaagtactgaagatgtttgaaggaatttttaaagaacctcaagggttgcctcctcaaagagagaaggatcacactattactttgcaacaaggtactaaaattcctaatattagaccttataagtaccctcattatcaaaaagatgagattgaaagattagttagagagatgttgatggctggtattattaggccaagcaatagcccttttgctagccctgttattttggttaagaaaaaagatggaagctggaggttttgtgtggattatatgaggcttaacaaaattacagtgcctgttaggtttcctatacctgtcatagaggagttattggatgagattggaggtgcacaatggttttctaagttggacttaaggtctggctatcatcagattagaataaaggaagaggatgtggccaaaacagcttttagaactcatgaagggcattatgagttcttggtcatgccttttgggttgaccaatgctccttccacttttcaatcactaatgaatgaagttttcagaccatttttaaggagatttgtgttggttttctttgatgatatattggtgtacagcaagaacttaaaggagcatcaagagcatttgaaagcagttttacagaaactgcaacagcaggaattatatgtaaatagaaaaaaatgtatttttggtcagaaggaattggagtatttgggccatttgatttctggagaaggggtagaagcagatcctagcaagctggaagccatgagtaaatggccagtacctaaggacataaaagggctgagaggattccttggtttgactggatattacagaaggtttgtgaagaactatggaaaatgggctcaaccattgaatgctttactgaaaaaggatgcttttcattggaataatgaagctgataaagcatttgagaaactgaaggaattaatgagtaatcttcctgtgctaggggtacctgatttttctaaaacctttgtgttggagactgatgcttcaggatcaggattaggggctgtactatcacaagaaggcagacccttagccttttggagcaaggctttatctgagagaggacagttgaagtcagtttatgaaagagaattaatggcaatagtattggctgtaaagaaatggaaacattatctgttaggaggaagatttatcataaaaactgaccagcagagtttgaaatttttaaatgaacaaaagttgttaactgaggaacaacttaagtgggctattaagttgattgggtataattttgaaatccagtacagaccagggaaggagaatgtgtagctgatgctttgtcaaggcaatttgcttttgcagcagtttctatggtccaggagaatgattgggttgaatgggaggaagaattaagagcagaccagccactatatgagatttatcaaggtatcatcaccaagacaatggagaaacctgggtatgtagtgcaaggagggaagctgtataacaaaaacagattagtgttaccaaaaaattctgctagaattcctttaatgttgaaggaattgcatgattcatctattggagggcattctggttttttcagaacctataaaagaatagctgatgtggtttattggcagggcatgaagaaagatataaggaattatgtggctgagtgtgaaacttgtcaaaaaaataaggtcagtacattgtctccaactggattattacaacccttacccattccaagcaaggtctggactgatatatttatggactttattggagggttacctaaagctcaagggaaggataccatattagtaatagtggacagattgactaaatatgctcattttttggcattgtgtcatccttttacagcaaaggaagtggctgaagtgttcattcaagaggtggttagattacatggatttcctgcttcaatagtctcagatagggacagattattcatgagttcattttggaaagaattatttagaagggctggaacacaactgaagtttagttctgcctatcacccacaaacagatgggcagacagaagttgtaaataggtgcttggaggcttacttgaggtgtatgacaggaacaaaacctaggaattggcctagtcagctagcttgggctgaattttggttcaatactaattacaacatatctgccaaaatgtccccttttcaggcattatatggacaagcactttgtgggtaaaaaacagtgatattccttctaaactagaagaagtagagaagctttgtattgatagagatgtgttgttacaggagttaaggagtaatttgctaaaatcccaggatcatataaggaagcatgctaataaacgtaggagggaagtgagttttgaagtgggagattgggtctacttaaagatacaaccatatagaatgaagtctttggccagaaaagtgaatgaaaaattaagtcccaggttttatggaccctacaaaataatacagaaattgggtgaagtggcttacaagttagaactgccagcagacagtaaaattcatccagtttttcacatttcattgcttaaaaaatcagtcaaagcaactgttgtacctcagccattgccagcaatgttagatgagtagtgggagcttcacatgcagccagaaaggattcttaaacagaggacaaatgcagctgggaaacaagaagtgttgattaaatggagagagttacctcaccatgagaatagctgggagttggctgaagaattacagaggatgtttcctaaaatggaccttggggacaaggtccagcttcaaggggagggtattgataggaggtggggtcaaacttatgcaagggggtttagatagcaatttaatagttagtataactaagctgagttagttataactaacagttttagagagaaatgtataagaggggagctcggagaggaaaagaggggggaattggaggttgtgaccctcgaagtcactgtgtaatcaagaattgtgtttgtgagttgaataaagcatttttgttctctctatattctgtaccagtacctaacactttccttctaacatgttagagctcatattagaactttaatactgaataggttgccaatttggtcaggaatcactcctctgagttggttattctgcaattggagggactgaagggaggaaaggttaccaatataaggacttaagtgacctgagagtccaaagcctgaaagattcaagccagttactctttggccaagcctgtcacatagaacaccagtccaattgcaaggagatgaattatggttccaagaagataaggggctaagagtctcattactcagttgagacttgaatgacatcaaggcttctctgtctgtggtgatgcttaaagtggctgctgatgatacaccaatcaaaaggttatgtggctcaagagggaggaaaaggagtaacaaggtaaaatgagcaagaaaatgagagaacaaggctatagttgctcctttagttttggttatggtataaatttcttactaggacatgaatttgattgtattatctctagtattcattaaatattgtatacaatatctaatgaatactgtttttcttccatgtataaccaaagtgccattttcatgtgtttgacttaggttcccttgcacgaaacattttacagcgaaagaaagtatttcttttcacagcaaaaagaacaaaaaaaagatgtttgtacgtgaaaaaagtcttattttcattttacacgggaaaaaatggttatgaaatcatgtcataatatatgtttaatgttgcattcaggattacataagactttgtctactcgttaaaaagataacaaattcataagtacttgctcattaaaaaaaaaaaatacatctttaatttttatatacattaaagataaagatatctctaaccaataattgaaatttaatttctttccatacataaagttcatcaaaataaattttgtctctactaacaaaaaaaatcatttacttgaccaaaaatctaaccctaacaacatgcttaagtagtatatacatgatatatatgaggtagtgttgatcgtgttaatataagagtgtatattctacttgcttttctttcatatctattctttgatttgtttccgggtttcattagattgttcagatccaatcctcttagggatctattcacagtattggaaatatatacttatatcattccttcatgtaaatcaaaatatatagtatacagtttcaagtacattacaaatacattattaaaaaattaattgtgtttagtattgcatatagtacatgaaacagtttatataattatgacgtttcagaaaataaggatagatttaaaaataaaataaaaactgaagtaaaaattgtaaatagacattttgaatttccaatctgtcaataactccacctcagcatcggctttctagcaacatatcattcgtcaacaatataaaataattttaccaacaatacattaaaattaaactcctgaatatatacattgcacaaactacacagatgttcaattatgttaacaagatagaatagaaatagacttaaagcagacaagattcatggcttccacaacttcattgtgcagtcttcactaaatgttgcaacaagattcctatggggatgatgagtgacacctataacttccttctcatggacctgccgttagccagagagaaattcattatatcataaataaattcatatatcaagataacaacctcagtagaaaaataagcatattgtctcggaacagaatacgagaaaataaaatcccatttaaccatacgcaaggcagagagggttgatcaacagagaatgcacaacgtattatctaaagaaatgagcttcaaggcataaaaaaccaccaagcgggctgattccagttctagttagtttttacataatttacatggttccccatttttaacaaaagatgcaacaagatgaaggtggtaaagagttgttatttatataactcaaataacaatatgtacacttttttttttgtctatctgtctccattatatcatttatacatttcatatttctgtctttctctctctcttagtcatacaaattgttttataaatttttggacaaataacttttctcggtgacataaaaataccaaagaaagacactaattcaaaacatgtaatacgataatatatatataaaaacagtattacaatatcgatgggaattgagaccaatttgaaacaaatttatagatctaatctctgactaactacatataaaattacacataccttcattagatgctccaatttgccagattgatagctgaagcagtacatattcctgcattcaatttacagttccatgaagaatataacaatttttggaaagataattggtgaattagagatattatttcgacaaaaaaaaaattattgatttggaaaatgtcatcaaactcacttatggtactgcaaaattaggctaagttattgtgcttaaggaatatgggaaaatatcaatcataaagcatatgtgatgaagcagtttacaaaatgtacttaaaatctttgtctactggattaaacgaatccatgaagaatataacaatttttggaaagataattggtgaattagagatattatttcgacaaaaaaaaaaaattactgatttggaaaatgtcatcaaactaacttatggtactgcaaaattaggccaagttattgtgctcaaggaatatgggaaaatatcaatcataaagcgtatgtgatgaagcagtttacaacatgtacttaaaatctttgtctactggattaaacgaaggagctgtgtcatattatacataaataggatacctgtcttcaccaacacagtaaatccattctcctttaggggaaacacaggctgcaacaaagtctccaccttctcttttaccagatgagaagctcttcacaacctatcaattgacagagaaataatgatgaactcaattttcataccttgcaattagatcctaacatgctgctacaacacttcattgtaaaaactgatgaaaagaaatgagaacaagtatagcccaaggttctccaaaccgcacgtaagtaaatatccacattcaggcagcatgaatatgcagaattacatatatacttatccttgtcagaacagacaattcattaagaaagacaatgccaacatcaataattctaatataaagacactaatgaaataagtataaacaaaataacttccagtcatccactcttttatgtatacctgtccttgaagtgtcatgatatatatggatgacgttttgttacaaacaacaatgtgatcagtattcttggggaaaatgtgaacagaattgacagaagcatcacctccctaacattccaaagaaatcagaaattagaaaaatgaacaaatttgctgggatgacatcagaaaattgaatagcaaaacccataatagtaaatttttgaagacacactcttaaaggaggaggtggcttaaaagtttgtatgcagtctgtagtcttcacatcccagacctacaatatggaggaaaaaatacatctcttatgaacaccagataaacaaggaacttcaagtacaatgccaagtaacagaccttgattgtacagtcacttgaggcagtaataacacgactcccatcatttgtaaaaattgcatcattcacataagatgtatggccacggaactctttcaacatctttccagatttgaggccatgaattctgtattacaaaaaggggaacattttcacttaacagttgctagcattttatcgttaagatataaaatatactgcagtaataaagcattaaagatttgaacaaggagttgtgctctaaattaaagaataaagagcagcacataaatgagtaatttcatttccatttctccaatatctctaataagaatcctctcacaagctctagcgccactgtttggaagaagaatgaagaggaggctatgaagaatcggaagtacaagaaaaaggatatctctcacttgaagacaatgaaatgatgattatatagaggaaaaggaggaccattcgtgtcctttcagcgcaacttaacctttccagatagttagtacatgacaattatatttggtagatttattttagcatttgaaaagaaaaatatattgcaaccagcaaccaccatgctttcctccattggccgcactgtcaacccaacatttgtatggtggattttaggcttgctactatctactataataatgccaacttctaatcactagatcattcatgctctgcttgttaatttcaagcctaaattttatgtcaggtgagctaatggcttataaatggttatctctaacaaaacaacgttaaataagtaaaattaaatgaaaaaccttgctgtgctgtcaaatgaagtgcttaataactggcttccatcacgggagaaggaaacacttgtgacaccttgagaatgagcacgttcaagacgccgtaagcactgaccagtcctgatacgccagacctaaaatgatatgtgaaatatacagttttaagttttacatattaacatttccaaaaacagcaagtcagcaactacaacatcgacaagaactgaagacagcaaaaattcaaggaaccacaagataatgagacaaagtaggaccatatgaagttataaacacaaatcatagagtgaaatggaatgcaagatggcccaacatgcacaataaataatttataccgcattcatataaatgctcttttttaaaaaaaaaaaaaaaaaaaaagaaagaaagaaaaccaataaagacatattcatcgttaaaaaataaaaatcagcctagacacaattaccactaatctaagacttaatttataagtcaataacaacagtcaagcataagggaagaaaaagacagcgcagattatcacccacgtaaaaaaaaggcatgcaagacaggaaggtgggactgactaagctatgcaaaatagaggtgacagagcaaagacctgagtacataagctctggctgccaaaaaaaagtacaggtttggccaatggccagaaaacactcgggttgctgggtggtacttggtagccagaaaagatgagggaagaatagggaggtgtaaatacagggtgcggtggctgggttttctgtatggatgaagggatactaatcctaaaatcctactgttgcaaaaaatagtgtaaaatcacaaaaatctccctacaaaaatgagtggccaatgccgtaaaagggtggagggtgggcaaaatacatgatttcgccactgcctaatgttgcagccactttacaattttgtccataaaataccaccatctagattgcaatcagtgcaaagcaaaaacacaatgcaagcacaaattaaagctaccagaggccaatcttccccacatcatcactatactattgttgcacaatttgacactattcactattaacccatgcttcagtcatacaatctaaatttcaccaaatgaattttgtttggtagctcagttctatttcacagaaatagcgaagttatatgtgcagtgcactccaaaggagcattttagacaatcctctttttgccatctacgtgggaaagctttatctaggtggctaacttggtggacagccttaacatggtgtacttggaatcttagaaaccagatcctttttcataatgaatcctttaacggccacaaacttttggaagatgccattttcttttgctggtcttggctgaggaacctagagaatggttttgatacccctttccattattggtctagcaacttgagagagtgttttgtacctttggggaggggttaatttacatgtatttcgtctttggttttttctttttgcgcgatctgtcagaacttcgtcggctttggtataaagccatcaaagttctgtgtagatcccgctgttttgtatcttcagcagtactccttgtactgttttatatatatatatatatatatatatatatatatatatatatattatctttgctgatcaaaaaaaaaatatgtgcagtgcacaccttgaaaatataaaaatctacaaaatcaagaatacaagaatttcttctaaaggttagctcatgcagccttaaatgcagataagtattactcactttaatctttccatcttgagacccagatgcaagcatttctgaatctctgctaaagtctacacaaagcacagcatcatcatgcatcatgaacacttcctgcaagttcatagaatcagaaaatgtctaaggcaaagacttttggtaaactataagaaatttcctttaaatcgatagtattaaaattcttagacagcataaatcaagcagatatgttcacaacttcatacacttactgaacacaaagtgaggaagagacaaatcatcaaaacaagacatcgtatcatgaaagaaaatacaatcacatgagtaaaaggagtaatctgtgcataaatttatatttatatatattacagaaccaccaaactgtacttaatgttacagtcaaagttgaaatagttcctaaaatgacaacagagatctgagtgaaatatcttttctacagcttttaatgcagttataaacgtaaaggtaccagagtaacaaaagtgtttggtaaccttggggctaagtgaatcttaccaaggaaatatatcagccaaatatctatttccaaattcatcatcaactatcacatacaagacatttatttattcttggcagtaaagccattcaaataaaaactcactcacatcagcttggtattgtagatctttcttcagctttccacttatgtaatcccacacctagaaatatgtcccaaaaatcaggaagaaaactgttgaaaatgaaactttaaactcaaattatgtatacctcaataaacccatcaactgagcatgatacaagaaactgcccatccggtgaaaagcaagcacattctgcatgactttttgtcccaaactaaacaagcagacacaaaacataagggtcagattatgcaagcctttaaaaataataagacagggaaaataatgatgaataacaaatgtcatatgaaagaaaaatagagaaatggtcagattatgcaaccttcaatgtgatttggcagaataaaactaatcaagctgtgaaacaatgcctaaatgaatatagaaaacatacctttatcgtgtgagaaagagtcgttggatacatgtcatccacatcttgtttcatagcagctgttccacgaaacaaatcaaactgcgttcctggaggaagtaaccctgagaaagcccaaaggaaagcatagctcaatcagctcaatcaagatgtaaagatataaattttcctacaaatagcatcatgacaacctcttagaatgtgggtttaggtctattttggccttatctttagtcgatgtgggacttgggtttttttccaatacatccccttatgcccagacacttttgggcttggtgcgtggatgacatggtgggtggcccgtttgatggatctaggataggctttgataccatcttagaatttggatttgggcctaactcaaccccaaaagctagctcatggggtgagggttgcccaccacttatatattctatcttggcctgatctctagctgatgtggaacttggatttttttccaatacaaccaaacatgccttataagcactacttaggcagttatgccatatcactaagtgatgcatgactaaacacagctgctcacgccacaaagaaggtgttggaggcttcaatgaaggcaggcttagagcgaccataattaaagcggcttgccaacaagaagtttcttttctgcttattattagagaaatgaaagatgcatcatgcatgcatataactgaaatattcatttctagcatctataagttgcagaaatgaagtaaaggctttgtcctggctcccgagccaaaagaacaaaaaataaataacacagtgaattgcataagaaacacaacaaaagaacttgtaagcagatgaccacagtgatgataaatcttaattttcatataaaagttgaccatgaaagtaatttattgtggcatcaacatgttaccatgcaattaccttgatgctgctgccacttcaaagcctgaccaattaaagccatcaatcgggatggtggcactacagtaacttctgctgcaagagctgaaaatgcaatgaaagagaagttattaaagtaaaaccccccaaaaaaagataaataacaaactgtttgtctgtatccctagcaatggaagaagaaaactttcatttccaatcaagaaacagttgttcattaaaataaaaagtaaaaaaaaaaatagtatcacaattagatagtaactactacaaaagtaaaagacagaaaccttgggctatttgagcacgtcgcttctcttttgttgagtcttgataagcctgtcacataggacataaatcataaacccttgtgcaaagaaacaaaatgaagtccaataaatatcaatcctgaggacatggctagaaataaaactacaaaagtcataattcattctataatactcattattccaagaacagataataataagtgttaatgatttttttagtccttgaaaatttcccatcagagttaaagctgaatgatcaaacaattgtaacagagtgcagaaacaaaatagaaaaaagggaaacaagcaacaagttgcttaatttagacaacaatcacaacatgaaattgaaaaaaaaataaaattatagaatgtatttctaacctcatttggatcaaaataagttctaactaggagatgttcaagacgcaaatatctttcaggctgctcttgtttcattacacccatcacctgtgtttgccttaaaatagcacgtgcagtatccagttctcgaagttcaatcatttctaatacaatctgcaatcatgttaaaatacaaatctatttgaaacatcactaacttgactgaaacagacaacattattagagtgttatacagatcaagtgttacagactacaagacaagcgtttatgaatagcaaacagtcaaacactgctgaacaacaattcctgaatatcactttatttgtattggctcagctcaatactcttttagcctaatttgttagcatcactttcaaagtgaagtgggaaaaattgattcccagtagcctacctcatttggcaactatcaagcattctcaaagacaagtgaaattttttaacttactccattgacaagaattgaatccagatgtggggcacaaataattatttatatctatagttaaaaaattattatactttgccatctaacaaaattgtttcttctcaactcactcttaaaatatcacttgcaaatacaaataatatttttttaacctaaattgttccaaaataaattctttcagcatcaatttctaccaaaattaaacaccttttattccacccatgcggagagtggaattaataacttaaaccagttattgaagtccttaagattctctcttttttgaaataagtaattaacacgttgtattttagccaattggggggggggaagaatcacacatgaacagaattctatcccaaagtagagcaggttaaaaattattaaactacttatatagcacagaaaatattacaactcccctaaaatttgaacagcacataattaaaaaaaaaatgattatgcacttaaaagctagtgaaccagctacacaaaaagcaaatgtcaagaaaatgagaatcaacaactcaatatctgaaagggcaccatgccagtagctactacttgctaacactaaccagcaactgagtttaggttaggcagattgattaacaacaacattcatctaggaagattgattagcaacagcattcagcatttcctatgccaactgcatcactattttgaccctcaccagcctctatttcaacatttcagcctatcctaccaaatctcgataactccacccaacctcattgccaaattaaaatttaaagctgttcatataaatgacagggtttaaaagccatcaaaaagtccatacccagcattgaagtttgtgattgagtgaacatacactaaacagtgacaagccataaaccaaagtgagtcacacgcagcacaaaatacctgctcatacaaatcctccaacttattcctgggaagcttgagttgagaaacttgaggcaatatcgcatcccatcttccactattaatatcagcaacaaaggtttcaatgctgtcaacagtgttaagagaaacctggcattcgttctgcagcatctgaaaagtctgatgcaacgaattttctttgcaaaactgaagcacaattttgatgacactgcgaaggggcaaacaaaaattgaaaattacacataaattcaaaagaaaaaagagatctattgtgcgaaagaaccattaaacgagcttcaattagacgtcaaacaaaattgaaacatgtgattcagtaaatgaagaaaattaaattcctatattcaagagctcgcaaatgaaactacttactcccgagcttcaatttcgagcgtagacattgctgctatatcgattggacttacaccaagatgtctgcgtagggttttagtgcagattcaacgaaactctgttttatgttatcacttatcacttccaacgttcttctcaggccataatcgcgttactgacgttctttttattggaacaagtgaacaaacaaatcctatttgctcctacttgcggattgatctgggtcgtcaaacccgatagcccacatgggtagggttttaggccttgttctactgctagacgggcctccctgccttaggtgggctggcctagcttcttgagggatgagttacatacaccattattttttcttatacatcattcatgaataatgcctttccaaaattacccttcgcttttttaacgcttttatacacggatacgtaatattgatacttacggattcgtcaatccgtaagaattttttttttacatgtacggattgggcaatccgtaagcccaatcagtttattttttttatatacggattgggcttacggtttggatttacggattgcccaatccgtatataaaaaaaaataaacggattgggcttacggattgcccaatccgtacatgtaaaaaaaaattcttacggattgacgaatccgtaagtatcaatattacatatccgtgtataaaagcgttaaaaaagcgaagggtaattttggaaagacattgttcatgaatggtgtataagaaaaaataatggtgtatgtagctcatcccgcttcttgatggttttctttgtatcacacacccaaaacaagaaaaatgagttaaccatgataaagattaattttataaaaaaattatttattatttatttttttattaatttttttcttatatataaaagaacctagataataattataatatgatagagagagtataagagaagtgttattagtatttattaagactctcttattataaatattgattatatagagtgtgttgataaactaaagacattgccattttaatgaaatattttaattccttcttttttacaagacaaatatgccatttcaatattggaactaattgtaatgaattaataaaacattaattatggatatgacatctagctcaattaattttctcaatacacacacgtggcatatcaagtaagaagacttttattatgagagaataagatgtgtgaatcttagctatatttttacttgtaattttattaaattcaggaaatacatttatataccagtgatttttttatttattatgtaagttcgtcattgtatttatctatgattatatgatccaaacttatttttattatcctcttgtataaatagagagacccacataaatgaattattatttatgtattgtagatagttttaatgaatactcattagatttgggtctaattattttaatggatacttgacttttgcaagcacgtatagctcttacataataccttttttaaagagttatataaaacttaaaagcaactattatgacttttatttatattacagtggggaggctatggaaaattaaatctccaattaatggcaatatgtatgaatgtccggtgatagtgaagaaggaccagatacaggaccacaaagagcatccatctaaaactaacaatggagacaaacaaaacaattcaaatgacttggcacaacattaataatggaaagataatgtactatgagaaaagtgatgccgagggaaaactaagaatcgggtaacaactatagtatgattattgctgtattaaaaagaattaaattgcttggaatatatatcgatacaactaaaatatagtttgagatattttgtcaagtttataatttttttcattttttatgctgatgtttgtttttattttatactcttatgctgcttcatacattttgattaataatcagttgtctttatgcgtacttgtactttttttaatgggcaagactatagtgacctgacgacagtactaaactactagcagatttcctttttatagtgtgtataaattcctagttaatcttcaattaaaaaggtagagtacaaattaatgtcattgattatgagttttgtctattcataattttaaaagccataactttgatcctttcttcattggcggcaggttatcaagtaatgatacggtctgatatttttagatagataagaatataaaataatatcaaaaaaattacaataatttatacatcctattccatcaactaaatcatacatcttgaccaatacgatctggtaggtaatagcgagaatgtagacttaactcattattaacttacaaaaataatcacgagaactgaaaatctcttttgattgaataacttaattagtgaaaaaatactaagttgatttgatataaaacttcgtgatatatatcctaaaatgaaaaaaaaaattaaatgaagaataattatagattttttattttaaaaattcaaaaattataatataaattataggttatataaaaatcctctttaatctaccttttttaagaaaatttttgcatgtaagtccgtcaataatgattggaacaaatcactgttatgaaaattttaaggtgttaatgtgtgtgttttaatctagattatttaaatatgatctaacagtcaatttataacacttatttcttacaataaaaaaatcacacatatatatatatatagggaatgtgtctgacaagagtcggttttttaagagtaaaaaaagtagttttcttagaaattgttgatataaatggtttaacacctagtttccttaattaaggtttaagatttgatctttggtttgaatatagagtcacaactaaaagtatcattttattttaaaatgggtccagaagaggagagataattagttggatgtcaaataaaaaatcttgaatacctctcattaaacaaaaaacaaaaaagagaataattttgaacgatcaaaccatacataaattttcaagattttaataacatgtcatgtgcctaatgatgacatttaccaatggacatttgtcaaaagtcaactctacgcccattgttttatacgtagggtgagagaaaagataataaccagcaagaaatataaataaattatatacatgatgccaagtagagagatagataggtacaatagacaattgcatgtagttagaaaagtcgctatgtgtggaaaagtttgttttgtataatctttgactaaatcatgatttgggtagggatgtttatgagtatgggttaagcgtgaatctgaattaatatgaacaatttaagttaggttatttatgtatttttgattgaaattgttcatatacggattgagtcacaagtctagatttatagatccgttgatccgatttgtcaactcgtaataaaaatataaattttattatttatttatatatatatatatattaaaatttaaaaataaaaaattattttgacaataaaaaaaggtgtggggccgaatgaagagtcagcctataatcatctcatctcattcttgctttgaaggtgcggtattataaatgtcacgggtttatgtttctttttcttttgcacttctgtgttctgtcttatctcatcttcttctttgtgcttcattgcttctgttctctctcatttcatcttcttctttgcagttctacaccagctccttctttgttctctctcatctcatctcatctcatctcatcagatcgatcaagcatcaagttttcctttgcgctttctttttcttttccgaagctttttaacttcccgtgatttttctgatttgtattcattgggattttgatggaaacagggatgagaagaaaagaaataaccttcgttgttgagtgttgacttgaatttttggttatagtaaaacttattgcaagaaattaatttgtaaaaaatagttgtattcaggctattatagtaaatcttgttcaagaatctattgttttaatttatattataagtctattttagaacattatgttgatggtattaaataaatcatttttactattttcatacatttgataatattgtgttaattgtagtggatatttgaaagaatcattatataaaatagtagttttaagaaaaaaatttaaatggataacccgttggtccgaactgaaccaaaccgttcatgaacgagttgggttaggtttcaaaaaaaaatttgaaaatcgaactaaaccaaatcgatcgaatttgattagattggatcctaattttgaccaaaacctattcaaacccctaatataggaaagctttagaaatttaaaaaaaaaaaaaaaaaaaaaaccaccaaagacattatttggcgacctatatataaaagcacttcaacatgcactatcatctataacttgtgtagtttgaaatgtaattttcttgcaaatttattatactaattataattaatcaccttgactgcatgtgttttgcaaggacgaagactaggtggcagtaaaaggttgcctccacttacttttgggtggcttctagtgagtgaactctatcaatttttgttatctctctttctttctattctatagcctcttttaagttttaaaaaaataaaatttgtttaacaattagtccaatgtgttgaatgtagaataaggtatcgttccgttgaagaccttaaaccaaaatttcctcagttgaaaacttaaaaaaaatgcaggaaataaatctttcactgctcttctttttattcatttcgagagtaatttacgattatatctgtaacccagcggagcccaacttaacaatttagcttaataatgtgtattgcatgcacatatacaatatatatagataaaatttaagaaaaatattaaaaatcactagtgcaatagcatgcgttaaaaaattgtagtaaaacaatatcgttacattataatatctgctgtatagagagtgaaacagaagcagttctttttatttatttttacaatgacaacgatataatcattatcacaaacaattctttattctttaaactttgtctcatttttcaaagaaaatggattcataatgatgtatgaatactcgtatatattaaatattttatcaatatctgttttttttatcatatcatatcatatattatatctacattttcttttttctatgtccaagtgtcatctaatgttaggtcatgggtgtcatgaattattatccaaaacaaactatgatcagttggagagagaaatgttgactggctcggtgacttctttataaagagtgttcaacaatcaacatttctagactaccatctacatagaaactttgtagcttgaaatgggttttttcatgcaatctttgttacttactttgctcaccttggttgcatctatctttgttttgcagaaaagaagaagactactagtactaggtggcactaaaagcttgcccccaggtagctttgggtggcccctagtgggtgaaacctaccaatttttgttcaacaagattgaacatttccttcaagagagggttcaaaagcactcctcagagatcttccacacacacattctaggagagtcaacagtggttctttgtggccctggagcaaacaaatttgtctccaccaatgagacaaagcttgtcaaggtttcgtacatgaagactcagcgcaggttcttcaacattcctgatcaaacacatgcacctaagacaaaaccaacacaagaagctgcatctgctgctcctgtgaagatcttggggattctgaaacctgagggaatatctaggtacatggggaacaagattgaatccaccatgcaccaacatttcatgacacactgggaaggaaaaaaagaagtgaaggtgtaccctttggtgaaggcctttacccttacacttgtgtgccaattcttcttaggaattgatggaccaaaatttgccagtgagtttgagaacttgtattttgggatctattctgttcctgtgaattttccaggctccacataccataaggcactgaaggctgcagctgctataaggaaagagatccaatttctgatcaaagagaagattgacgctttgtccaaggggcaagttgtggatgacctaatagcacacgtagtcggtgctgagcagggtggaaaatatgtgccaagacttgaaataagcaacatcatcatggggttgatgaattccggccacataccaatagctattactctggctttcatgatcaaacacattggacagaggcctgatatctaccaaaaaatcttatccggtaatttaagatactaattgtatataacatgacaaaatttaaattcagcttcttagctacttttagtgcagctctctaatcagaattggagttccacgttaataacttatagtaactttttacctaaatctttatcatgcaaattgctgaggtgaaagtctaattttaatcagaaaacaataccagaaatagctaagaaactgcatctaagttttgtctgtaaaatattgtagctattttaaggtggtatgagataaaatatgattttgggtttaagccaggagagtacagtttttgtttttggcttttctttttggactcaaaatgcaagatctgaaacaaaataaggttgacataccacatagccaaatataagtggcagacacaaataaggcccaacagaattatgtatgcttaattttcctttctaaaaaaggctatatatcttgcttacttttatttgaatcagagcatgctgatattacaaaatccaaaggatccggtactgcactagattggaacagcatacagaaattgaaatacacatgggctgttgcacaagagaccatgagactctacccaactgcaccaggtgcattcagagaggcaataacagatataaactatgaaggtttcactattccaaaggggtggaaggtaccttgataaagaaagattgttaagatattaattgaaacatgtaaattaaatttgtcactaacttctttatttgcatttattttcacagatcttttgggcatttattggaacaaataagaatccaaattactttcatgaacctgaaagttttgatccctcaaggtttgaagggaatgttcctgttccatacactttgataccctttggagctggaccaagaacttgccctggaaaagactacacacggtttgtggtcctcaatttcattcacattctcataaccaagttcaagtgggaagttatacttcctgatgagaaggtttctggttcttcgatacctatcccagcagagggaattcctatacgtcttcatcactactaagttttcatgagtgcatatattgtgaagtttgaagaaaatctttgggtgtatagtttatctatcagtgcagattaaatggagaatatgatcaatatcataataaaggtgacaaatgccccaaacaattaaaatgtaaagttggttatacgattatatgtctaaatgtaatgtgatgatgataatgtaataagaatattctcaatgtattctagtcattttttagagggaaaaaaagtgatgttaagtagctattatcatttaacaataagtcatggtccatccgtacgtgcaaaatcctattaataaaagagatattcatatcaatcaatatggtcccaacccacctgaatttgatttgttattgaaagcagcgtgattagtatattcaactaataatcgaaattcattggacaacgagatactggaccacaaattcataaaccaaaagcgacaacgaacaacacgtaggataccccgaaagtcctagaccatgcatgcatgatgacaaggacgagaatgctctgacagaaagaattattcttaccactcatttggcagttagatatgataataagagtataataaattttaatcctatttaattattgtgttatatcttgtcttatatttgataacaatatggtaatgatagatgttaataatgatagtgacaatgatatagtaataactttaaggttgataatgataatgattggcattatagaaaatggtggggttgttggactgatgattgtggtgagagagagagaataattcaactattcttatctattgtattttatctattgtatatatactaaggattgacaaatcatttaatggtgtatcaaataattaattacaacaaaataggataattaacagttgtaaaaaagcataaagatatatatatactgttattatatttgtgctccctatatttattattgactaatttcttttttatattttgctcattttatactttatttgattggaccatttattataatttatatgataaaatatgttactagttcattaaattttttctaagtcggacctcaaattttttttttccatttctttataaaaagatggaaagtgatttagataacactttgaggataaaaaatggtgcatttcaaaaatagaaggacaaaaaatgaaaaaaaaatagaaaatttaaaactgaactttaaaattttagaagaaccaaaaatatgttttatcatgttttatatttcattttcatatatgtgataataaatatatttttctaaaaaacaatatattccaattgactttaagtcctaaatctgtatcttattctatcatatttttattaccaaatggaaccttaagttttggtgagtaaatatattgtgaacatgaagcatttgaaaaacatgcatccttgagtgtataacaatgtaaaattcggcatacaatcatctgtagttaagacaataaataataagatagaatgaatttaatttggatatattattatcaccgtaacaaattataaagtagtcatgattgaattaaattttaagaatattctcaatgtgttcttgtcattgtaaagaaggagaaaaaacattacattaactttagaataattaataatatatattatataagtaattatattctttttttcatttttttttcttttatctcttctttacttatcacattacttattactatatttttcagtttctctttcaaccttttcttttttacttcctatcaatctcttcttctatcccaaattcacttcaaatgcatgtatagctcgaaaggaaaattatgatgaaaaaaatgcaattaagtcgtagtccttcgtacctaatataagagtttttaatatcaattaattgttcgattaatccagacctatctgaatttaattgttactgaaagcagcgtgattagcactcaaataataattacattcattcatgaatacaccgagatactggaccacaaattcataaaccaaaagcgacaacacacaacacctaagacaacccctcaaaagtcttaggccatgcatgcatgacacaaggaccacaagcgcgtgcacacacattttgtagggtgtcataaaattatgtcttaataactttaaaacatgtaaagaagaaagaaccaagctacatttattaataactctttgtataatatgaaattaagtaatttagttattaaattatttaatattaaaattgatataatttagacatttgttgatatatatctaataatggatattgattgatattttaaataacatatctatcgcaataaaatagaacaattaaatatcaattaatttttagtttagatgaaattttataaactaaatttattttataaaatatttcaattcaatgattagattacttaatctcattctatacacgcttttttgtcaccataacattgatgtgaaatatttatcaattttgctagtgactaatatctatcaagaaacttgactaattatcattagtggagtctttttttcaaatcgcattttttaattcactaaatttgaactcaaaatcttacataagaggtatgagtcaaatatcactcgaaccaataatttgtttttaaagacgtattaagtgaatacttattattattattataaaaattatatatatatatatatatatatatatatatatatatatatactgtcatgtgacaatttttcttatgaattcatttttttcctatatttcaaattataagggtaatttataattgtgcatgtgtattatatttaaaaatgctactaaaaagttaacacttgtgaaggccatgtgtgaagggcatggatctaatcaagaagaaacgatggtccataaacactccttagcctgtgctaacgcttaggcaaagtagtgcaagaacccacgggcgtcccatctaacctcaatgaatgcttccacttggggaattatggtcagttctccgtaatgtccaattgaccaaaaaataccaaaaggaccccccacctgttgattctattcaggcacaacaattactacaccacgcccttgacaaggaaagaattcaaagatgaaaaaccatatgtattttgtggtgtaagactgaagagaaataagggatgggaaaaagtgagagagagagagagagagagagagagagagagaaatgaaagatatgaaagtaatgtgatataaatatcattgtagacaaaatttataatagagcctctgcattatattattgaatcattatacggtgaatacatgtaacatgtaacgaatggactacatgctccctaagaaaaaattccccagtgcgaaatcactggagtaaaagaagaaaaaaataatatcaacccctattctaagatatagaagggcagctgaaatggatgctgtcgaggtttcttctagtcttctgctatgttagaattctaagtaattcaaagtactgcatttgaaaccccgtaaccatcacgatgagatttttgccatctccatgcaaccttcaaactctgttgaagatcagtgtgcttagcaatccaattcaattcatgtttgatctttgtcgggtcactgtacacctcagcataatcgccaggacgacgtggaaggtagtctactttaatgtcaacccctgtggcctttttacaagcttccacaaactccttcactgaactacctgataaacataacacccgtgagaatcttgacacaactaaggtatgagctaaactattttactacaaagaaatgtacaatggtttaagaacattttccagttctattttccgtttttactttatctcttgttttcagatgttaatacagaaaacagtgaaaaaaatgttttgttgttttagggggcgtttacttgtgcttttatttcttgtcttcatttgctgttttcattgttaattataaaaaacacaccttgtttttaatctgttttcaaagatttgtacaggaaacacagaataacttttttttttatttacctcctgtacaaatctttaaaaacaggaaacagatttaaaacaagatggcaagtttggcccttcaatattttcactttttcctgtataaatatcaagaagcaggaaataagtgaaatttttttttttttttcaaaattaaacgacccctaaagtgctatattcatgatcaaagtgttttaacctaccctttccagtgccaacattgtagaacccgactttactaggttgcgccttttccagagctttcacatgagcatcaaccaggtcagttacatcaatataatctcgtacacaagttccatcagccgtcttatagtctgttcctcttacctgcaaagtggcagcacacaatgagcacacctgcaagtactacatgaaatgaatttgataaaattggacaagttcatgacataatcatctagaccatttgagcaagttgtaaataataagtataagaaataagttattattgacgctcaaagatttccatgtaccataaaattaaacgtttaagcttacaaaccatttccaggacttgtatgaccaaattcttttcagattttgtataggagcttacaaaccttttttctaccaagttttcagcataaatgaaatgcaattgcaacaacctctaacggttaaaaagccatagatgtagtattcttcaacgtgattggcaggaaacttaggactaagtcaatatcttatatgaatactaagcaaattcaaattaaatacataacagctcgagtttttcactagcaagaaaatatgaacattattctgatgttggaaaattcagttaaaaacttatattctagactaaatgtatggaaaagaaaattagaagatttatcaagagtttgatggctctgaaaaatattacgcctaagctagttgcctcatattggttcaattcctctgaaaatgcataatatatgatgcactgtaatctccttaagaagagcaatttccgatttttgtaatgaagtaatgaaatagaatgatactaggttctattgtttggtatttgaaatagaatgggatggaatggaacttgaatgaatgcatttgaatccattccatccaatactcctgtttcttaccctctaatttggggggaaggggaggtgtcatgtgggaggaactagggcttactttttcccccattccaagatatctaaagtctaaacgatgaagtgtgaactttttaagcccatttcgctccattccattctatttcacttatcattaaatatccaaacatagcctgacttctattgagaattcctttttagccataagcataaatggaatgggcatacctttaaaccaggtacaataccacgagcagcatcaaagcaggcacccgatattcgaccttgctctcgcagttcaggcctaggagcctcacccaatcttccctcagggtctgatccaatcacattgaagtatctggtggtttcccaaagaaaagttaccaataattaccagcatagataattctgaaacatcatcaacttccaatgattggctatatttcatccacagtcaaacctcaaactgtacatgaatcaattgtccaaacaacatggggtagacagttttgtaaagccaacgaatccaaatacaataatgtcgttttttctttttgattgttttccacacataaaggaacgtgtcagaagctccataatttttcccaactatgcattgattaaatggatcattttgcaaggtttccatatatttcagatatagttagaatcacttacagcttttgcaacaaagggcaaatggaataaaaataagatataaaaatctatttaaaatgaagggaaatgcaaatccaaaatacaaacctcagaatcattattgccatttcagagtttttagaaaaatcaagaataatatcttctgccatcttcttggctttcccatatggatttattgggacctgatatatagaaatagaacatcaattttaacactaaatctcctcaagcagtacagtcaaatcaggatgcaatgaaaaacaaaatattctcaaccaacccccataattcaactatccttagattcccacctgctttgtttcttctgtaatgggcatcttctcaggttccccgtatgttgcacatgtactggaatatatcaatgtcttcacatcatgtttagccatagactccaataccaacaaagtgtttgatgtaatattgtgataatacctggcaaacatgcgaattagaaataaattaaatctataaagtaaaaccaaagttgatcaatccaacactaaataatcattctcataacaacaatttgttcaactctcaacaaaatcatatctaattacaaagaatggcaatagcaatagcataatgcaattcatagagtagcaattgcaaatataggtacactcaaaccaaaaatatcctctagataaagatgattttcaaatggtccaacttttctgttattagtctggtatgcattgtaaacattatgtcaataagaacaactatggtttgtctttgaagttcttatccataatattgaacagtaaatagaaaaatatattatcttgcatcacagtttgtgggactcaatgcgtgacttaattggcaaagccaagaccataatagaaatctctgtgccagttcaaataatgtttaaaatgtcaatgtgtatctaaaagaaaatgtgatttgtggtactaagatatagatggtgaaaattagaaactgaacacaagtgccacttccacaactttttcagctgagataaatgtgacgaacaaaatctagaagtgttagaaactgaacataagtgccacttccacaactttttcagctgagataaatgtgacaaacaaaatctagaagtgcttacttaagaggatcaacagtgctttctcccacatatgcaacagcagcgaagtgcatcacggcatcaaatttgttctccaaaaatattttattaacctgataaccagtcgaataaactatctttcaatggccttccccatatatgccattaaaataataaaaaaagaagtgacaccaaagtatttcttgtaacaaagtgtgtaagcatacagatattggatctcccaagtcagcataaataaattgaagccttccaggttctggaaataagtcttgaagaaccttgatggcccccaaatttcctcgtgacagattgtcctgccagaaaaaaaaatgttatgtatgtagcaaccacactgatcagtgcatttagctttaacagaatcatctttatgaattgacatactactatggtgacacgataattctccttcagaagtcgtagagtagcatgtgaaccaatatatcctgcaccccctgttactaaaacatgagtgactccaggttcgtgaactgcaaactgaaaaaggggggagaaacagaaggaaaaaaacgaattagaaatagctagatgaataaaagagaaaacagtacagttgacttattacgcaaaaagattgagcgagagaaagaagagaattataactgaaaaccactatgcagtaggtctcgcaaatttcaatggcctaataaatgtctccagtctctttgatgaacacacaaattcacaatgaaataaaatatgaaagattatagctgtcaagcgaaaacattgtattcatgtgtaacaggatttatacctaaatctcccaagtctaattgttaggtacaaatgtattataacatcaactacaataaacaatataatctaatctacagatacacgtcatacaacaaacataacacatgcactaacatatgtaggttgaccatggtaatggtgtatggcattttaattgtatcaatggtatagggattaccggactaggggaattcaaagatggagaccgcttgatcatgattatgcatagtgttgttaataccgcagcaagaaatactttcccaacaaaattccccttcctttttggatctgcataatccatgcctaaaggacagaaaaacagaaactacattttaatacaccaattacatgataagtgggggggaaataacaacaaacacaaaacaaattacaggacattgacaattaatgaattcaccaacaccttatgttgtcaattcatatatctgcacccagtctatcctatagtcaagtgttaaaaaaagtaaagttttccaataatctaatcccattttcaaattgattaatactttaagcaaccaaacttcattcaaaggagaaaaaaaataagaaagttgatcatactaccattcatgatcaaattttaggacagaataatacctcccattgttgtagctctggctgcccttgactgatttctggacctgccaaaatttagcatttgcaaaatccttattgtttagtgtgttgaatgagatcttattccttaataccaacaatcaaattaagcttcactccccagacagatcttgagagacatcctgcagttaaaatcacaccacatgagatattttctcctctaaaatgtgaaacaacccaaagaagtcaaaaatgaaaagccaccaaacaaaaaatttaaaaaacaagcaaagggttgaccccagaaaacacagtaaagtaaaataattaaaaaggataaacattaaagcaaaaatagcaaaaaggaagggggcaaattaagccaatgaaaaaacatagaattcaaataaccacaacattttagccaaatgaaattaagccactgcaattcacaaataaattcaaaactgaaatatggtcaaccatagagaagacatcaagaattccaagatccacattaaacagtacaagaacgaaccaataaaaaatttaaaacacacacacaaagctaaaagttaggctctgcataactcattattcatgacactaacaaaagacatgcaaaccaaatcgtttctcagagcatgaaacgcgaataaggaaacaggggaaaaaacgaaccccccaagaggaccacattcccatttaacaactcaatgaaaaaaagctgcaaattttgaacaaacccagaagactccacagttttaagatccaacacatgacaaaagcgaacaaaaacccatcattaaccgtttcagctcaaccacacttcaaaacaacccaacatatagtaattctggagcacacaaaattcccagaaaacaaaaacgaattattctaagcttaaataacaaaaacgaagtccttcatcagaaccagacccaaagccgcaatcataattacctcaaaggaaaaacaatgaaaaaaataaagacacgagctttcacagttacccacaagatcttaatagaaaaagagagagagaaatttgcagagctgcaaagaagaggagaaaaatgtgtaccagaagagaagacggtggagagaataatggaaaatggaaagatgtagaaaatggaaagagagttgcacacgaatattgaagggtccaaaattgaaggatagtcctgagagccttgaatatggatgaagagagagagagagagatagagaaagagaagagagagagtggcggagagttctgtgcgtgcagtccatgtggtcgaaacgttagagggagagagaagagagagtgacccgaccctgtatcaaaggaacaacaaatcataggacttcttttttgtttttgtttttttcttaatttctttaagtatatttgtttttaaattaatagagtttaattgtagaaattttacaggtaattaattaattaaaatttacgctaagtatgatttgtaagataattagtagtataataaatttgttatacataatagaaaactattagaattggttaaaaagtgaaggtttcttaattggtaaaaatcaaacagaaattatctataataacttaaacataagtttaactaattgaattatatccgttaaatcttagttaatagtgaagggtttgagtattaatataaacctatgtttgatcatcattgtgtagaaaatgtgattggatcatttatattgatcatatataagttacttactctttcaaaagtttttaattttaatattatttgtatagaaactttcattaaaaaactaagtgataattattttatatataattttttaaaataaatatataaaataatgtataattaagtgttattcaattcaggttggtctgatcggttgaatcagaatttagttgtttaattaaattgatcatacaattgatccaagataactagactaaatccaactatgtaggtccttggatcatatttgaacaaatctgatttggttaatttttttatttcaaattaaaattttgaattttttttaaaaaaattaattttagattattattaatttgtattttagatcttaaaatatcaataaatttttctactcaaataatattaatcatatacttatttataatatatacatataattttaaatttttaatatataagatcaaattaattcttttgatttattagcttaattgaatcaattatagaatttcacaaaaactcgaaattgcaacagctttttgagcatccaattatgtggtagcacttgttgcgtactatctgcatggcatcatatcatcatcattcatatgggacattgtttttctactttgggacctacgtgtcccatgaaactcaactttctataaccaccggtttctttccattgcatcgcccatctttgttcatttcagattaatcaatgattaatgatgatatattaatgtttatgactattcttcaaatataatgtttgcttttttgttaacttttgtattgattatgttagttattactatgttgattatggtatgacaaatgctaataaatgcattcaatgcgttaattaagaaatttaaaataaattatttttattaaaataaaaattatattatttatatttttttatattttctataatttacacaataaatatttttttaaaaaatttaaactaatatcttaaagatattcattaacaaatcccttatggtattagtatctctgttaaatgaacctctacggggaaaaaaacttgtccacggaagtttggacgaagaaagatatctgtacatcaaagaaaatttacagcctaactgaaggtgaaattttttggtagtaaccatggagttttagattagaattttaatgatgattataacatatatatatatatatatatatatgtgtgtgtgtgtgttgtttttcttcctgtttgtttgtacttcaacgtttgttccattcccacaaacatttatttgaaagattagttaataaaattaacgagattctacaaaaggaaagatcaatgggattaatgagaaatgtggactttatattactatttttttacgggaactttatattactactgtatagacatataaagcgaaataaattaacatataaacgattttgttatttttctccgatttaagtaaacaataaggtgtggcttataatttttaaagtatcctctttgaaaaaaaataaagtatcccacgtgcaaggcacattcaaattttttaatctttactttattttctggacagctaaaagtatcacgctttcccaccttttttcaaattcatgtgcaaaaaataacacatggccaattaatttacagagttttttattttaacaaaactgatgcagaatatatatatatatatatatatatatatatatatatgacagatacagacttcttatataattgctactggttcattaattactccaaaacataggatgggaatttttgtgtgccattggtcccccaccgtccaatctgtgatggatctcttcatcctatattcatattagattattagtacttttttttgtggtcggttacaaacttacactttctccacctccttcttatatgttaagtattcacttattagtaatcttctaatcaagtatcctttacttcaaaaaaagttaaagaaaatttaatattatcacaagaaggttggtgcctcattctcaatcatatgaaactaaagtacctttcaagttgtcaagttttgacagtcaattttttctcacaggaatctaaaatggtattaaaaaatttataacactcgtatattctatttattcaactaaactaaattcctttgatgttttgcaagcaagtgaagtgaaatagtcacgcataaatgattttgatataatttttgttaaatccaacctcgctcatgtaaaaacaatattaggtgattctgattatttattttagaccacttaataatacatgataaactattaaaataagctcgtatcaaataaaatttatttgatcaaattattttgtaaattagtcaaataaacttataaattttctgaatgttgtcgtaccaaatacatcctttttgtgacagtaaaacatccttcgtaatagatggcattttattgcacaaggaagaagtttagttgtacaacttgcattgttgacatcatcatgaacttgggtaaatagtcaactatatggagaaaacattagatgaaacgctacgtggtgctttccttgtcaaattaggtggactttgaatttttaatatcaagctttccaccaaacacggtgtgaaattcaaaagcacagagagaccaattaagagaaccgtgtgtagttaagagacaactcactttgccccacatgcatgttttttttgcctttgaacctactttactttaatatgcatactgtgagttgaatccgtcggatcaactttcccaactctcactttttttttttttgggttagattgtatattagtccatatgtatcaacattaattattttttagcataattgatctattagcttagttgattggagtaaagggcggatccacaaaaataattaaggaagggcattagtgatgggagtttggggacagtgctttcgattttttttttgtaaagaatatttaaaggaacaaattattataaatcataatataaaagaacaaacaaatagtcagatcaaattactattttggattgaatagaataataaaaacaatcgatcaaattgtttttactagatacaaaactttaatatagtttctttttttaataaaaagatagaattaaaaatttcgcctttatgttttatggtgatcttttatccaaatctttattatacatattaataaggcaaaactccaattctgattgaaaaatactgccatgttgcttttgattttagtaaattcaaataaaaagggcatgaactttgcttgatgattcagggtccaagaatttcagatgcaaatcccgaactcttcaagtacttcattagggcactttgcaatgccaatacttcaaaggattactgcccaacagagacatgtccattccagaagtgtatttgggcatgcgcttcctacaccattctccattactcatacaccatttttacacagtgcaattcccattatatccttttaattttaaaatcatttatataattttttttaaacctttcttcctccctctcacccgcaacgtttcttcttcatttttgctgagcgccttcctccctctccggcaagcaccgcattggcttccttcttcttcccgttgaacgacactggtgagtgattgttgtgcgccttcatctccggcaagcaccgcaccgcattttgccgttcactcctgttcacaccgcattttaaaatcattttgccgttgaacgactctagtgagtgatttctttcgcaattcgtgcaaatggtggtgtttggagggtgttgcaggtcgttaatggcggaatcggatccggtaatccgttggggactatcgtacggattgggtgatccgtatgcctcaaatggattgggtgatccgtatgactcatacggattgggtgatccgtatgagtcatacggatcacccaatccgtatgagtcatacggatcacccaatccgtatgagtcatacggatcacccaatccgtatgagtcatacggatcacccaatccgtacgatagatacggattgggtgatccgtatgcctcatacggattgggtgatccgtatgagtcagttttatgcttttaaacttgaaatttttagaattaaatgaataatattgatgtatttttggaatgtatgtgcctgtgggtgaaaatatgtagtttattgagttgattcgattaaaaaaggaccatgcttgtgaatgccgcttgttcaaaagatttataggttattttgatgagaattgaagttgtttatatggtccagtgtgcaaggcaggtgcagaacccataaatagtttggttttgattacaattagacttgagtatttggtgtgcttgtgaagtgttgttttgaaatcgttattggttggtttgcgttagtattggagtttgtttggtatgcttgtgtagcgttgttttgaaatcattagtggttggttttgattaggattggagttgattaattggtaaggtggtgagttgcagttgttgaacccattgtaggttggtttgcattagtgttggacttcgttgtttggtatgcttgtgtagcgttgttttgaaatcattattggttggttttgattaagtttggagttgagtatatggtaaggttgtgaattacagttgttgatatggttgtgaattggacgtcttaattggacttcattatttggtatggttgtcaatgacactagtattcattgatgttgttgaaccaatttttaaaaagctggaaaatactgtggatgcagattatggctaggacaagaggaggaggagtgcgtcggccttttggtcgaagtcccgatcgtcctgaagaagcccctgagcggcgtaggcctaccgcatctgtccgtcgtcagagggcaggtgttgctattcatgatgatcatcctatgcctgagcctgagcctcatgtggatattgctgacccggtgatcgacgatatggacacagcttctgaatcttttcccggaggtccggaagattcttcggtgcttaccgagtttgccgaccatgtggctctacgagtctgggcaggagaggtatgttcatgttcaactacatagtccaatgtgaaagtcatttggttacacaataatgatttacgttaaatgatgtcttcaatgcaggaacgtccagagttgaagcttgcttcccatggccgtaaggtcattagatttgggaagcctgtaccggagattgaaggttttgtcgcagctactgggctgactccattgattggatgctcagtggagactggagacagggggttgctatccgcgtttgttgagcgatggcaccccgagacatgttcatttcatctgcccgtgggagagatgacactgaccttggacgacgtgtcatcactactgcatctccctgttatgggcacattcgacacgtacgagcagttagacatcagagacgcgatcaggttgttggtagagctgctcgatgtgggtgtacaggaggcatccgctgagacgacacagtgtcacggtgcttatgttaggctatcatggctccgggatttgtattatgcgaaggtggagtcgagacagtggatactagccgctagggcatatctacttcaccttgttggatgcacgttgtttgccaacaagagtgccacacatatagctgtggcattcttagaggctttcagagactttgatcgggctgcaggtcttgcatggggtgttggtgcccttgtccacatgtatgagaacctgagctacgcatgtaagcatcacgggaaacatcttgcaggctacatctctctattacaagtaatgtccttgtatgatgtctgtaattatcacagtttattggttgcagatgtgttgtttgcattgtttcctgacttgtattgttttaaatttgtagtgctggatatacgagtattttcctagtataggaaatgaggttgcagatgagcaatacgaggagagggaacctcgtgcttgcaggtggaagagcgcgaaggccttaccggtgtcaacctatcgtaaacgtatagataggttgacaccgtctgatgtatgctggacaccatatggggagcaccgtgcccaccgggagtttgaggtcatctccatgtattctggattcctcagatggggtcctcatctgactaggtacttaccggagagggtggtcaggcagtttgggtatgttcaacagattccacccctgccatcctcagatgttccttccagtgaagaagtagatgatacgtggacccacttcatggaccacctgctgcccaccggagagttggttgattatgcaggtcagtgtggtgctgcatacatggggtggttcttccgcatttcccatccattcatgaccccatcccggtatgaggaggcttatgcccagattccgccagtgtctcagcctgcaccctcccatcctgcaccagcccagacctcccatcctgcaccagcccagacccagtcccatggtgatgtcgatgagcagagaccagtacatgccgtggtaagacttgtttaaattgttcatttcaaattgaattaacatttattgacaattgtttatttttagcatgtgtgccaacgtgctgctgagggcctccaacatatgcttgacatgaggatggttacagaaggcacagatgcatactccatggtagagcaaatcctgcatcaccttcgaggtgtgactgacgatcgcattgtgtacacccgagctagacggactgtcagaccgcggaggaggccttccggtgctcgtgattgacatttatactgagtgaattttgttatttgacatgacagaaaccatgtaattattgtgtagttacttataacagcaatgtatgcaacatatttttaatatacttcgcattatatatcattgaagtcatacatttgcattgttaaaccagtgtttatacatctcctaaatcaacatattccgtgggcaaccgcatcgatttaatatacaaccgcattcgatcaatgtaattatacggccactgtcgagcttcctgggtacaatgactatcccacaaacatgccgtcaagggtaaaggacaattgtctgccaaagtaacctgatttaaacaaattgccatataaatcattaatctatcttgaaaataaattcgacatatgaaaatgaaacacgttatgtcttacctgaacaaaatggtttccaaaaacatgaccaatgcacaaaattcgatgaactcggggatctctaggcggttgacttcttagagggaagaacgtcatactttgctgcagtgacagggatactacaatcatgttatatcttgatgcaattacatgacccatatctgtgatatccatccacttatccattgtgacctacaaattatcagttaatcgaatatattatatgcatgtttgtacagagttacgttaccccaattcatgtgaaacaaaaacaatttaatcataccttcgacattccatcaactagtagggaccgcttgatcttctcaaacctatctataccaccaaacaacaacacatattgatcagtccattgtgcaagttctttcagcagatcattgcggaccaaagaccaagcgtcttcaccgtaacctataaaggcagcaattactcgatatccacaattaccatcaggttttacatcagttatgtcaacaataaatttctgcatgaatgggtcaaattgattgagcattggaaccctccggtttttcattagaacatcggaagaggaactggactgtttcggggtagaacagctattttgtacagagtgtaactcatccacatactcgaagtaagacgggtcccttcttgtagaccgttcgtgctttctgacattcttcttctgagcaccttttgttttgaccttatcagggggaggacacatggaattcttatcagggtatgcaatctcagacagctttgtctttagtgccatttttccacacaaatcaagtatctcaaaacggttagatatgacatctatctcatccgttatgcttagcgtgtattcagctgcaccattgtcccaatagttcaatgtccgccaaaacatatgaacactggtaattggaatgctcccaataacatactttgccagctcacatgcacaaggcaaaccatacgtcgttctcaacacacatccacaacgagatgggttttttccagcataattcacccgctcatactcttcggcaatttgattcaacgcatgcttggacaccatgccaattagtttcctgtataacgtcactttaaaaacatgtccaaccacatgtgtagttctttccaaagatgccttgatttcagtatgttgcaaggtgatcatattgttcatcgcatcccaaaccgtgcacaaatcaccaacactattttgtagtagccgctttaaagtccaatgggcagactcaaccctgcaaggtatgatatgaagatagttcatttcatattttttaaacgtatgcaaatgatgatataaatgataaattacctaatgtcttaagtgaaatttacctgtttgttgttgtatttccaaaatgcatgactttatttgtccatgctgtgacaaatttttctttgtgagggttcaaccaagtgtccttcacgtaatcaataaatgttggccacggagcacatgcaacctcaaatttcataagacaatcatcaaatttcttctcattagcacagtcaacaacacttccccatgcatccatcacataatcccacgcattctgctgccgaatataagttttacatttagccttcacattcttatcaatgtgaaacctacacaataaatttgttgcctctgggaatacggtttcaactgcactcatgactgctaaatctctatctgtaacaatcaccttagggaaaaattcacttttaagaaaaattcctctaaaccgttgaagggcccacacaacattacttatacgttccgcctctaaataggcaaatgcagctgagaatgtcatcccagtaggcgtcacaccaacaatgtcaagcaaaggaagcctgtacctgtttgttttataggtactatctatgaggaacaccatatgatatgcattactcagctttaccgcatctggatgtgcccaaaacaagtcacgaacaacatttacatccttcaatctatgccaatgaatatacatgtcacgttcaagaagtttcattagctgttgcatttcagtgttttcgcctcttatacgcgtgcggtatgcatatcttgcattgtatacttgcttcaaacttgtgacattatttgcattgtgctccttcaaagttaacagaatattctttggtttcaccattgaccttgtcatatctgcaacaatcatcttctcctcttcagttaatcgaccagcgtatgggtgtccacagaatgacttagccaaagcatggttgtgattaccacatattagtttcaccatccacccttgacctcccgaaattggtttaccccgcagcttaaaaggacactcgcattttctagtcccagtggtcaaacgtgtcaaaccttttttccattgtctatattttccactcctttcacaaccaattaacacaaatgacgtccttcctacttttccggtttttgtgtcactcctcattataacagccacaaaaccattctcaaatgcaaccccacgagcccatttcaataccgcatcacgagattcaaacacctacacaaatgagtaattcatctttaatcttctcaatttaatcatttaacaactttaactacattcaaaagcacataaatacctcagtcgtgttgaatgctgcagaacaatcaactacacaatcattgtcttcaaacgcatcagggtccgcttcgatgtcttcatccatataattttcttccgacaacatactttcatatatccactcatcggtgtccatccttacaactacacattttattttatcattactaaaatcacatacaaataaatcaccatttacataactaatccataaaataacatttttacaattattcattaacgtcttaataatcatctacatacataaacaatccacaaatttcaaatatgcattactcactcaaataattttataaattaaactcaattgttattgaatccaaaaactaactttccgtattaattctctcaaataattatcagctaaggtaaattttccttaaaaatatatgttttaaccaattttttaaaaaaaatttctcaaacagcagatttaataccatacggattacccaatccgtatgggatttacggattacgtaatccgtatgattcatacggattaggtaatccgtaaatcccatacggattgggtaatccgtatgggttttacggattacccaatccgtatgggatttacggattacctaatccgtatgaatcatacggattacgtaatccgtaaatcccatacggattactcaatccgtatgacacacgaaaacaataaccaccaacctctgcaaccccgacgccacttcgcgactccgacggccaccaccacgccaaaactccgacgaaatcaacagaatgccaccgagaacaaccaatgaacagcgtttgtagcaacaaaaatggcaccaaaatgaagtgaataaagggagaaaagaagaaagctgcaacgtaactgtacatgccataaatataagaggaatataagaggaaagctgccaggggtatttttgggttttcaaaactataatggtgtagaagaaattgagaatggtgtaggaagctggtgccgtgtatttgccttatggaaagctaggctcacctaatatgggccaacaccctaataaccgcaaaatattagcattttttgctggtggagcccatggtaagattcggaaaaaactacacaagcgttggaaaaacaaagataaagtattgcaagttcacgaggaccttccaaagggtcaagactacacaaagttgatgagcctaagcaagttctgcttgtgccccagtggatacttgaaaatttaagggaaacgtaggtttgcttctaattggagcatcgtgttaataatgtgaaggtcgtacgtcattattttgtaaaatatattttaacttaacaaaaaaaaaacttatggattgcaccatccgtaaaaaaaaaagcctcttacagattacggactaggcaatccataaacaaaaaaaaaaaactcatagcaattggcgaattcgtaaggttacgaaatccgtaaccttaataatgtaaaggatatttttgaaagtacacttttcatgttaggtgtattaaaaaaatgcctcatgttggaagcatacgccatgcaattataccaaaaacttacactccttcgcagaggtaagaagcacgaaaattccaagacaacaaccccaacactttcctttggtcaggcaacaacatacacgggggatggtaaacattccatcaattacaacttctcacatcgccactccaataaatttatcccaaatcaacaattaatttgatgaaccaacagcaaaatcaacataaaatagaataaaataaagtgtcaagagcacagcataatctcagtcgagggcaattaaaaaggtcatttccataaaccaaatgtactcaatcaagaaatcaaacaccgttaagattaccacatgaagccgcaacttcctccactcatactaattcaggcttcagagtggatagcccaacgaagttttacagcaaataattatgagcttaggaaaattacgtggcccatggaggtaataattttcagaaaattatattaatcaggaaatgtacaagtaagaaatgattagctagactgtagggccctttttgggtctcaaactgcactcacgacatttcttgcagctggcagatagagagaaatgtataagtgagaaatggttaaaattttgtgagcaaaggaagcaaactcaccgattcaaggagggtcgaagggagctttgggggaagaatatgggagactattacaggtgaaagaatgagaaaggaaaagatggaggggttctattagaagttaggccctcagaaatttacaatagcagcctccattttacttaccgaaacactattaagtttttaaaatttctacaagcttcctaatggatatttaatggcaacgaatcagagctcgtgcaatctgtaaagtcaatattaaatacagattgcaacttgttttttaaaacaaatgaagattaaagtctagtttaaataaactgggatgcaaacacaggtaaaatcaatcaatccttttacaagttaaaatcaagatatatatatttttcaacttttgagaaaattgattttacttctaaattttcctttcctataacttgttgaaaagttcatccaaattcagcctgactttatctgacaagttgcacacaaaagatggcgattaatggaaaatctttgctaaacctgttgccatggaatatatctttcaagacatggataaaactacacatttttgtcatgcaatttcgaatactttgttcatgatacggttgtttcacccttctcatcttccaatagctttaactccctacgccaatcttctaattttgctagcttttccaactgctctggcttcagattttgctctgtacttttctgctccaatgcttctgtaagtcgaatctgaatttaacagtcaaaatattaggctaggaaaatatgaaaacactatttgagatagttctttagcaagaccgagaataaaaacacatccaccatgtcatgcattcaaattctctagacaatggccaaaacaattttacctttaattattgaactaagttgcttagcctatcatagtattatactttctaattctaatattcatttctctaatcacaatcattttgtttataaagcctccaattcgctctgacacaatctccttggtaaagttgatataattatttgatgttcagtacatttgtcattaataaggacacacacacatttgtttaatgagacaagtcatgcaaagtccccagtgcttcccagaaggattgcgttgatgtggatccatgttctgagaattcttcaactagactagctaaaatattagccacataaaatcataaacctactagattttataatggtaacaacatatggaaaattggaaacatatccaatgctccaaaagaacaaacagattccaaagaattcattaggaacaacaatacaacattcacttttccagcaacctacctatagcaatattttctcctgaaccacaccatcaactacaaaattgaatatctcctatatgtcttgatcaagattcatctcagtatcatactgcaacttacaacaagagagatgatagcaaggatccatccttatggtcaaaaaaccgaagctacctaaaaatgggactagtgaaacctttgcatcactaacattgtatttggtagagaaagaaatgaaagggaggggagggattttgataaaaatccttgtttgattcaaaggtttggaagggagaggagagaaaatgagtgggcaaaagtccctcccctccactatttgcctcccatttccttctcctcttttaaactaaacggtcaatattctgtaagttgtattagatcttgagtagcataagtaatacaggatgatgagaagtcatgaaccgtaatggtggtaactaagaaggggccattgatgagtcactatttatcactatttactcatctttctgtactcattttaatccctgaattgtgtttaatcgttcacatttgcactatttctcatataggatttaattggaccgataattcagattttaattaatttggattattttaagtttaattattccaatttgattttcagggcagtttaataattaattgggcttggaattaattcatggacttgaagattgggatgccacgtcagcattattttcagagcattttattttcgttttattttattttattttattttcgtttttgggccaaaattgttaggaaaagcccattttcgtttaggtccgccactctatatatttgggaaactgtgcccatgcagaccagccaacattattttcgttcagttctcctttagggttttagtaaatttcgttctctgcagttttctttgtttctagggtttatgttccctgtttgaattttcggttcagaatacgttgtcgttcagtttcagtattgttttcgttttctgcttcatcttctcaatttcgaatttcgtttctctgttttcagtttcgttttctgctatttcgtttctgttcaattttgtttctgcttttaatttcgttctgcttttaatttcgtttaatgtttcatttcgattcaattcgtgtttctgttgttatttctgaattaatggaaggctaaacctagggttggaccctaggacagattgcaaaccctttaatggaggttctctgtttttgaatttcgtttctgcttggttcgttcttgttggggtttctgttctgtatttttcgaattagagtcatgcttaatgattctgatattgattgattcagtaatctcagtttgcttaattctgagagcttgccctaacgaggttcacgtttgcttaattcgtgtaatgaagttttaggttaatcttcgcttagttgattaatctggactgataaggattaagtagaacagattatctttcgtgaaccaaggaaattagaggcgcaatatgttataagggtctgacttgtttctaatcactgcaattaattgttatttctgtttaatttagattttcgcattctgccaaaaacccccccaatacacgtttcaatccctaacgcagacaattgagatccttgagagacgacctaggagtcacttcctagtactacatttaaaccgtattaatttggccgagtacgacctcgatcagccatgaatatcatgaataatggtaaactgttataggaattacaaacaacccattgatgcaccatagtaattaataagattcccttgtaatcccttgttgacataatttttccacaattttcagcttctttttggccaaaaatagccttgtaggatcattagtatatggagagcttttctcattgtcatttacatccgagaaacaagtaaagttccttcttatatttgagtgttctttcttatatatcttgagtctgccgagccaaaaagatttaaaagttcatggaacaacattacttgaatatcttctttccttcattttttaacggatattaagaacattaatagaaagaaaggagagataagggatcatataaaaaaggaaaatgtaaacagaaagctgcagaggctacaaaatgcagcaaaactcatcttttattcaataaataaaagagatagagagagagagcaaggtagctctccaatctagcagcatattggttataaattccctcgagacagaagtgaatagcagacacaaaacaaatcctatcacataaggtaatcagacacccttgaaaatatgggcaaaccatgccaacctatacccatgaaattaagtctaatactcctcatggctcatacataaacaatactagatagacagcagcaccataacctatgaagcacaacccaaacactagatatgacatggagacaaaatacaggacaacagacacacataacagtttccactgtaccattctcttccaattttgtttctatacattaagcaataaaggcaaaatacaaatttatacaattttaaactgccaaagatgaaattgcctgaccctgcgcttatatcagaattctagaggatccaattcccactatgacaagcacatatcacatcaatcataaatttaaatatttgttttagtaaaattcttaactctactatttcatgttgcaacaagaaacatgttaagaaccttcattttcttcgcaataaataattgagggacacattagcaggataagtcacagcacattgaatcaccaaggaactaaagggcagggatgcttgctacatttttaggacatttttgccaaatggaaatctttgttcatcttacaccatttaagaaaaaggaattgcctgagagataaagagaaattgagtgtgtcaatgtgataagaaccttgagagaaccacaccacaaaagctagctattgtagttggagagcccaaggccttataaaccccacactagaatcccatacttccaatgtgggactccaagtcccataccttgcaattggaccctaacatcccaccacgctccgtagctctggcgcccacgcgggctggctgtgcactagccctttcattagtcctgagcgaacattgcaatgtcggtgtcaccatccgcgccgcttgtttgcaactggaagtcatggtggaaggctctgataccaattgataagaaccttgagagaaccacaccacaaaagttaactattgtagttggagagcccaaggccttacaaacccgacactaaaatcccatacttccaatgtgggattccaagtctcataccttgcaattggatcctaacacaatgctgctcaaatatgcaagagacatgggaaaaaaaaaaaaaaaaactgaaatcttaagaaatatgaataaaagatcgaactaacatacatgacgtggtatgattggcaaataactacatttgtagaattcttaggtctgtgtgtgagtctgatcggggagataattttccaatgtaaacacatgaaattaatatctctcacgaaaggcataatattgttaaagagtggggcgtcaacagaaaagggtatgaatcatcaaagcataaacggtgcaccttctttttgagagctcgaattcttttatcaatatcttgagcttgggaatcttgcacagcgagctcatttacttgcgaggtcaatgcctccacagattcctgcttcccactctcttcgacttcactcacattcttttccttttcaagcgcagcctgaaataacacatattatataattcgcattgatcaaaatttatcaattaaacaaagtaaagtagaacactaattttatatatatcagcatcggcattagcatacatacctgaatgcgcttttccttctttctctcgttcctcttgacggacttggtcttgggcttggaatcggcgtcggggtcgtacccgggaggcccagccgagcccatctcctttttcaactgcagagaacaagagtgagagaaagagaaatggaataataagaataagaagaagaaattagggaacggacgagtgctcctttgggttggtaaatggcgacttcgtcttgaggggtgtagccggcgcggattcgaatgggcttgcggagggttccgtcgggccgtctcgttgggcccacgatcctctctccttctttcaggcttttgctcagctccgctatttgcttcttcctttcctcgtcgctcatctttcttccttttcaactattactactcttcttcttgctatatgcttatgctgcgtctctctctctctctctcactattgacttaagcacttaaacaaaattacttctactaccaatcaataaaagacaccttctcttggacttggactctctcatgattaattatcataaaattgattttgattgaagtaaaaattacttttatttatttcaattttatcataatttttatacatcataattaattttatgataattataaaataatttaaatatataaaatttgcttaaaactaaaattgattcattttatgattgttcaagctatccaacgcacacttattctgtgcgggtccccttcttacacaccgtgaccaaatatgctttacccttgtgtaataaccaaatggagtcactattttattaaaattgcaaactagtccctatataagtaatattcgttatactagttattttatttgattcctcattcctgtaacttttttattttaaagttttaatatctgtacgagaaaacaatatcttcgattatctgtgtaattttttttaacaccagtcattaacttttgtaataatttttttaaaggaaatgaataaagaactcatcaccaagatctaaaaattaaccgttacgtacatatacatagactaaaaattacaactttctcttataaagactataatttagtgttgaaatttcacataatgtattatgggattaaaataatatatataagtaaaagagattttttattataagaattaacttttagaacttatctaagtcataatttaaattcaaagaccatattaaaatttattataataattattgttggacctattaaagacggatcctaggtaggagtgataaatgggtgagatccccaagaacgcacagaaaagaaggattccaaaaaataaattaaaaaatacatatagttatattgtgattttttaatgttattttgtattagttttataaacaaattaaaaatattttttatcacctattttttcatatctgaattaaagtatagcatgtgattataaagtattaatattttagttgttagtttttttcaatgttatgtctataagtttatatatgttaaatgaatttttatcttagtgtaacatgtcaacaattcaaatgtaatggagatataataatatattgaaatgaagtgtttgatttatcaaaagggaaaaaaaaacacaaactataactcaaattataaaagagtctatttttatactataaattaaaatcccaaatttggataataaaactttaactctcctagccttactatctcaactagaaatttgtagcactttctttcctccatgcaagttcatttcccacacattctctataattggacaaaaaacatctcaattaataatctcaatttactctctatttatgcttttttttaaattatattaagtttcttaatcatctactcgttccaatttaaaaataaaattatgccacaatttaaagtatttattatgaatctaccatttaatttatattttaacaaatatttattatgaattataatcataataataattatataaaaataattatttatctgatgtaacacacaaactaaaatactagttaaaatttaaaataagtaaattaataaattaacataaaaagtgcatgtaagtttaatatgagacaatgatatttttgccaatgactagagatagcaaggagtaaattgaatgattaatgtaattcatcatatttaaatttgttaaaatgttgttattcacttaattaataaaatacataatttttaattaaattatatgccctgctttttagtatgatttatgtttatattttaaaatacttatatataagatcttattttattatttcatcccatgctcataaaatatcaagaccgatcttggatctattgaatcacccatgattagattttattattatcagactatttgtaaatatccaatcttacaaattgcttacttacatttaaaaaaaaaaaactgcatacttaaaatatctgatcctctggaataaataaataaataaataatgtctactcctcaacatgaaaatggattgttagagatttgactccacattatcggttgatataactaaaaactctccgtcatcacttctagatttattacgatgaagtcctgatgttcttgaatgtaattctttttttcttttacttgctagacatgagctaatatgcgttgattatttagtgattgctgatatagagctgcactagaggtttaacttataatctatgagatacttctagctattacttacgaaccttatgatggcattttcttcacaagctcagtacttagctaaggggcaggacaggaattaagttttaaaaaggtgtatataaagtatttgaaatgttatgaagacattaaatgttagtacctctttcaatggatcggggattcaaacggttgattatctatgaggtttgtgaaattatataaacatttttttgttttttttttaactattacaagaatcttttttgtaagggatgttaatataatatataaagagtgttagtgtaatgtttatgaacattgagatatagagtgataataatgtaatgttttaaatataaaatgaggttagtatagaaataaagaaaattaaaagagtgatattatatgtaatttgaaagaaaaaaaaaactcacaaaatacaagtgtattgtgttgtgctctttgatataatatgaaacaggttatgtctaagtacatcttaatttttatgtttaccttcttgttctaacagttattattttccctccccttaactttttttctccctaaagtgtgtacatcccaagaggtattttcttagtttttgagcatagctttcttttagcattaaaaaaaaaaacaattaggctttctcatggaaagggagtaactataattgataataaactattcttgatcatacaaaagcagcccaataccccatctccaaacgagcttaatggaaaaagaaacgataataaccatccgaagttgattcattctctcataataattttatatccattactgatgatattgattagtagtgctatatgactcacaaaatataactatatttaaaggaagatgttggatggatgcatagctaaggatgttgatggtatgatttgattcaatttaaatataatattaaatctgaatcaatcttcaaagatttagtttgattttattttattttacaattttttcatttattatcatataatttatttttaattatttttaaaaaaattattcttttattaaattttgtttgacatattttagttataaattatttttcttttattttctctcatactaaacaatctaaagattttctcactttttttttctttttcttacttttataaaactaaacaaaaaatcatctttcttacttttcattttctctcgtaccaaataatctaaagatcatctcatattttatttttctttcttttcactttcttccataaaactaaccaaagcataaggggaaagaaaagacaagaataatgatcatttgacaccatgccgcacctctttttggaaggtaggggagggagtgcaaatataattgaaccttttgcaaataactaagagcatcttcaactagagtgcttccaagttccttcacttgaaggaatcgttccttaaatttttttttgcgttggagttggcttgcgtggcagaatcgtatcatcaagaatgaaacgcggtccttatataaggaactgaaacttatgaataaaataatattatcgatatcaactacctgtaaaaaaacagaggaaaaataacaaacctgaggtcgagcgcatgaaggaagaggctgcgacagtggtctacatcaaaagaggcagtgcacatggaggaagaggttggtgcgccgcgcgaggtggaggcggcacgaaggaagaggtcgtgcacagaggaagttgccgcccaagtaagccgtcgcgtaaggaagaaggcgcgtgagtggaaagcacacactacaaaaaaaaatgaaatttcagacggaaaaaatccgtcggtaacaaccaaaatccgtgggaaaaccgatttagcgacggaatttccgacggataaaaatccgtcggaaaaaggggcgtaggaaatgttaggcgacagattttatttccgtcggtaatggctcgtgggaaatttccgacggacttttctgtcgaaaatactctatgagaagcgctttctacgtcggttattaaagccgtctttgataatggtgtcctggaaagtcgataccttctaagacggtttttaaagtaaccgtcttagaatgttatttttaaaaaaataaaatagatcattctaaggcggtgttttgcagaaccgtcttagaataacaaattcaacaaactttttttgcataatccttgaaaagttgcgaataaaaaaagaaaaccttaatattattaaaaccactcaccacatatgctacacaatgcttacacacacacacacacactatatatatatatatatatatatatatatatatatatatactatttaactgagtgtgtgtaactgtgtattgaccattcaagaacattcactagaaatcaatcttatttttatcttcaactatatttttcaggcctctcttaggtgcttggcaaatggtttttaagagaggtagctgacagatatgtaaagacaccaaaatgctttatttgttatcttactaacatgtttatctgatttctctttgtttcttcttgcagagtccttgactccttgttaagtaaggtactatcctctttcattctttcttccttctaacaatatttcttattttaaacacccccccccccccaaaaaaaaaggtgcatgctatgagatgcaacccagagattcaaattcatccaaagtgataaataaaaacaatcagctccatcttttttcaaagttgagatatcagcactatttgaagagaataatacattcacaacaaggagggattaaactaataaaattggggagaaaaaaagtaccatggttgtcaaatctatgcacatgccagaaataataacacccttaaacaggataatgttaccttagtgtctctactataaggaactccattatatcctggctgcgaaattttagaatcaccagcattgatatctccattagctgcacggacagcagcactagctctagcttcccatgcttgaagactgccaaatttagggacagacaagtcttttacccgactgagttggtccattaaaggcttgagctgtagctgcactagcacaagaaatacaacagtcatcacaagattaactgtggaccagtagcaacaacaaaataaatgtcaccaatatgtaaagtctaacaatatatcatgaaattcgaatgagattaagatacctataggcaaggttgtgacattcataaactgaccccaactttgcatctatactgaatactcacccaacaaattgtgcccagcatatatatatatatatatatatattatatatatactagcatagaatatgatggttggtcaaacctagtaaagtagttgacctgctaaaaacgtgagtgtgtcaggtttagctcaagattatctggttgtcttgggccatttctaaactagagtgggtcatacattggattggaccaccaaaacaaggtgtccactaatggtctaatgcttggcaccaaaatgctggtgacaaccttgaactagcagcaaattcattgttttgatcatctcctaagtcccaattagggctggactggaatgatgtatagaagaatggaaaacaaggatgctgcctcatgtttctttcttctttgtaatttgttgcagttggtaacctccccatgctgttacagttacaaatttcttatattggtaagatggaagcgctaaattcagttttgtctttatcttagtcagtgattatcatttagcaatcacgtgacttctttgtacatgtccaaactacctttaaccaattttctgccatcttttttcctcaatcaatgtcataaatatctcctcatttcagctactctcaccttcttttgtccttttaaagcccaaaattaactaccaaagtatagttgaatgtatcctatgtgtgacatcctcatttattgatccattattttgtaatattgatcccatatatttaaagttaaaaacctatggtatcacatcttttcccatatttacttccaagccactttcctccttgctaaaatcgcaacatatatacattatcttctcttaggtgaaaacattgcttccaaagtatgtctcaaaatgcaagtttctgttaattgcttcccttgacctaatcaaaactatatcatctacaaaaagcaagcaattagggataaatttttatgcccttggtatgcaaatccaatactaaattagacaagtaagaacttaaggccaaacctttatgtaatcctatcccaatatattgccgagtgttaagagtatctacaaaaagttttaaaattatatatatatatatattgtgaaatcaatcagtatctaatagagaaaatgtcactcatcatgtcaggaactgcttctttatctcatcatattccctcatttgtttccttatttaattaatagtcttatgatatcatcagacttgggctttactagtaatattacataagtgttactagacctaattattagtataaataggaccattattgttagtattttgcatcacaccataacacatcatatcaatcagtctaatagaacatgattattgggaacctcatttctctcttttcctccttccttgcctaaacacaaataatttcatcacgcattaagagattaagaaaaccacattacaacagtattgtagattaagacgaaccatcatcattctttctatttatattatttctcttaatagattcatcatttcttctattggggaaaaaaataggacttacatgccgatcaaatctgccaggcctcgttaaagctgggtcaagaatatctggcaagttcgttgcagccattaatattattccctagaagataaaataatgaatcaatttctaaaaccagaggaacaaattgcactgcaagctgttcaaatatacctcattctgctcaaacccatccatttcaagaagtagctgatgcaatgtcttctttgtgtggccctcccattgttttcttgttgatcccacaacttcaatttcatcaataaaaatgatacaaggagcctacataaagataaaagggaaataaatattccataatcagacaaaaaataaaggacccatgtggtatagtacaaaaccagattaacaaacaatttaaggataccatttgcaaaagtcaacagaccttctttttggctgcttgaaataaggatctaacacgtcgagcaccaactccaacaaacctgagcatgaaagaaaagtgatataaaaatgaacatccctaacagccaacatatcacaacattccgtaatgtgacactagttgctacagtatatgtcagcgtgcaaaatacttgctcaatggcttggataaatacttaattaaggatgacaattctatccagagcctataggtacccgcaatgggtaggataaatacttgctcaattgggatgggctaaggcagggctggggatttacccacaaaatttaatggggaagggttcaagttctatataaaaaagatgtttatcctcctctcccctcccacccaagacaagaggatcaaagaaatgcaacagtgcaacacttctcattaattaaggactgacacagattgagccctaaagttggtaagagtatgttcccattagaataacgataataaaatacatttagtaatcaataacagaaaagcataaacatattctgtattacaattgacaactactgtattttcattatcaaggttgcaatataaaagcattctttgtatgttattattttcaaaacaactaatgaattataatttacccacattacattacagttgtgactgtgcaatatcttgtttctgatctcaagagactgtatataaatgcgttcaatgctaaaaatttaagatattgaaaacataaaaagtgaaagaagacttacatctcctcaaattcagagcctgctcgatagaaaaatgggacaccagcttctccagcaatagccttcaaggtcccagataaagcaaacactattagatcattacaatgataattttcaataggttaactcaaaaggttgatgtcaataatgtaggattttagttacagtcacagatcaaaacacttatgcaaagtgtaaggaaatatcaaagtgagagacaagaaccaaagtccatttatgtccttccttgaacttcctaatagaatatagcatataacagtgtagtgtggcatactaaaaatgataacgaatcctaaaaagcatatggaagaagaccaataggttctaaattgtataatacaataacttcataaacactgtaaaaatgtgtctgacaagacagaaactaactgaccttggctagtagagtttttccagttccaggtgctcctgtcaaaagaatcccctgaaaagaggaacactttagccacacttgatgaacaaaacataaccaatacacacaaaaaagtatgataccttattataagacaagcaaattgacaaaaaaagctatcaggaaaaaaaaaagaaaaaaaaatgacaaattaacctcttcaaacctttggcaactttcctccaaggcgtgtaaacttagatggattttttaggtactccacaacttcctcaagttcttgctttgcatcatcacacctttcacatccttaaaggtttttacattctgcaaggaaagaaagtgtgatagagaaagattaagaaaagagaacacataaggcatagaataacttttggtttactgtatattctacacacaaggctaatacaacaaataaggaaacttgaaattataatgtcagatgtctttcagaaattacggggtggtaagactttccaactttttcgtcaactggtccacaaaattgcaagtaaaggcataattagctaggattattttattaagataaagaaaggaaatgattatggaggtatagtatatatcatgccattgttcattagcctattccacctagaatcttctcattcaaatattcactatccatcaaaattctagcttatccaaattgaagctattcaatcacagaaacattcaagagatacagaaataaatatctgagaagtgagaactaagaacagattaacaagttaaccttttcaggcatcacttccttatttagcatctttggggcataggaagaacttgatccaactcctgaaggtccaatcccacccaagcttccaatgtatttttgaagtgcagcagcaccaataaacctgaaaggatgtgtagtagcaatacaagtatataaaaatcagagagtggatgtttctacatggaaaagagagggagaaagggaaactagggactcataccagaccaaccccacagctacagtgatcaaaatagttgagataagctcttgtgcaaaacgtgacttatttgatacttttggatcaacctaaaagaggaaataacttcatgagaatccgagaacagctaaaaaaagattataactatagcataacattcattatgaaaaacaacaagttcagaaagccatactcacatttcgtcgaacacttggaacacatcatcattcaccccgaattctgggtggtcctcggtgtgtgcgcgagtaccgccatcgtcctcggcgtaaaaatgaatcaaatgaacacaattagctaacgagagataaacacatcagagactagcgacattacagaagcaaatcgcaaaaaaaaagtagcaagaatttcaataaattactgaagacccagatcataaatcggcacccaaatccagaaaaatcaatcaaaatcgcaactttggagaaaccaaggggttggattgagtgcagaaagggagtgatgggatttggaaagtggaagaaaggagcttacattcttgacgaagataacatttgcggcggcgatggcgatgactacgccgtcgaggatggtgaccgggccggtgaggagactccacttccgatagatcatctttttcttcttgctctgattctctctcttttaggttcatcttttcacaaatgaaacgaaatctgcaatggaagctcttctgcctacctatgttttaaaaggacccatattagagggaaacttgcggctgcccttcacgcacgatgaccggaatggatctcgcggtgtcaccggtgtagccatggccgatgccatccttggcttagggatgggaagagacgcttaaaacgaaggtaagagtaggagagtggtaagggattgaagagatagtcaaggctagggttcaactattttttgttttgggaaaaatccaatttctaatgtaataaatatacatggaaaaatgttaatattccgacggaagttagtgggtaggaaagggtgcatcggaaaacatcgcttttcttgtagtgacataagagagaaagaaaagaaagaggaaaggaaaatggaaaaatgcgtgtggtatggaagaatttagaaggttgtttatttaaaaaaaaatgcatagagagtcaatggaagaatgtagaaggttgaaatggaagtaataaaatatatatttcattttcgctgtggtggtgtaaaactcagctatcatatgtttttataaactcgaaattgcaaataaaaacatttccaagtgcataaagagtcattagcaagagataaattatactttttctttgattatttttaatttatatttcatttttcttcaattattcatactttttatttgtatttataaaaactaaaaaaatgttaagttttaataaaaaaatataaatgtgtggattttttggagtttcttgcggtttcttgtgattttcttgtattgaagcaaaattttgtttgagttcctcatgagtgacatagagaccacaaaaagtaatgcgagaaacacaaaaaggtgataaagaaacccattttaaatgctcccattgaagatgctctaaaaaagctaagttcaagaactatgaaaacttttactgtaacttgtcatcctcattgggaacaatgaccaatgtgccacattccaaataaaaaatttccacaatgtcatgccaacagtaaatattaccagactgtcacgcgggctatttcggcccacaatccagcgaaatatgtgtgctaatgtggcatcattctgttggccacgtatttcgctacatgagccaacgaaatacatggtcaataacgggcaggacaggtgacagacataaagtatttcgctagggagtcaagcgaaatatgttgggacacgtgtcactgatgtatgatttcactataggaattggtggtgatattgattatataaactttaaatggttataacttttgataaaaatgtttgattgaggcgttcgatatgtcaaaacgctcgaaattaacataagaaatcctaagcaaattgccgaaggggatttggtcaactattttttccaaaaaatgtctctaagtaggtcaaaattaggatttaggattcaatcatccaaaaatttacttgtttttctagttttttaattctttaattagttaatttaatgctatttttaattagttacatgacacatgttcccaatgacttttttttcccattgctacatattttgcttggcccccagcgaaataccttgcgctgccacgtgtcctgccctcgtctgcccggtcactaacactttgatcccctatttcgctggttcatgtagcgaaatacatgaccaacaaaatgacaccacgtcagcacacatatttcgctggcctgtgggacgaaatagcccacgttgtagtctagtaatatttattgttgacgtgacattgtgaaaaatttttatttagaacgtggcacattggtactgtccttcctcattgtccttggctagttgatatagtgttgctgtaacttttattgcttttgggtcattggatattgatttgcttcattgaatatggtgctcttcgggagcttgttatgttttaaatgtgatttctatctttgtacttagggatgacaaacggatcggcccgcaaaaaaatggggcgggctggcctagcccgcttttgcaaagtgggctggaaatgctagcccgcctcgctttaatgcgggccagccagcttaaaaaattttaaaaaaataaataagttaatttaaaaaaatatagaaaaattatattaaaataaaaatatgataattaaaaaaacacagttaaataaaaagtaaataatttaaaattaatcataaataaataatgttatgtgataattcacaaaattacaccatttgcaaatagaatttatggatgtaaactgtacaaagtgtaatatattagtaatgaaagactatttgaaagtatcattatcataaacatttaaatattaaaacttataagttaattatgagagtgcaaaagagtataaattaaaagaatatacctatttcaaaatatgttaaatatatctatttaattttaatatttaatattttaaataatgttggcccagcgggctagtccgccccgccccgcgtttggcccataatttgcgggtcggactggctcgtcccgttttttattagcgagttgatattatcaacccagcccgcatttttttactggctaagcgggctggcctggcgggccaggcccgttttgccaaacatatttgtaattttttggaatataatattatctttggccttaaggagaaaaaaaactatgaaaacttagcattttggttggaggttcattcattctgaacattctctatacaagttaggaatcttcatcatattaatgcacagaaatgttaaaattaatttactttttgcattaaggaaatgttgtgaagggtctaaatttcatgtttaagagtaaatctaattccatttttgtttgcctcccttttatgtgttataacatatttcatgccaatttaatagtcatgtaaagattttatactttcaagcaattaatgatcaaattcatgtaatgatcatgctctagctgtcaacctttatccttaatttcatttgtatgagatattgattagctaccagtgctttaatatttacaagtgtattactaaattttatgcacgaggaggtatttgaccactttttattttgctattatatggataagatgttataaatctgtaacaccataagtctataacatagtctgtagccataataagtctgtaaccccgtaagtctacaaccatatggattgcgctgtaacaccataagcctatatataatcataagtcagtagcaaagaatgtgttgcagccaaaggagaggcaatttgcagcaacaattttcaaatcatcccatggaagacataatttaaagcttcttcaagtctcatacaaattaaggtttaagttcaaaaatttcaatattcaaaaatgacataccacatttagaaaaccatatgcagattctcaagcacatttttaacatattcataaaggatacataaaatgaacccttctatgcagaagcatcatctagtttaagaggaatacatccaaggcctatttcattactaggtatgaagctattgacgttattgaaaattaagacctcttctgaggaggactcattcgagttcccgtaatcttcccacatattttgaagttgcatataaaacctcttcattggtgttatctttttgcgtaccaatggtgaacgttttcttgtaggaatcttagggctccataaacgtcgactttttccacctagcaaaaattactaattgtcagaaatataataaatgaagtcacacaacaatgtttttcaaagaaaaagataacttatttactattatcatgacctgtaacatagcttgaaacaaggagattttttctaccctttaaatgttttctacccttcagagtttttctacgcttcagctttttaaggttatcagggtactctggttgaaaatggttgggaagatagttctcaagacttccacatttcctgtatcttgacccacatgcattgcacaatactggcttgtcttcaggtccattacgccaaagtggagtacctgatcatggagccatatatatgttggtcactactcgaataatttggaagtagatattttggacaaaataatttgcataaaataagaatggttttgcttgcttgttcttaagggttatctgtgcctatattcatagagacatgatagttttgaagtgtcttagttttagatacataactttttgtagaaacaatttctagggtttgctttgtgtgtgtgtattgaaaggctaaaagaattttattgaaaatgtgtgcagcacaagaaaaggcggatgtacatgaatattatttttcatagaataattagtcctcctcgcccagtatacaattaattatagtacttctagctagctaaaaaggtattagcctacttgagatttgatagaatcaaaatacatagattacaatttcttcatatcattattcattaggtaggctaacacctgaattactatttaaataaaaatttcgatgaaaatgatttaaaggtaatattagacaaattcggtattatttaatgaaaaacatcaattactatcctaacttggtcttcagtgaaacaataattacttggtctttatacccaagatttcaaaccaattataattgcttttaaatttatgttttcttcaatttttatttttttaaaaagtcatatcatctcatcataaatgacacacccccttttttttaatgcaattagaatttaatatatgcattaatggtccaaacttaaaagctcattaaatgaagcaatttatattccgtaaactcacttactgttttttctttttctttttctaacacattaaaaagattaaatgatatatttgttgtggaaataggtgaacatttctattggtcaatagggagttttcaagtacatgctccaagtagttattactttttggattgtaattgttttcttattggttttagccattctaattatttgaaatttagaaaccattttagctttcggtcagaattttctttttataacttgtggtctcatgtatagtacctagacccatcaatgtgtcaataggtaacttgattttgaaaagttaaggacccctttggttatgttttcatttcttgttttcactttataattataaattttactttgtttttaatctattttctattttaaaagatttataaaaaaattagagaaaacaaaaaaaaagttgtttttagtgttggctatacaaatatttgaaaacaagaaaaatattaaaaataaggtaacctttttataaaattacggtaaacacaaaaaatgaaaatataaataaagatagtcatgcttgaattaaataagattactatcaagaataaattaagttttctttcaagtatttaaaaaatttaatttcatgaaaggttaatttgatttagaagtaaataatttatatttaaaaacttttattttaaagaaaaaataataaaatttagcataaaatatcatactaatgtagaattttcttttctttttctagtttaacatgcttagttttgtaatgttggttaaaaataaccaaacttcaatattttcatgaaattacacttgaaaaaatcaaaggcgagtttgaactttggtgcaattgaatgcttgtccaagcataagcttagacaaggagaaaaaagattaagggcttatacatcataaatatttaactaattagattatataattgtataagttagaacactaaaataatttttaaaaggtcaatagtattaacttcttgatgccaatactttttgaccaatttaattgaatcatttgactgattttgaatgtcttgaatttgtaagataaaatattcatcttttttgaataccatatacagtcaccatgttcaatctaacggaaaacaaaagttctaattaaccacaagaggacttacaatgaattttgcaatggaagcatggaccatgctttctccccatatctgtaatgtttccttttatctgacaaatagaaattatagttatcagaaaagcaacaccacaaaagccttgaaaagaaatcaacttaaagaacaaactacaaaattatgttacaaaattcaagttgtaggactaccggaagaaacagaacaaatcttcagtcaactttaattaataacataaaagcataattaagattccatttattttttctactctcttctcttcaagttttttttttttttttatgcaattgagccgtgcttacattataagttattcaaattcatatgtttgacaaggctaccttgggtttttttaccatttcatcatggaaaggatggcaagtagctccatgctctgtgaatgtccatctatatcatcatatagggacaaaaatatgcagtcgttatgcaacgcacatgaactttaataagccattaaaaaaattaatataaaggagaagaacaattaaaggtggggttgactctacaggattaaaactgtaaaaaaattattagattgtttggttgtttgttgaattagaaagtccatttaatactaaaaacatagtgagtttaatgaattgtactcttgtatatgtgaactctctttgcccccataataagtattatgtaagaagaaaaaataagttttaaaataaaagttattttcgtttttaatataatattaattattatttttagtttatatgtttaataatatttttagaacgttgttgttatgcttcatcatttctaaaaaaaaaaaatcggttaattttataaagttgttacactcttttatttacttaattattaatttttgttgatctatataaaaatgtactactaaattatacttttgatcctttatcttattttaagattcatttttaaataatttattttgatcttttatcttttaaatttggatcaatttggtctttcttaaataatgatggcttcgattttaagacataatttttgaaatagtgattaattcaaaacataaaacttgtctcattagatttgcttacatgaaaactataaaatccaactagtgcatgtttgaacaaaaaaagatcataaacatagtaataatctcatgaaaaatagtcaaatgaataatcaaaaaaaaaaaattaatatcattttttactgtgttttatgagactcgcttttcacctgatttatatcattttatagttctttttagttcaaacatcaatttagttccataatttttatacaagtgaatttagtgaaacaaattttacatcttgaattagtaaaaaataatttcatatttgtgtctcgaagtaaaaaataatcattgttttggaaagactaaattaatccaaatcatctccatatgaactaatattataagaaatataaaaacttaaaatgtaatattaacataaaattattttctttaaaggcaaaaggtatagcattgatatgataaggatgcaaatacacaccccaatcccaatctgtacaagaggtacaggtattacatacatcaaaaaatcatttctcctaaagttaactttctgtcccaaaaatgccatagttaacttctctgaacatcaacaacatttgaagcactgcaatggctccaaacactaggaagagaaaaaagttcctggtttgttgccgcctttgtacattagccattgccatgagatgtgctttatggcagccaaaataccccctagatcacacagtctttacccttaaaagctatactatttctatggttccatatgcacaccagcaagtaatgtgccatataaaatgtttacatctacggcttttcctccctctcatgcaaaacccaaactgagagtgtgactgggaaacctcctgaggggaaacattttcgatccccatccatttaaacacttcacaccatattcttgaagttatcaaacaagacagaaatagatgtgatatgttttctacctgaagatgacagaagttttagtaaatatttattttataatttataatttataaaaatatattacttatatcaattttgtttttataaaaataattttttttagaatctgttacataaaactagaattcctatcttttaggattttgctttttacttttagtaactttacaagtaattttggtttgttatgttttttttcctgcaggttggcttctaagggttcaataggggttgatggaaaatctatttcatatcaaatccatgaatttgaaaacattgtttatgacatgaaattgaaaggaattgtttttcttgatgacattatgcttgtgactttcataatttcaaaattgtcttcttggtagattgattttgctcgaaatctgaaacataaagatgaaagtttcacatttgatgatttgcctgtttgtctccggttcaaaataaacatcattttttccaaaaggtatttgcaaaatctgattctcgttctaaggcctatcttgttgagagctctaataagcctttctctgagtctttcaagaagcatgggttgaacaaaaataagtttgatagaaagctttctttttctaaaaataaaaatacttttaataacaacaataagcctactaataaaaatatggggaatgaaattttttgctttgtttgtgggcgagctaatcatttgatgaagaactattttcaacgccattgccaacctacgtctttcgtccctaaacctcatcctaatgttgttagcattggtgctgcctctgatttctcatctgacagagtcaagcaacttattgtgagcatgggaatgggagtatggcacatgtgttaggagaaggtcaagtgaagctatagctatctttagagaattttcttgttttagatggagtctatcacatttttgatattaggaaaattttactatgtatttctttgttagttcaacaagggtactccaaaagctcctcttcccacgaaaacaaatgtttaaaccatgtccgcttccatgtgtttctggaattggtatcagcaagcatatctccagtagtcgctcctttatttgtggtaacttgaaacaatctaggtgacatatccttaagacacagattatcaagtcctttgtggctccaaaacgcggtttgtttaccactcccaaccttcctctgaaaaagatcctcgaaccatccatatacaccttcaaacctgtaacttgtattctgaatgtccctccaccattaatgtgatgcatttggccagcttcttctagataaagaaaaaacatctgctttgccgtatttataacacaataaaggataccacagaaactccttatcattgagatttctccacttccactttgagagcaagctaacattaaacatctccagagttttaactcctagacctccatcttcttttgcaaggcaaactctgtcccaacttacccagttaatcttttgggtctctgccactccattccacaagaactgtctttgtatcccagcaaggatcttcaaaactttctttggcaccttgttaatagtaataataattaaaaatcaccttctttatatttttcaacacttaaattcgttaataactaaggaatgaatactatcaaagattataaaaaatcttattaatcatggccaaaaatataaatatttttagtgtgtgtataatatgttttcttaaaaaatttggggcatggccccattcaaggcttcaaccacaactaagctccagccctggtggtggtggcatgttgtagtacagtatatgctagggaaaggtatcaaaagatcatgtaagagagtttactcttgttgggacttggaacaggtatgaggataagtggttaagaaaaagtctaagatcaattggatattttgaatgatacttcttttactggctggtaagatggaaaacaaaattgaaggttgatgttttgagttgacgttggaatttttagcaaaaaagaggggagaaatggaatggtttgcaaatgatatgtaattaatatagtaatgtatatttcaattctaaagtgtaatgttatgcttgcagggttggactttttctgtaataaggttgggtacccttgtaccctagttaatatatatatttttctttggatgataaaaaataaaaaatgttaaaaaaaatagaaacagacccgtatgcagtgcagcattgtctggaagaaatttccagtgcttcccatctacaaaggatccttcaacttctcttttcgatcgcttaaattcctaattttgaattgcaatatttttgtcatacagatatatttgcattgcaaaaatatataatacagaaaaggaaaacatttgtaatctttttgtctttggtttttaaaacgcttgttttagaaacagtttttaaaatttaatggattttaattggatgcgaaaccagtttcttataatagtgtggaattgtttataaaacagtttttaaaactagaaattgagaataggatcaaacaggccctaactcacacatccttcagttcaaagttgacataagacaatcattattccaaagtatgccgatttcatattgatctatatatagtacttatcagatcatacatgacttctaatcatctcatgaaacacaaacacctagtgtagagacagaatttaagtcttgagaaaggctcataaaaaagtttaattcaaaaagttcaatattcaaaagcaatatgccatgtttagagaaacgtaaagattctcatacatattcatgaaggatatacataaatgaatccttctatgcagaagcatcttctggtttaagaagaatgcatccaagccctatttcgttactaggtatgaagttattgacgttatcaattaataagacctcttctgattcttggaatgactcatttgagttctcttcatttttccacgtcttgagaagttgttcatgaaacctttggattgatgtctccatctgtactaagtgtgaacgtttccttgatggaacataaggattccacatacatggattttttccacctaacaaaaatactaatttatatataagaagcattcacacaacaaaatattcaaagaagttaacttacatatttactagtatcattacttgaatttgtagcatagcctgaaccatggagaaccttgtttctaccctctagatttttaaggttatcaaggtactcaggtttaaaattgttgggaaaatagttctgaaggccaatgcttccccatttggtgtatcttattccacatgcgttgcacaacactgacttgtcttctggtcctctacgccaatgtggcgaagctgatgaaaccatatatatatgttggtgactggctcaaacatttgagaaaatgttttgaacaaaataatttatataaaataggaatagttattttgtttgttcattcttaagggctacatgcgcctatagttatagtctatagagacatgatagttttgaagtgtcttaatttatcataaataactttctgtagagacaactatttttagttgcgctttgtatgttgattcacataaaagaaacaaaataaacacatgtacgtgattcttaaggttacctaattattttgaattataatacatgttaatatggttttgaattgtccatatatttaaatgaacaaacatgtttgcaataatatatgtctatttatttcaagttaataacgtatgtttttttcattgggccgcaataattctaaaaacatatgtctatttattcatatatagactagaacatgacatgtacgttatgatttgtaattagtgatgtaaaacatggcgtatttatctgaatagttatattttgggaaaccaagaactgcacacgtaccctacccataaatcaattaaaaattcaaaataattcttaaataatagataaaaaaatcaattatatgtttcttttaatttgggtgcctacagaaaattcattaaacgtgtgtttacactactcactagcaaacatagaaggtagaaaacacataggatatattttaaaagaattataaacaaaagaaggatatataataaaacatataaaattaatatttttatacaaaataagagaggaattctctcttaatctatatctatagatatataaaggaaaatattttggagtacatatttcttttttccttttacccctataattatctttttaaatatcttttttatccatataactattctcttcaatcaagacacactccacttacatcttgaaaactatccactgttatttaactttattatctttttcattatttttatttttcaaaaattatagaggcagagtgttactttttcccctagtcatgaataatagtggttcacaacatattttccttcaccttcgaagcccctggcagaggtaagagtatgcattccaagattattatttttttttttggagaagctattaggatcacaaaattctctatcatgacatgagcatacagatttgattaggcaaaactctttagttgagctagaagatggtgatagccatggagccaaagttctacattgatgatgatagtagtaggaactatggttgccatagaaggatgttgtgattgtcaaacacctagggaagaatattaactttcttacaacgtgatcatctgaagacaatttggaaaccttattgggggtgtagatgtagttgacattaggcttgatgttttttttatggtcaactttgatttagctgaggatagagaaaatgttatggtaatgatccttgaatgatttttttttttatcgatcactatctcattggtcatggatgtccgacttcatagcatccaagatgaagatcaataacaaccaagtctagatagtgtttttcctgtttatgcaagaaatactatgatgagtgttttgttagcattggctaggtcggtcagtgtaagtgtacatatcagatggatttgagccatcattgacacagttagagggaagtttgccatggtgagtatggaaatggatttgagccatctaatagtgggatatttatggtttcataacagatggtttaatattgaatattaaggattgcactcaattaatttgcaaatgttgcaatctatatggtcatgtgataagtagttgtgcgcaacagaagatgaaggaagtcacactattggcgactgcctaaggtggaggggagacaaatttgacgagggaacatgggtttgccctaatccgctagctggaatggcaatcatgttaattatggaagatctgtatagggaatggtttagtaaaaaaaaggaaagtgaaatcataaggttttaaatcatacatttaattaacatgattgcattgttagatttagcattggcagatcataggctttcttcgagagctgtaataactctatttatacgttggactaaactctttccccaatcagaccaaaattctactattaattggttcaggtttctataattttattatcaaattcaaaccaaatcaatccaatcataaaaaaaactgatttagcttaaattaattggatctaaatatttaaaatttttatttttattttataaaaatgagaattatttagaattttgtttttttctagatttttacatcacatatatggagtgcaaaacggatcacattatcacacagtttgatactagtacattaattaactaatttaactaaataaaataattttatttataatgctttacaattagaaaataacttatattatatatataaattaaaacgtgaatagtagactttagtctaagtatatataggtatcttaattataaataaggatgtaattattgaaatttgctactttcgtgtgagattttgactctataaaattgtgtaaggtagaggcatctttagtgcatgctttaatttgtatttcttaacttaataataataataataataaatttagttatgtatcatggatcaggttggttcattgattccaaaaacaaaactaacgagtttgaactaattgagttatatttgatatgaatcggctttagtatcgaaagggtgtaatttttttttaattaccgtttgtgggtataatttaaatttttttaccaaaaaggggtaagtcataatccctattatgatttctaatttagaagtcgtaactatatattttttaattttctaactgaaatcgtaaaaaaatttacggcttcagtatatatttttttttaacccgctacttcaaatgtgtaaaaaattttacgactttcaaaaccttttttataaagtcataaaaatttttacttctttcaaaactttttttctttttttctttttctcattatgacttttaaaactttttttttctttttctcatggaagtcgtaatgagtcttacgactctttctttttttaccttttaatttttattttactttttttgtaagtttttaacttttttatagttttttaaaacttttttctttcgttttttaaacttttttatatgtttttttttactttttaaaatgataaataattttgttttaagtatatcattttgttttttatatgttttttaatacttttttccattttatcttttttttatacatttttagtttcttttttaaacttgttttcttaatttttttagtttcattaaatatttgaatatgtatttgatattttttatttaatattattttatttaatatagtttataaattttaatatatttttatttaatattttttaatattattttatttaatatatattatgaatataccaaaatttaaatatattaaataaaaatatataaaaaatttagaaactatattaaataaaataacattaaataaaaaatatccaaaatataatcaaatatttaatgaaactaaaaaaattaagaaaacaagtttaaaaaagaaaataaaacgtataaaaaagttcaaaaaaatttaaaaaaagtataaaaagaacatataaaaataataatatactttaaaaaaattatttatcattttaaaaagtaaaaaaaaacatataaaaaagtttaaaaatgaaagaaaaaagtaaaaaaaaaaaactatacaaaaattaaaaaaaataaaaacttataaaaaagtgaaaaaaataaaaggtaaaaaaaaagtaataagactcattacgacctccacgagaaaaagaaaaaaaaaagtcttaaaagtcgtaatgagaaaaagaaaaaaaagaaaaaagttttgaaattcgtaaaaaaatttacgactttgaagtcacatattaaaaaaaatatatactgaaatcgtaaaatggattacgatttatccctttttgttatgacttctaaattgtaattgtaaaaaaatatataaattataatttgtgttatgacttctaaattaaaagtcgtaatatgaattacgatttatccctttttgtaaaaaaatttaaattatacccacaaatggtaattaaaaaaattacactatttcgttgctaaagccatatgaatcttcaaagtacttaaaaaaaaaaaacaatgaaaagaacaaaaattctaagaacaagaagaggacttacaatcaatgccgcaatggaagcatggaccattccttttcgccatatcagtgaatttccttttgtcttacaaatagaaattttaattagttaacaagtaaaataaattgttgcaaaattcaagttgtaaggacaatgggacgaagagaacaaaacttcagtaagttaaattacatacattctttactctttctttttgtctttcttttatgtttaattaggtgatacttgtttctatttaattttctctcctatcttcaattgttttgttcttatgcaattgaacagtgcttactgaaatttaaattcgcatgaagagagagcgacaagttgcttacatgccctgtaaatgcttatctgcatcatcatataggtccaaaacgatgaaaccgttacctttgacaatacacatgaactttaatactagattaaaagaaaatattgtaatataaaggagagaaagaaaggtggtagaggattacagctctaaaaacatttaacattattattaaatataatataataaattgtaataatattattaaatgttatatgtattaaattaataaataaatttcaataatattattaatttttatatacattaaatataatatattgattgaatttaataaatgtaatgttaatatatgtatattaaacgtataacttgttaaatgaataaaacaattatctgtaagaataatttttttataccaacttatgcataattctcaatcagttatatccttttagtgttaaattaatagatatgcatatgtgtgttcaagtatgtgcatatatttatcaatttatatgcattagtatttaatattaatattataaattagtaattattagtatttaataatatttcatttttagtatttcataggatataattaataatttgttagtatttaatatttaatttaagatttattggaatttaatatttactaaattaaatattaaatattttcttcaaaaaatgttaattacattaatagactaataaatatataacaataataatattaaatattaatagatattttttggtataaaaatattaaaagatattaatatatatttaatatcaaaattaataatacaataatttaatattaaggcttaaataagattttggttcctaaaaaataataagatgtttttaattttagtcctctatttttttttttagttttaatcctttaaagatttaatttttttattatagttcttgttatcaaacaataacattaattgataaagtaacaatgacgttttcaattcattaacttactatgtcattgaaaaatctaataagacaatcacatattaacttttttggtaaattgtgactttagatcatcatgttaatggtgtctgactaattaatgaaagattttaaaataaagtttacaaaaaaaaaattacatataactccatgataacataacaagtcaatgaattctcaatgtcactactatgttataattaacgttattatttcatagaagagactaaaaccaacaaaataaatctttaatggactacttttattaaatgactaaaattaaaaagcatcctaatttatagagaccgaaaattctttctttttttaccacaagaattgaagacaaatatgggaaattttaactcatataccatatttaaccaaccgagttaaattccttctttacaaaaacttattttagctttaatattaaattattattaattttaatattatatataaaaatttatatgtattgatatttaattattattactacataagtattaatttattagtatttaatttattgattattaaatgctaataaatcttaaaattaaatatttaataataacaaattatgattatatcttatgaaatactaaaaaaattaatagttattcaaaaatgtagtagaccaagctcatttgaggctggttctggacaattggttaaggggattctatgttgtggggatctgaggactactattgtattaataacacatagtgaaaaaatttaatcaccattattttaaaattttaaagttaatgaaaaactaatattgtttacaaaaaattaaagaaaagaaaaataaaacaattaaaaaagataaaagataaaataaaaacttttaaaatttaataagccaaaatataaaaaaaaaatactaaaatataaaagactaaaattaatatttaacctatgaaaaactaaaatagttttcaatccataatctcgtgctaaattttttatctccaaagcaaataaaaagttgtactaacagataaatgacttttaacggtcaaccagaataatgatgacttgttcttcttttcaattcgtatgtatttaattatttttctctagccttttatttaataattaagatcttatcttcacattactgaagactgaagtagtatctaagtaaattgagttgttttttttattatttagtattgggtttaattgattcagctcatatgcatgaatgacatatatggtatgtacaaaaaaaaaaaaaaaaaaaatcggcgtatggttagtaaggtctcgtttcaaaattttatatagtataattaacaatttccctaagcaaacgacatttaagcttttgttgataaagtttatatggcatttactaattttatatataaagttatattgtattagaaattaaacgattaaaaaattataccttcaaatagcatttttatcacatgaggttaaaaacagttatataacaaggaaaaagaaaaggctttggagggaccatgacaaaataattctacctccaggctccggtcctagatataataaatataggacaaatcatcaagattaataaaaaaaattaattatttttaattcatactactagtcttcctttgaatcaagttgtattttgtaagctatatattacttatcatcaataatggatagaaaattattatgagagaatgaatcggctttggattgttttcttttttcatcaagctcgtttaatttggagatgggtatattgtgcagaattttgtacgagataaagaaaactttattagtccaattgttactccctttccatgatgcttaattgttttcttgtaatcttgtgcttgatacatgttcaagaacacagaagatacgaggggtcagtttttgggaggagaggtatcacgataacaacttcatccatagttgattacgccacaatggtgactgactcaaacaattgggaagatgttttggacagattaaattctgtaaaatgcgtattcttcttaagggcaacacatgagcctatatatttatatatacatgattgttttaaagtgtgagagatattcgaaatgaataaaaggttgtatcatttaatgaaaatatgtgtctatttacaaaagggtatatgcaagtaaagttatattcttttatgaatgtgtatattttttcataaaaagatatgacaactcatgaaaagatacgagtatgaaaggttgtatcctttcataaaaaattgtcttatttcattaaaatatgtttctttttatcaaaagttattagatgtgatttttcactaaaagttaaaacatacgactcatgagatgaatctctgcaaaaggttacatcccttcatcaaaaacataaaattgtccataaatgtgcacaaagataaacaatgagaatatcccaaaaaataatcaaccctaaataaaaactactaaagagacctgcgattccataaaaaaccatcgtggccccttgcggaataaatggaaaataaataaagtccgaaataaatgaaaaatcactaattttctcataaataaagaacaaatccatatcattcaaatcaatttctttcttcctttatgcataaagagaataaaataaactattattttgtaaattaccattgatgtgatgcttgatttgaatttgcaaatcatatcaaggaactatattgaatcctggagggaattgcgagtaaaccttattgcatccaattaatctttatttatagagattggtaggaataaattaaatcttaaggattatcatcatcaatgattttttcttaaatatttcgttattgttgtagagtcatcgccactaatttgcaccaacatgaagtatcttagttttatagacataattttccagagatgcaatagtttttagagtttttttatcgacgtcgaagaatgagttgatgactcataggcagtggtttggtcaagagaaatcatcggaaccatagcgaaagtgagtcttcataggataattgtcactgtatatggattcgaacctggatgatctattcatgacctgaagtttggatgaaactaagtgaaggtccgaacggtcgaactgatgttgaagaatcgaatgagtcgtggttaaggtgaaatgccactcaaacctatgttcttcccgaaatgtgttaaggcgcaacaattgaatggacaataatttaaatacatgttcaactaattaaacaaattttttggtatgactcactttgtatattaatccaaatgctaataataataataataatttgtaagaaaaacacatatacatgatatattcttaattagtatatattattttgaattaaataaaagacatattaatatgatttttaatatcgtgtccatatttaaaatgaacaaatatgtccgaagtactaatatctgtctatttgtttcagattcataatacatgtctttccgtacatggcacagtaattctcaagaacatgggttgtttatcataaatcataatttgtgatattccataaaggttttggaaacgaaaaaaaaatccccttcaccctacacataagtcagttaaaaatttaaaattaaagaattcttgaacaaataaaaattgtcagtaatatatttgtttgcaaccaattaggtgcccacagaaaatattaaacgtgtatctacagtatcattagcaactatagaagcgtagataaaatgctaagtattataaacaagacaaataatacaatatataaaattaatataaacttgcatcgaataaaatttttaaatcttgaagaaatttatattttaaaaatgagcatacgtttatataaacataataaaattctaaaaaatatgtaattatattgtaatcattttccattatatttaaaattacttacgtatccacatcacgtgatgcactttaaaatgatgatttataaattatgtataggttaatacctatactttatttcataaatgaacactcgctattgatcttgttagtggtatgatggtgactctatcatttttgaaagacagttcctatattctttaaatttctccttttgtcttcgtaaaaaagaaaaaaaaaaaaaaaaacctccgtttgtaaattgttattttacagtttatcctttagctaacttaattataaatatttttgtaaaaaaaatacagaataataatgttaaaaatattttaaatattataaaagataaaatagtgagatagaatgtaattatatcaagaagttttcataaatatatacgaagtattttatttaaaacatttgtacacctggcaatttttttctcacatattaatattttggcaataacgtttcattaataatttattaaaaaaatgaatattctatatgaaatttataatccatcttttttcatcacgaaggtatatcacttgaattgaatttgatcttatttcatatcaattccatgtagcattttatttatttattttatccaaatgtaccaaatagttgagggttacaatatttttaggcagttgctatatccacttcccttctttgtttattcatttcttttttcaatttgttttccaaaaaattgaataagcaaacaaggagagtgtatatagcaattgcctattcttgtgagatgtggattgagtttgaacatgcagcccatttcttattatgagtgttaaactaatagcaaacgaaagggaggaatgggtttcaatgactatatccccataaatgcggccttttaggctaaagaagcctaacgagctagtacataactctaatgctttatggattatatattctctaatgctgcatttcttaaaactaaaaggagaaggggagattcttgaatgaatttggccaagcattgtccaaaggaaaaatcctaattctatcaagaatcatggcatggacagtgctctctagactctagctaatggtgaataagtagatactttaaatgaaaaatgggtttggggtgtttcagatttcattgatgaaacagtatggatactattcttaatttattgtttgagaaatttgaaaagcttaaacttgtttatttaccaattacatatcaattcagatctcacggttacaattagcctgatccaagatcgtgagattcaaaatattaaaatacatttgtgactcttacagctgctgattttccagccgctagctcttaaccaagtaaaaaattcaagcaaaacaattagtgcaaccagcaatgtgtgtattaacacagccaatagaatgcaaaacaaaatatcttatgaaacacccaacataaacatcccgaataataaattcaattcagcacaataggaagaactatcttcattttttttaaagaaaaaggctgtaacacagattttagtaaattatactaattatcattgagatttcatgaaattacacaaacattccttaattacttttttctacccctatactaactccttttaatttttgaaaaatatatactgacatcctttctatacattaccctgaaatctaagactaattcgaatgaaaaaaacaaaaatcgagattgcaaaacaagcacagatcgtgttttgaacaatcacaaacaattataaactttaagcctcatacaatcagcacctaaactgccgtgcgtgtgtacttctctcaccttccattagatctatcgtttgggtaaaattcactcaaagatataaataatattttttttaaatggttgtaagttgttgaatttttgcaggattgaactgaaccattgtaaaattcgtctccccgttccatgggccatattatgcttatcgttttcctaagaaacttgagactttaatttcttctttattttttcttgaggtcttttggtcccagagtagtaaatgtgacatgaaattccgccgaaattatggactgtaaattgcaacaagtagcaagaatttggtcgtggtcaattatcattgattaatggtagaacattttaaaggaaaagggtgggaagatgaacatggtgggaggttggcacaaaatgtttggtattctgtcttagtaggaaatgcgttaggcatcgcagcactcaaaatttcatggcatgccaaaagatataagtttaaaacaaaacgaagtcaatccactttcttacaatttggaactttgtatggtggagtttaactttaacctctctctctctctctctctatatatatatatatatatatatttatatgtgacatttaatataagaaattagatgaataagatatttttcagtcaaaagctaaaaatcaattcttttaagatgctgaaattcatttaaaagaatgagttatcccagcatatatttgttgtatgtacatgtaacaggaatcaaactcatgatcatatatttaagagataaaattatctatcaattatgttatcaattatgttacaaattataatatttaatgtcaaattacagcacaagtgacaagttatgaagaatccttaacaacttgaattaaggcggaaaacacgtacatccagtactactacgcatcgtgtaggagacttcatcagtttctgccctttgtgatatgatcctggttcttttatgatggaaaatctgttagaaatagaactttacctcgataaatcatacaatatatttaagatagttttttttaataggcatacaataaaagatagtattaaaggttgatggtgattaccaaaatcaaactccaattttaatgagaaaacaacaatataattcttgacatactgaacttaagatttgtttattttgtcgttgtgaaacattaaaatgaaaaaaaaaggtttattagatgtttcagggttaaatatgttcttttattataaatatatcatgattttgtgtttgatgcctataaaatatttattcagattttgctccaaaacagttaataaattggcatatttaatttttaatcctccacataagatgcatggttcattagggaaagtatgaaaatgaaagaaaagaaaatatgaataattatatttgttttctttgtttgattgggcagaaagtgctttccaattaaatttcaattttcttcttctctcattttcattacatattattgattcgattattgattcgagtaaaattggaattaattttttaaataaggtctcacatgtttaagttctataaataaaaaataatgtgtttaaaaagaaaaatttataaaataactagttaaattcttccataaaaattatttgttaataaaattagtaaatactttacattcatcatgataatcctaaaaatcatatacattaataaggaattaaaaattacattatttataaataaatttattacttataatgtcattttagtttaaataaaattatcttttttagagtattcatagtttataaagactaatattaattaacataaatgataataatttatttttaattaaaatctaatttaaatcatgcacatgaatataaaataaattatatttaatagaaaaatatatattttgtatacacttattattctaaataaaaactaattattatttataccaataaatatttcatactgatattttagtaaaagaagtaagtctatagataaaaagtaatgacccttaattggcagacgcatgtggcttggtcacaatttctcggacaacgagtccagccatggtatttagtaattaataaccaaccacccattaaatgtgtgggccttccctgactcctccattataaaagcttggttcttagtcaccgaatgcactcacctccaaaacaaatctccttctttaacttagttaaactcaactcaaggaaatggctctgggaagaggcagtgcagtagttctactactttgcttcttgctgcttcactctgagatggctcgtgctgccacctacacagttggagattctgctggttggacctttaacactgtttcctggcccaaaggaaaactttttcgtgctaatgacacacttggtcagttccaattattctatctgtataagatttactattagataaattcctgggagagagattttggagaggaaagaagggaagaaaaaaatttatgtagagacatttctttgtttgcgagttttaatttttgagagaaaggatttgaggatttttaaaactcctctgaaatctttcaaagctttaaaattattgttccccctattcgagggatttttagaaggaaaagtaactaaaattattactataccagtcagtgttaataaaattactatcatatcctaatcagtgtaaaatatataatgtattaattttttaaataaggaaaaaattgtaaaaatttcttattaactttctattttcctctcttaatatatttttaactttcaaacaaggagaaagaaatttcccttattttcttccctttccttctcatcctttcccattgaatctctttcctttctctctcctcctaactctcaaacaaaggcttaagttcttttaataactactttaatttctcaatttaatttttcatttttaaccaccgacaaattaatacctcatttgttttaaagaaatttatacctcaaatctgattctaattaataaatagctaaaatatattttgttttaatttaacttgttaagttaaaaaaaaatattttggttattaaagtatttttattagactaaactgatcttttttgtcagattacatatcaacaatattaattttaactgacttgataaatactgatgtgacatagcatttaatagtttgtcacgtgtgactaaattgattacatgagtgtaataaattttttataataattaaaagtcacatataaacaagtgaagagtgtgttgcttaatttatattattaggtgaaattaatacaagtctcttaaatatgttaagagcttgttacaatgtcttccatacagtatataacacatggaagaagtttcctttttgataattcttttatctagctaacttttgaaagcatgaaatcgatacatttttgtgtatggggtgcagcttttaagtatagccctggggctcacaatgtggtggtcgtgaacaaggctggatttgatagctgcacgactccaagaggagccaaagtgtatcagtcaggggcggatcagatcaaacttggcaagggactgaactacttcatctgcaattatgttggtcattgcgagtctgggatgaaaattgccgtcaacgctggcgcctgaagttaacttgttaacttctctctactcatacatattgtattgtaatgcaaaaagtgcaccctttagggggaagttagctcctttaaataagcggatagatataggtgtgtatgtgtgctattctataaatgtcacttatctattaagaataaatgtcggcagtatgtgatatctatctctctactctaaagtgtaggtctttgcttcagaacttataacttttagtaaaatacaaactaaatcttgcttaggccactttcattttcatatacttaaataaatataattattgaattatttggtaatattttaacgattatataattatatcatttttcttagatacattagatagagagtataagtgttatataatttttttctcacttatctccattaaaagtaataactaatcttcatttgaaaatgtgagtatacataagatgaataatatcttctaacaaaatttattaataagatgagtattttttacaaaaaaaattcatatttaaaaatcaataaagatttgaaccctagaccacttgattaagaaacataagtcattactacttatgtcaaccattattgatgtttaagtgtcatatatgtcttatgtaaaaataatcataatatcatatataattattataaaaattaaaacttatcatatataaaaatttgttattaattaatagataaatgttagtcacactttttctaatactctctttttaacactttccttatgattggctaaaatttgttaaaaaaaatatcaattttggtgggtctcacttatcattcaatgtttgtctctcttgatttagatgatatctaccaaaattgataattttaaaaattttcaaacaatcacaaagagagtgtcactagcattcatataactaataagagaaaaaggttatgcacttagaatgtataaaattttacatagtcatccaatcatgactcatcatgtatggtaaatttattgacttttaaaataattatttacagtaattcaaacagtgatttatgattaaatgacaatgtaaaattattttacactttcaatgtatagccattaataatatcatcaatgacaaataaaaaatgacatatttgcaaggaccaaaataaaatattaacatatttgcagaaactaaaaaaaagtggcataattataaggactaaaatagaaaacactacatattcattaggaactaaaaacaaaaagtaatatatttgcaaaaattttaaaataaaattaacatatttatcataactaaaaacaaaaagtaacatattaacaaaaagatatttaaatattaaattaaacttaattgataaaaaaaatagcttgaaaaaagaattctgaccgtttcatgttaaatgatataggagaatgatgtacgagatacgtttctttataaataaataaaaaagataaaccttttacttatattttctttgtttttatatattaaaatgatagtaaaaatatttcaaaaaatactactatagtcttaattataagcaacataaaaagattatacttaaatataaataaattttgactactttcatactacttaatgatatcatctaaaaaatattatttaattaattgagattctattttcaataaaaaaaaacaattcttctttatatcaagttttaataaagaatactttaggaaataattatttttttaatatgattagtagagttaaatgatattaaataattttattagttagttttaattacaattaatattacttataattaaattcaaatgaaatatatattttaaacttttgtgggctaataatttaacccaacaagcccaccaattcaactcatttaacttaaaagttatataaatcaactcacataaactctcaattaaatgaaacactgttttttagactcaaacccacaatttttcaaatttatacaatcaagttgtgaattaaagttcgtatatctaactttaatgataactgaattaaaagcattatgactatagggccgggctgtaatatttttgtccctaaatcaaaagcattatgactctggcccaatccatggccttgagtcatcatttttgaggcagtagtgccccagcactctccaaccatccccattacaattggccttgagtcgtcattttttatgggtaattatttaacaagtcttattatttgctttggaaatgcacttggggtgcaccaaagtatataatgatgtgcattaagaaatattcttttttatgcaaatggttgaacctttaacaatatgggttgaccataaggaaaatgctttggagtgatatttgattcttgcacttccattattgtattttttattttttattaatattctgaaaagtccattaaatggacttttcagaatgtaataggaggtgcagaatacaataatgagaatataggatgcaatagcccttggttagtgatgcacttgtttagtatctttggatattttcttttattttttattcattttaaaaacaaggttcaaaagattagtgtaagaaacaagaaatctaggctgaaggtgaggcacaatgagccagaattacaaatttgatctatggtttgtaactttattttcatctatgggcctttgcttgggagttagagaagtttaactattgttttataattttaaattggctaaaatgtatttttggtccccctattttttacaattaataattttagttcttctaatttaaaattgagacatttagttggtatttaaaaaaattagtaattttgatctcactgtttaaattagacattgactattagttttataacattgactgtttcatgggcaaacattaactcaattagaagtagacaaaaccaatcactttctcaacaacctatctccacctttatcgattgaatctctccaacagatctagcatcttctatctagtgtgctaattgcttgcttttattatttttttttcttctaattcactttaagttgtttaattaattacatctttgtgcaattaccaactatgatatacaaatatcaaaggaaaagaaaattgttcaaagattaaaaaaagtgaagcattttctgagctctcatctaattttcactaacacaaagttggtgttgagttgaagcaggtagaaaagttccacctattaaacactccatctaattcaagcaaaacatacatatcaatcgagttagcataaaagcttattaataaatcaaatcatcttgtgttgattaagattctagacctcaacaataaattgaaatgttgtgaatcctagagaaggtttgttaaatatcattcggatccaaaataccgatatggaagcatgagccaaagaaggcgatgatgcttacacaaatgcaaatagccttttgtgtattgtctctggtagtgccatggtgcttggtgaagggagaggaaggggtggaataaagggttaataaataaataagaggttgagggacacgggtgctcatggtgcttttatggaggaagataactagggtacagaccaatcaccttcattggagatgataacaatgatggtaatgacttcgttggagatatgtttggatatagcagtcgtgttatcaaggtttgagaagggtaatgactaatgtgcagtgagaactgataaggatggtgtgaaagggttgacgggtaatttcctcaatcgtaacacgagtcggtataggttaacgttaattcttaagggttaacgactatatttggatggtgggatcaaaattactaatttttttaaaataaaaagactaaatttttcaattttaaaatagatgaactattattaattataaaaaatacgagaaccaaaaatatattttagccatttaaatttgagatgtgatatacctaagaaaatttatacaataatttgcacaacattaatttgtggttatcttcctgcatcattatgacatgtattaattaatgtgtatgagagacataaacacaaaaaaatgttaaggtacaacttgttatatgaattattatagaaataacatttcttttttaaatataaaagaaagaacatggcacatgactaaaagtatattttattcagtcttttgtggaaattatatattacttacgattcattgtcctaacttgttagtgaattcaattttcaatactatatagcatatatttggatacgcaatacattattcagaaatcattttttaaaaagtttatggaaaaaacaactctttgtttgtttgaattctccacagtgaattttggagctaaaatcattcagcaaattatccaaacatgcatacatagtttaggactaaattatcacattcttacattttcaggaacaagtgattatttctcctttttttttgaaaaaaaaaaaaacaaagtttaaataattagtgagtatacgatacttcaattcatctacattaaaaaacaacaattaaaaatcaacaaacaaaatatctttcaacagagaaaaaaaaatacataaacctacattccaatattaatcaccttatggttatgcgaaaatcacccaagaccttaattggccgtacatgattattatattagctcaacttgtaaattactaactaaactaaactcaacttagtataccgtatcgtatagtataggactaatacaaacaccgatgtgaacgagaatgacaatgaattagagagaaaaaaaaaaaaaaaaagagccccaaaatcgatctagttattattattcagaaaacccacaagatttattggcttatttctaaagattattcaaagtgaccaaataattatgtggcaaataaagaaggtaattgctatttacgatttctctttttaattatacagtactccccttattttgcttaatatactctttttttgtgcaagctcattcaattctctagagatgctcccatttgaagtggctgaactctataggaagccttgcctttcaattccatagagatgctcttgcaatgcttgaataatttcttaatgtcttcaatactcccttgcgatggccaatgtgaatatcgtggtcctcccgttcagattcaacaggaacttaatttaaaattagtaataatcaattcgcacttataatatggtaaaaaagaaatttaaaagtataaacgtttttgaatcatatatcatttttgaaaagaacacagtctttgtattaattgtgtaaaatattttttataatattattcaattacaaattgacatttttgttaagttgacttttataataattatttaaaaaaattatatttatcataatttttaattagttgataatgtaaaatattttttgctaataatgtatagaaattaaattctttttaattagctagacataaggattaaatgagatgtgtgattggatttaaatattagacaagaattaattagactcgtatgataaaaagtattaaaaaaaatcaataaatactatttttttttttttgtgaatccagaaatactcaattaaacacaagcaaaaagttgtagtccatccgtaatgaaatcgcgcgtaacataaatcaaagtggtcttaaatctaaacacagccagccaacaaccaatatgagacaaaatcataggtaattgaattgtaacaataaattaatgtgatgtttggaacggagaaaaattatgggagcattttttttcctactttgcaagacaattaataaacagacattcctcaacatttcttaagaataaatgatgaaatcaaatatatacatatatatatatatataaggaaatccatgactctaattaaagataagctgaatctgtactttaatttgaggtcatttgcaaattgctagctacctaatataaaacttgtgaacctgccgagtgcgggaccaatttataatatctttcagaacaaattggcaattgcataatcaagtaatcatttcaaactttaacataaggaacttgctgccattaatttctttcaggcctaacaaaatgcatgaaagctgaagttagtcccgccagaacaaaattaaattatatgaaatttaaagtcatgcataggaacaaagatctaggtagggttcgtaaaattttaatcattatgttagttgcattacattatagaggtacctacactattgagaaattaaaactgtttatttccgctttgaaatcctgaacactgattcgttaattgttgcatcataagatgatatatggtgactgatatgtgtcagctccaaaggacactaatagattcctccctcccattgtttacaaaagattatccaaggcaaagtatcttcaaaataaatgtagcatgcatttgccttctgttacataagagcaattcaatggtttatgcggattggcaattgtaaaatacacattcagcatttcctagacatgactaaaattccaaaagattgtctgtggggtgcattactgttcacaaaagaccaaaattttcttttttccaacagaaagccagtcaagcaaacagctctacacggatttgtgttcttatataataaggccaatggtggggaaaacaacaatatctataatcttagcttatttaaaaaagaaaatgttttatagacagctttgagatagaaagaaagataattaattgttttaattgataatgtaacgtaatatgatgagagttattgattagatatttttttaaaaaaatattatcaaaatataatctgtctttaaaaaaatgtccagaagagtgtctatttttactgtactttactcgccaataagttatttggccgtagttattttcaaatgacgtttacataaccaacttcagaaacaactaaaaagaagagttgagttctgaaaggaagattaaaaaaatagcttttgaagatggagagtttttataaatagcctatatccttacgctgattttaacttatagaaaaaatttacttaatttttttttcctttttataaatacttataaaaaaagtttattcaaatggaaacttatttttattactaaggatcaattttgttgataaatcaaaccaaacaaaacatagatttgaatgagtggtttttaatattttaggctgattagttttctttaaaaaaaaatataaaacaaggtctaatttcacttccatgactcaaactaacatcaaagttgtccaaactccaaattattcttataaaattatttgttgcggacctcaagggtgaacggcgaagtcattgggcaataggttcgatctatacaccaaatattattttactaagcaaacataattaatgggattatatatccatgacaatattagaatagcagtataaatgacttacaatatacataatatactaaacacttacggtacgtataattcacccaattattactttcaattttcaactttcaccttttcaatttttagttaatttttcaattgaatatgccaaataaagcctaaatttctcaatggccattcatatataaataattaacgttgatttttatttttctttatattgttggcgaaaatttaaatgagcctttgaacattgaaatcagaagttccacaatcttcgggaagggaatattcaattaataggtaccaacacttcccccttcccttaataaaagaatacccttcactatcactattattactattaaaagcaatgacccctacttagaggataacaacagaatggaataaatcaagatcccgcactaaagattacactgaaaagatattcaattaataggtagcagtaccatatacgagtaaaaggaattaattaaggtctatatttgaggttaacctccttctcttatagaaaataaccctcactagtactattaaaagcaatgatgggttaatttaattcaggaatataactctcactattacaacagaaggaaataaattaagaattatattcctgaatgatatttgtgattttttttttataaaatattaaaactaatttaatttatgatgttattcaatgagtaatttaaaattatgttgctaaaaaatgtttaataaattaatttcattatatttattatatatttataattttttttactacatcaaagatatgtgaatgtctcttaacttatttgatttaatattaattttgttcatgacatgtggttggtgtgagggatggatccaaggaagggcaaggacaagccttggctcccagccccctcacccctctttagatcctttgtgtaaatatgagaaaaaattaaaattaaaattaaaatattaataaaatataaaaaataggttttggagttgatatttgctaaaaaaaaagcagtagtttattctccaattttatccataaaattaataataataattttttaaaaatttgttatttataataattatttattaaaaatatttaaataattatgtaaaaaaaaattggccttccctttaatacactcttagattcgtttccaactaccgttagtctaagaaaattttccatactatttctcttgctaatagtattagacaaatattaatagaatatgatatcttccgttaactaattgaatttaaactaattttagtatagcgagcattatcattcataataattttgaataagattgtatcccgtaaataatcctgtggtttatatcataaataaattaaaacaaatttaatttaagatgtatttgttaaagtaatttaaaattattttaaaatataaaaatatattaataaattaattttaacatattaaataattaaatgtaaattaatttttatatggtaaagaaataaattaataatattttgtcattgaaagatgtatattccttacaaagtaattaattattagctaatatttattcacaaacattgcggggacaaataatttttattttccatctcatgaaaaatccttggttggtggtggtgggtgttgctgttagatacatggtcgtgcgagtgcattttgtggataagttagggtaggaattgtgtttccatttgaaaacactacaagtctacaactcataatggtggcctcagacaccattgcaaagtctaaattaattatataatgcttctaggaatccaatgctgcaaccgctacaatgggtcataaaatatttctgctagccaatggattttgaacaagtggaaacgcatgcagttatccacaacactttaggtttaattagacttgtaaaaaggtgcaacattaccatcatagccaagacaaaagtttaggacactaacaaaaaggaaagttaaatagtaaaagtatttacctattcacgtttcaagttcaagtttggaggttgacttaagttaacgctagcaaaataaaataataggtatatgatcaataagttacgcgtcagagttaatattgacttccaccctcaagatcctctttactaggaaaaataaaataaaataactaagtaccttcaaagcatagttattttcatcaagtattcttgcctcctttagtatacgtagtattttcatcatcaaagaaaagggacgtgtttctgataagtaggaacctgcaaaataaaaaccaattagactcagaccaaaattaaagataaacgtaaatgtataactcaattaacatgtgcatggtgtggaagaagataattattgagaagaaacttatgaaagggaattgagcccacaaggggtttctcggagacagattcacagagcccgtttggcctactggccacctccaactgccaccattttggggtgattctaaaacaacccatttaatattaatggaggtggacagaatgccaaaatggctatggaataaggcctctgagaaaccctagaggcaatatagagcaaagagaaagcataaggaaatttggaaattcgatctggctgagatttgaagaagagattatgggtaggttttgactaaaggaagaaataagagtggcttttgtagaaaggtgcataagcgtgcatggagttattggaatatttggccccttgggggctagcttctgttgttttcaaagactttcaatccctctgttttgtctgtagaagtttgcatatatatatatatatatatatatatatatatatatatatatatatatatatgtttagggcttgtacgtatatgacaatgatatccgcttcttatttgcaataaagacttttgtgcccttagagtgcaactctttgatgctaattatcttgcacgtggttggagatagtgaggctttctttgaccatggttgttaagttgctatttgcttgcattgtgatttcactatgctttttgacttgcttctaaaggtggatgcaaaatgggctggccatgtctcccactcagtttctaattatttaatttgtcaactcactgtttatcagttcaacctttgacgtttattgtgcatattcctataagaaaactatatatttacaacaatttaatggcttccttgaatgatcgatattatggtcagttaatttgaaaactgaatgtctctagacataataagcaaaacagcggttggtatataaaataaacatggaaagaacatgcacatttttaaaagattactttgaatatcgatcattaactgttccataatttaattattagaagtttgttttttccttactttataaatatcaaataatcattttctatcataatcactacacacttttatggagtgtaaaacatgtacattctcattcttgttattaaaaaaaaaaatcccattcttaccaatcatatgcctttgcgtctaatctttttattcattaaaagcataacattttcaagtatgaacccacatctgcaagtaatctagcacaattgtaaagattacctgtgtcgaattttgtaatttaggtaactaaaagaaataaagaatataattaaataattattatttttaaatatatatatataatatttaaatatatatttcattaattttgatgtatatcaatgaagtgttaaataaaattttttgatgtatttcattaataaaaaattaatccaattttaagtatataggggtaaaaaaattaataatctgatattcagtccaattaaaattgaaaaaatcaatccaaaaatttggaaaacaaaataaaaaatatttttttattggatcagtttgaatttgatttttgaaaatcaatccaatttaatccagccaaacaaaacttatacatgtacatatgtttttatttttaatttttttatattactcatgtttattttttgtttcttttatatttataaaattatcgcataaattatacttttttatgaaaaatgtatttaattaaagataatgttttattaactattttaatcaaggtgcataaatatatttattaagtggtgtaattttttatatttttatgaatatattagctcatcatcccctctctaaaagtgtattatatggagatcaaactccattccttctctttcaaactcttactcaactacatccattaaatttaatgatatacatttgaagagttacgctatactcttgatatacaatgacttgacttatgaatgagatatttttgtattttaaattattttttatgatcattatacaattgaatattgatttattcaaaaccgtttcatatttgaatcgagttagatcacatttaaattataaataaaaataattaattggtaaattaaaagaaattaaaaattgattgaataaaatgattttttttctttaaacgatccaatccagtatgcaaattaatacccctctagtagcattaattcaatattgctagctacttcaaaactgcatcgctcctgtcccatctgcctaagtaaaattcttcccaatacattaagttttatccttaacaagaggcttaaaaaaactatctcattgtgttcttactatatatcacaggaagataaaaggtatatgaaagctaaagagacttgtgcaaaagatcattaattagagtttgagcctttggaaagctagagagaaatatttgggaatgtgaggattaggtatactattaatcaaagttggtgggataacaatattagcatgtttggtagattaatgcaatttgaaagaaaaaaatattcataggaatcaaaaataatattagaaaatttataataattcaaacgtcattttcaactaattgaattaaatctcattgactataatttgaagaagttaattgttataacttacatttttaatatatatatatatatatatatatggaacaaaatatattaatgtactattaaaagtgttacattaattattagacgttgattctaatataatttaatggttacgactaaggatgagtatggattagattttaaagattttaattcatattcaatttatatctacttaaatggattgaatctaaaatttatatccatattttttaaaaaaaataatttgaattcaacatccaatctatttaattggatatggatttggtcatgtttaatttatattcacttaaatgttataaagatttttttttacaaattttagtaattaaacgctaaaaaataaaaacttagtacatgtccatttaagaactattttcaactaaccttagtcaaaactattttcggttgatcttgattaggatattttcggcctacctaactaggacaattttggctgacatcgacccagacatttttataccaactttagtcaggactatttttggtttgacatcgattagtgcattttcgatcgacatcggtcaaggatgttttggattgatcttagttagattattttttggttgaggttgattatgatttttagtcaatgtcgaccagtaatattttttggccgacatcgactaagggtttttcaataagcatcgactgtgactagtttttggacgacgttgcttaggatttctatggcggacattggtaaggtttttttatgatgttagttgttgatatttttttgtcaacatcagtcagaactattttttgattgacgttgactaggtttttgtactgatgctagttgaaactattttctattggcatcagctagagtttgttggccaacatcagccatgactatttcttttagttgccgttggctaaggatttttttttacattaaccatgatttttcaatcgacgtcaattgggagaatattttggtctacgtcagctaggttttttttttgccgtgtcgatcgatgatgtttttagctaatgtcagccaaaaaaatcctaatcgacgtcgaaaaaaaaaactctagctgatgtctaccaaaaagctatctaacgttgaccacaaaataatcttgacagacatcagtagaaaaactctagctgatgtagaccaaaaaatagcctcgattgatgtcggctaaaaaaactttggatgacatccgctaaaaaatagtcctaactaacgttggccgaaaaaaccttactaacattaatcgaaaaatagtcttaaccaatgatagctcaaaaacatcatcagttggcgtcggctaaaataactctaaacgacgtcgaccaaaaaatagctcctaccaaagttgaccaaaaaaacctaattgtcattgttcaaaaaaattatattggatttaaaaatccatacaaatatccaattcatatccaatctatatccaattaattggattagatttaaaataaaaaaaatagatataaaattagaccatttaaatagatttaaagtgaattaaatagaatagaatatgaattgattttatatatttgaattttttttccaatcctgcctaccatgtaactacttaaaaaaaccatgtgagtcctcctccttggtttcacattgagcctcctggtcctgcgcacacacacaaaataagactttgcggcaattacctcctgtgcctgtgcttgcagaaaattagggaagcagctattaacaattgccagttgccattactggggtataactaaattggcttggcatttatattattaaaatagttaataataacaacaatgatggattttaataaattcatcgtataacacttcaatatcctttttttcaatcataactcaatttgtgaaattgcaatattagataattttttattcaaattgatgaacatccatccttttatgagtatttgaggatctgggaatttgtgtaattgctgcacaaagattaataggaaagggttgggtttatccgtacatggtgatcccaatatttgtgtaattcatgcgcaacacacaaagcgggttttagatttaagaggcacatgttttgggatcattgcagcaagtatagcagtggttcattcatataatcattttcaaaattgtgaaatcacagcatttgatatttctttttatccaatttgagagtgccctcttttttattatttcggcgattgattgggataatgacaacaaaatatgggttttttgttcacaccccttgttgcgcagcaattacatattttctgctagtaagggatttttattcaatagaggcacaagtcctaaaaattaccgattccattcgttaatagctgccgcaaagcctcttttttttttttctttcaattgtgcgtaggaggctgaacggaaacaaaagaggatgagtcgcgtccttttttttagtagttacatcagaagcattagattatattatcgtattttattatttaaaataaatatatcatataatcatcaaatcttaaaaaaatattatataaaaattatcaattcttaaaatatctcaattatatttttatcattttgattctatcattatgactcaacttctatcaatgtgatgactattaattgtagttattgttattattattagtgatggttacaataatcatgataattataacaatagtttaagtagtggtgatgatgaataattaataataattttaataaaaaaagaagaataactttgatatgagagaggcttatagataaaagaaaagagaaaaatgtgaaaaaataagagaaaaaagatttttttttaaattaaatgataaaatatgtaaatatgtttacattaaattttgaaaaactaaagaattaataatttttttggtaaagaagatttagtattgagcttcaagggtacaccaactagtgtaaatattagcaatcacacacacacacatatatatatatagtagaagtttattaacagggatgattgctgttatcttctgcaatcatcgtcctcatttaactacattttgccctttcttctcgaggaccttcacatcacatgggtcatgggtattgcagttatggagagaaatgaataaaagaaagctttagcatgctaccctagctagtagtttgaaagtgaagaatctcgggatgttttcttaaaggaatctgaggactaaggaaattagaatagcgatacataagacagtgacatacagacatacagttgtctggcgtagcttatgtaaaatgtaaagaaacacgatcagtttctttaaacttatttattaaaataaatgtttatttaataaaataagtaacattttttaattttttagtatgtttgtcttctgcttaaaaaaacaattttatacttcttatttacttcttaaaaaaacacttatataaaaaattattattttaaagttatttttcttaagtttaaataaactctcccataaacttttaaaattatattttggctttgttgtattggtgtagttttgatattgtgagtgattttttttatattgttacaattagaaatcactttgaataccactcttaaagtaattaatacaaaagttgatagtttttattatagtaacaaataataatcaatgattgattaacttattcgaattaaattcttcttgcatggaatgccagagataggtagttttagcaattttgtacggttagagaacaacctttgggatcattttgcagtttgtggcttccctattgctggaaacaacattgaacattgttcattctttctaaggaaatcagggttataaatggaactatgctctatattgaaagtgttaccccagtggaagacaataaaatgtgctaacagatcttggttcattaagttgcttccccaccccgtgcctttttctctcttttctttgcaattgcaggtcccacgtcccatgagaaaagatgggtgatgttccattccatttcttttgaaggctggtttatagagaaaggtatcttccgtaagcttaactctagagtatgcttcttttgtgtatacaaatagcttcacatacatccatatgagtatgcaaattgaactttttttagattctttgttaggtttaagattttctgattggcgtagccaaccgcattcaattgtccacttgattattctgttacagatcgtgttattagttgcttctttttctatattgttacaagaaatgtgcttaatcctaaaacttgcaatgtgcaacattaacattaaattatcatcaattgtaaccatttgtattggttccagttcttgacaggggattgtgttacgccctcatcaaccaacgtaaacatgaatcactcacgagtcacaaaatattttgtagttgtattggttcagttgtcccactcagatgatattgtctggcctagctaggattgaaaaaaacaatacagataaaaaaattgaacttccaaggcagaaaattctttacatcatgcgttaatgcttgaggaaatcctcatctcaagtgtttaggtagaagaaaatacattaagaagcatcttctctgtttgtgtttagctcaaagaaaaccattgttgttaaaatgaattaatgattgtaacaaagagaatttcaacaacaaaaaaatgtaacaaagagaagttcttcaattgcataattggctaaggtgtgatccttaaattgaacacgtatgtcaatgggagcattaggacccaccagctctgcggtatggctttataagctttatttggtcgattacatacaacctgcttgtcttgataggaacatgctgtttgattcctgcatgcaacaagaataatcagaagaaacagtggtgaatgatatgagaaatatcatgtataattctatgatgcactcaattatagatgtcttcccattaagagaccaaacctaccttgatccacagaatatcacaacaaagtctgcttttgaacaagttattagacttgttgggtcatcaagtgcaaaactatatgctgcagggcacacttgtttgaaaattttggagtagtttgaagccaaacatgttgcagggtttccataagtccctctgcagcaatactcatcagtattgaagacgtcacacgcgctccggcaagcaataactttgtcattgtacttagaagcaagctctgaagggcagttctgcctcaaatctccatcacagccaacagtgctgcagttcccggtgccattaatagctttcactactataggcaagttgaagccatccacaaggctaacatcatagaaatcaggttcaccaagggtgaagtcagcacttgttgctggagggcttccagggccagtacaatttatgctgctgccacagccacctgtttggcactttccattgccattgtcaaagttgcagcctgttctagcccatatcctcccactccatccatcaggagcagtatatacagttgattgtcctgatttcaatgcgaagccgtcgccactgtggttgtcactgcgagttatgccgggccatattgtctccttgcagtaatttactatagtgaaatttttactgcttccacacagctcaggtgctgccaaccaacacgtcaaattagtaagcataaaagtaaatttccatctaactcaggcaaagtgttttttcaaaagtgaaggagctccttattttaagaacttaaaatttggttcaaaattccatgatgagaatttagtatgcatggcaatggcagaggattactagttaccaactatgttagtgatgaaccaagaaaaatattcagttaaaatttgatttttaatatattaatccaaataggaaaattggaagtttggaatggaagaaactctacacatagggcacttatgcaaaccaaacaaaagatgtaggactttaaaagacaaaacgtgtctttttgttattctcttattagaattggagttttatttcgataattcacataataaaagttcatataataatggtttatatattaaaggtcatcatatgttacttgataaaacttcaattccgattggaaaataacactaaaaacatttaaggaattatttctaagttttgttcagctctaaatgctcattttgcttcactaaggttggcaacaaataaagcttaaaagaatgaattacctgaggcaattacaatgaagatggaggtgagtttcagcagtgcaatgtgtggattagccatctgctaatgctctcactctgtctcttagttatgtgacatttgatgtggtgatgggttgtgttatttatgagtaagattgaagaggacaatggaagaatacgtgaggaagagagtttgtgtaaactgacagcctgaacaagcttccttgcttaatcagtcaaaaaataccttgcccgcttatgtcacactgatatcctaaaattcatacatatgttctgcacctttacgcacttttcactgatcttacaaacctttcatttttttatttattctgtttttctcttgtttcattagaatcaaatttacaatgacgctatttattcactgatttgtcctacccttgagaaaagggaggcaaaagttttgttttgtttttttaatgtaaataaagggatatgttttaattcacttggttggtcagataaaaatcgattctcaatctcacatatgcttttcctttttcaattgtttcgataaaattatgggaaaatggtgccacttgggatacacaacgatatatagtgaatgctgcagaatcacagaatagacatgaaaaaaaaaaaactaacaaattacaatatttaaaaattgactggccctgattcattagcacaaaccttgtctaatgtcttcccttggtgatgcctatcttggaaaggaacttttccagttagaacatagaatctcaaagcaaagcatagcattcaaaaactgtgcacgccggggatctatttgtttccttgggccatggctctatatgtggtccattcaatgtccacggaaaaataaaaaaagccttatcacaaagcttgtactgaacttggcaggagctttccttttagtgattttgatctttctaaattcctcaaaagggagtttctttcttctcatactttgatgactttgacactttcttttcatggattttgttggaaagaaaccatctctgtcttccttccaaactggatcatagcgattgcagaagtttaagagtaattattaggtgtacttctttccaaatttccactttaaaagtttcatgtctcactattctttcctgtacttgttgatctcatcttgatctcaccctgatgtttctgatgcagattctataggttcaattataatgggcatgtaacaagtaacgacaaaacaaagcctgatgtaaacttgactttgaaaatgcaagagatctttctcaaggactgttcaagaacattccatatgccccttcttctctacaaatctcaagagcccattaaggacagtaaaaaaaaaacgttatcagcaatggtgtttaagagtaaaacaaagagcatcccaggctttgttagaagttcatatttaattgtataagatttatctttgttagaattttatttcatatttaacttatagtctttaattcaaatctaaaactaggatttctagttttctacatattgtaattctttcttcatgaatagatgattgattaattgttgattaaagtgagagagattatgttttattatttgtgaactattctagtttatcaagtttctccgtgatgctaaaaaaaaacttatcatttagaccattcataattgattgtagtatcttcattttccaaaatttcggattaatcataggatgtggatcattaatccaatattatgcgcgtcataccaaattttatgtccattatagagcatcgagtcacagtattccataacatttggtttgactcttgttctcgttggcattaaatcaaggttttcttacaattccaattataggacgatcccaagaacatcaatccggctacaatatcaccaattcttatataagagtgcatttttcttcttcagaattttcaaattctgtatatttatctacttcattgtatcaatattggatcatcttttctttcttagggatactttgcacatttcgtggtagatccttgtacttaaccttcaaaaattaatattttggacactacaggaattcttaatatatgtattggtttgattatttctccatgaacttagtttgagaattaaagagagaggaaagacaagagtggtaagaacattagagggaaagctaaattcttgaatgtaaacatgggtggtttgagcaattctatttgcttgagtgaaacacgtaagggagtgtagtgatgtcatactctcttgctaacttcttttttcaagtaacatggtgggagacaatcttgagtatgaactcaaactaggcgcatgttgaggggcgataagagtaattcgacaagaggattggttggattgaactcttgaggaatactcacatcatacttcttggaggtgaaaagttggtgttagagatgagaacaaagactactatgataatgataataaagaaaatttagtgggaagtcttcataggaagtttgaacataatagaagaaaggaaaataaggaagatgaaaaacttgagggacataaaaatgaagatactaacgtgttttaaggtaagtctattattatgacatatcttaaaatttaaatggaaaagaaagatcgaattcatctttgagtttcataattattcccaagtcaagaaaatcaaacttagaatagtttagttttttttatgattatgtagtttcttggaggaccaaattgttgtatacaaaaggagatatataaaacttacaattaagattgggataaaatgaatgccttgatgaggaggagatttgtgcccaatcatgggcggatgcaggttagaagttggggggcagtgccccccttaaatttcaagaataattttttttatataataataaaataaagtaaaataaaaaaatagtttaaatatttgtacaagagaaaaaattgaaaagcatagaaaaagaataataaaaaagatgaaaaataagaaaggagtgagtgtggatatgtatgtttgtaacttttatgaatgcagtggctacactcttgttatttttgagcacccatcacatgttaattttgttaattttttcttttttaaattttacattttttacacctttgttataataatttgttcctttaattttcttcacaaaaaaaaaatttggaggtgccgcctccgaaccccgccactattgttcccctttatttttttttttctgcatctgcccctgtgcccaaccattactattgagacttgtaccaaaaattgcaaaatcttaccgtgggcaaccatagcatggagggggattactataaagagaggaagatagccatattggagccaatgcgaatgaagatagagcggctattatatggtgcgatattcttgaatgggttgaatagggagattgctaatgtggagattgaggagataatactcaaggtcatcacagttgagcaacatttaaaagttaggaatgatgtgtctatgatctactgaatcaggctaacgtcatcattaagaaaaaaaagttacattacatatattttggcaattaaaagaccatattaaaatttttaacaataaagagaccgaaaaagtaatttagctaaaataaactttaagaaaaaaaaaatataagtaaagcataacttaaggaaggaggcctacacctatttttcatttgaaagactcaaatacaataccttatttaagacaaacaaaactcattgctacttaaatcattaagtattaattactaattgacttcgtaacttttaagattaatcttttatggccgggactttcaagattaatctaaagcttactaaataaaatcaagaaggaaaaaaagtgtaaagtctcaacttattcattaaataccagtaattcactattcaccgtatatgaaaatttatatgaaattaggttaagctatgttacaacataattttggctacgggtatttattagacggttcgaatcggttttggttaaatttagtatttaatccaagcaaatttggttggtttagttcgatttccacaatttattttcaaactcaattcattcatgaacggtttggtttggtttggtttggaccaacacattacccatttaaatttaatttttttcttagaactactattttatattatgattctttcaaatatccaatacaattaaatcaaatgtatgaaagtagtaaaattgattcatttaataccatcaacataatattctaaaatagactaataatataaattaaaacaaaagattcttcaacaagatttactataatagtttggatcacaattattcttacaaaataatttattgcaataagctttgctataatcagatttggtgcaactagatttagtgaaacaaataaacaaaatatgattcattaatattataaacatggtaaaaaaaatatgataaaaaagtgaaacaaataacaatatacctgaaagtaatacatcaagaagttccaacactggtagtcccaacacttgcagttccaatactagtatgtttaattgttaaaaacttcatatttaagaatctaaatgacagtggcacttaattttttagtaagagtaatgttggtgaaggaaaaagatgcaacttgcgagtgtgttaggcgaagcactgtagcttctcaatcttttgagttagatgatgataaattagtacttaataatgaaacaaaataatgataaagtacaaatcatattgatttaatatttaatttgaaaaaaatacttgaaaatctattgcgaaacaaagtatatacctttatttgtggacaacatatttgcagacttggggcaacgaggttgtgcggtggtgtggtgaggtggtgttgctctatcaaaaccatgcgtctgccgacaagtaagaaaggaatactttgtaaccctaaaataaaataacaaaagagaaggaaagaaagttggcttcaatatgcagtgacgagatcaaggtgggtgacgggtttactttaactactaacaacctaagttattcaattattaatattttataaaaagtactaaagaaaactttaaccccaatagtccaacttattcaattattatcattttattaaaagtattaaagaaaataatatagtatcacatctactttgattgtcaaattatttttttagtttttaaatatatatataaataaataataaaatttatattttattatggattcacggatcaggttaacgagtcaacaaatatataaatttagattcgtgatccaatccgtatatgaacgatttagatggatttaattcgactttaaccaaaatacataaataaactcaatccaaattatttaaatctatttagatcggtttgaattcacggtcattcttacttatgaccatcctatttctggatttcaactcaatgtgaatgaaacattgaaacgcacgcgcagcagcttttgttgtataatgtatttttttaatttttattcagagaaaatatttaaatattgtgagggtatggttttcaaaattcgaaataccgaaataaaaagatgtctttctcgaactcccgctccttcttctctctctttaatctatctccaattaagagagagaaagagatttcggctatcccatccagatctttccattttcattattaggtaagcttcgtcaattctcactcccttcattctctcctcacacatcctttccattttcatttctatctagtttttttattgcacatatgtatcaattccatctgggtattactattctttatacaagtttagcttatctgttaccgacagctaaacttggttaaaattactgtttaatccatgtcttgggttttctggatgtttattttgagggagattgttgtttcagatttacggactcttccaattccgtgcttaccaaattcgtgttttttttctttcataactgcataaatgaataatctatgttgatgttgttgttgtaaccaagctgaataacatggtgtgattcatgtggtcaatctcacctagtgagataagacttttgctgttatgcttgttttcatcactgcttggtgttgattttgaaagatggtgttaaatctgtgtacacttcaacaattatctatttgattcttcattcttgctcccagctatggattctatccctgatgtcattctccaatgcatcttgtcccgaatcaccaatgctcgagacgtgtcatcttgcaattgtgtttccaggagatggaaggactccactccctacatcagaaccctctattttcctcgcagctcatttgacaccccttcttcttcttctgagggtgctgacaacatcatcaaaagaatggtgtcaagagtggtgaagttagaggagctaattgtgtatagccccttttccccagatggccttgcatcatggctctcactggcggggcaaactcttcttcaacttgagctccgaatggacaaccttgctgacaatcagggcttccatgaaagcccttccaaattggactatattggtgctgctaagaatttggagtctctgaaactgtggggtgtgttgctggtgcgttcccccaaatgggatgtgttccctaacctcaagaaccttgaaattatcggtgcaaggttggaggaccctgtgttgagtgtggtgcttcgctcatgcccggttctcaccaggttgttgctgcttgcatgtgaaggggttaggtcggtctctattgagttgccatgtttggaggagtgtaagctggatttttatgggatggggaactgttctctcactttgacttccccccaaattgagacccttgaggtacaaggctgtagctggattagggtccctgaaaccaagcatttgaggaatctttccatatccaacagtgcaggtagttaactcgttaaagtggtttttgtgtttatatatttgttgttgactgttgtctgtcagataatcatttgtgcctctacttaagtttctgggattgtttgttcatgacattgtatgagagccggatcaagttaagtgcgtgtttggtttggtgccactaaaaatggactcatgttgcttattcttgaaattatggacaaacgcacaagcaaacacactaagtggtatagacaatagagtttgatccttgccttctattgacagttcaaacccaagggctcttccttgagtggtgtattcgagatagaatatttgggattgtaggtcaatcacattgtccatctctttttgtgtccttgttttcaagtaatctccagagtttgtcttttggacaaaacttagatacatattcatatatatattttttagcattttatttgatttagaattagagttttattttgataacctatactgatctttaatgctgagatgaaaactcccgtttttattagagaataatacccaaagcatatatgtttgtccctttcttttaagtttaacttactttcctttcaatttatttgctttcagggagagtgtatatggttgattttggaaatcttttagctctggagtatctgtgtatgagaggaatccagtggtgctgggatgccatttgcaaaatgctgagattggcaagtaaggtgaaacatctctatatgaaggttgaattcactggggattatgatgcacttcaaccctttccagagattgattttgttgacttcttcaacagtcatcaaaagctacaaaagtttgatattcatggagctatgtttgcagctctatgccagaagaacagtctcaaacatgtaagttcataataattctacccttctgattgaaggtgttatttaatatttcaattcatctaatgaggatatttcacaggtggattcaggattcgtgattccgtttttggaggaggttgtgatcacagtgaggtcacctcttaatgctgaacagaaaatgagtactcttgaatcattgctgaagtacgggaaaagtcttaggagaatggttataaagattcttgagatgaagagctgccatagtagcgctgatgatttttttgacgagatttgccggttcagatatatgaaccataacatagttcgaatagaataaagctcattattatttcttgatgcttacttaatttcagacactttttctttggagctaaatatttgttaaatctttctctggtatacgattttgttgtattgattttgaacttcatttgaaaattgactcccgttttagtaaatttgcagaataaatttagcgtccatatcatgattccaaaatattgcggttgctttaaagatcctaatgatttttttaatttctgtgtttaaaggattatatattattgcattacaccattttcaattacggaagataagaacagttaaccgttgatgtgaaatgttttcatgaagagtgcatatatttttttttcgaaccaaaaaaaaaatatagtagcagccagcaggtaacgagttaaatataaacaactttaatttcttaagcttcattcacctttattctctttcctccctattatattattcatcatatttctcatattctctttattcttttctttttatcttaattttttatatctctgttacatttcataaaggatgtgaaaaatgactattgcaataagcaaggagcttatggtgattatttaagttgtctacgcattatctttaataagaacaattaaatgaattatgaataaattaaaaatcctgctttattttttttggtgtttcatataaagtgttcatttattttaaaattagatcaaattaattttgaattactaaatgtaattaaaaagtatctttatattaacttgtatcataacttttatattaaaataaaatatacacatggtgtgagaaattagcataaaactaaaaaacaggcccgcataatccgtgtcaaacaatgaaaaaaattgtattggacagcatctcatacaaattgaacttcttgacaatggatatggatgtgtttggaaggattttgtagaatctattcacatttatgaaaataaatttataattttttttaaaaaaaaaccattttattttaacaaatttattaaaataacttctttaacatattttaataagttttaagtaaataaactcttatatgataattttttattaaataagaatgttaactaaattcacacacgtctttgttttgattgttgtattatgctatgcctatatgtcgaatataagatttaaaagaatattttggtagttggacatcaagtaatcggaaataactatcatgcaaatttttattttaaataattattttaatataaaatactaaccatcttttttaagaaatgaaaacaactatatttattaaaaagaaaatcaaacacatcagttataaacttttttttagatcggttataaactaatagcgtaaccttttatttatttgcgctcctcgctaatttattttaatgctgatttcctaatctattttaaatttttcactaaataaataggtctttatttttatgaagtaacaaacaggtcttctgttttcaatactttgtttttctcctttaattagacgatttatggcttttgaagattgaatatagttaaaatctaatgtatttgtattaaaaatatctgatcaacaaagttttagattaacataaaaaaaccaaaatctctcacgtttgtttttttaacgtggtcaacaacttttcaacgagtaatagtatgtttgtgcatccgttacatctaattgactcacattctaagaggtactaactttgcttatttttcgaccgaatgctgaattaattaaaatcccttaccttgataaaccgagaattaaaacaaaaaaataaaacacacactttaactaaatgcacactacatgcgtgttttgatgcgtgtttgtgaagggcttcccctaaacacaaagcaattaacctaacagacctttacatcctcaacagcattagcaattgaaacacaaccatgattgaacataaaaaaaacaatcctccttaatgaacttaatttttatcctaccctgtagttcccaacacaaagatggtagctataacaagaacaagcaggtatgaagacccacttttacccaatcattcactaaaattctttccctcttatctgcggattttcatatcccaatcatacaagacaattcattgtagtaatcatccgtggaaaagaaatgctggaaactctacttgtggtatcaaaaatttctgtctacacttgtaaataatgttcataaaaactctttttaagttattatatgtttgctgtatcactaataaaattaaattaactaatctatataagcttcttcttctggaagtaccgcttcaaataccacaattgcaaaccagaaactgcaatgcacatagccaaggacataatgctaaaccatgccactctgccatttgttttttcactcacagtcctcatctcagcttccctgaacaaataactcaaaaaacaaaaaataagcatatgaaaagtttttaaaagattatttgcaataaacaatttacaggggaagatgttgatgtgattggaattacctgcccttaagatagagcaaattctcatggatggcctctactgctccttctagctttctcagctcaagctcgactcccttaggtatcaatcacatgtagagcaaaataagcagagagaagcattcaagagtaaaaggtttaggtatagaattcaattcagatttggatcctctcatgttatgttatgagagagaaagatacaaaagaaactatagtaatacaccattatttgtgtagggtccattaaacattctatagtgtcttttccactcataacttgaggggaacatcaaataaggaacatgagaggatccaaaatttttcaattcacaggcaattactaactgcttccagctcacagtacaaaactacttcaagcaaactacaaacctaagaagctcttaaaaactattttaaaacagtgctgaactcatttcttattataccttgagtaaatgtcagcccttgataggtagaacacttaagttctatctacctatagtataggcctatagggagattcaaaattatacgtatctcttggaagtttacctcaatcttctcttttctagcaactgaatcccaatccttggctgcaattccaattttccaatcaaggtttacattaacctcaccaactccttgactatggctatccacccagaagcacgcaaggtagttcccagcctcttgagccgtaaatgcgatactaccatgtgttgtgttctccttgtgatgaagattgtttccatatggtgatgtcacctaaaggaaacaaattactattagaaacaaagagacaagtaatagacctttataacaagctgtatcagaaggttgtcattcaagagccaaccagtattacatcctgaaaacacataaacacaagcaagtctaaacaacagaaaataaactattattacttagtagaaatgtaaaatgtttccaagtacattttttcaacattattaaaccttatttctgttaagacttgaaattttgtaaatgcagttatcatgcaagggatccattccccaggtagctgaggtatttgatagagcatcagttgataaattagtggtttttttattactgaatcacagaattcacacaatcaggaaaagggctgcagttccccagttttatgactcctatagagattattctctgtccaaacttacagaactactgcacacataacacccttctacatcacactacatacttccaacatgacagttattattacttgtatatctaatgatacataacttctcatgacagctataatttgttcccatcagtattaaagtctccaactctgccatctttgatcttggcaaaccactcagcatagcaagaatactactctgcgaaccatgctgtaagaaatttccaccattatgtgtgcaagccatattctaagatgttttcgactttccattaccaccacttctccagcagcaaattattcaatgagctcaatgacaatgaaatcggactgtctggccaagaattagaccagctgagtaagaaaacttctatcaagactatcagttaatatatatggcccacacttgtagactggcctgtgcctgtagactgaccatccaattataactgactcaccatatcacatcacagtcttgtgggttttgaaccctcaggttcagttagggccgacacaagggtaaagcaactaaagctcaagctttaggcctatataaaaaatattttctattagttttataaagcaaaaaaggccccatataatgaaaaaaatgtcatatgttaacaaaaaggcctcaaatttagctctcacgtttaaattaaaaaatgttattttaaagtttgctttaggccggccctgggtccagtatagcgagattctagattctccccatgcatgactaaggaaccattggcaccatcccctcgttacatgtgagggaggtacgatgcacgccactcccgaaaatggtgggaaccgttagagaacacactcatcaaatagctgtgatctatccgggttacaacaggtcaacatagtagaggctcgctatggttttttaagttcataccgagcattaggactcccccggggcctggcgtgtgtgttctctagcgcgaacacctagaccattcaggctccacagacatatataccaaaaaattaggagtagttttaagcaataaaaattacattcactgataaatatatgtaaaaacaaaacaaagttatgaaaattcataacattattataataccacaaaattcatggccaaaataagacaatgggataataaatacccaaagataagacctaaaattaacaattttccacaacatggtcttccaggtaatcagttgagcaagaagcacctctacaaagcctttcaaattaccaacaacacacaataattttccgaaaccgaatagtaatagcaaatccacgacaaaacaaatccgtcaacacgcaaatcaaggaaccaaacaaatcagaagacgggaaagagaatctaatgagtaattgaagaaacccatgacagaaatcgcaaaagggtgtcgtaatggacgggaaaaagagtaccttgacggcgatggaggggttgtgggcgtgatcactggggataacgacgtaatcggccaaaacaacgacgttgtgttggatttcttcggagacgcacttggtgccagcggtgggtaacgtcagccagatagccagagcggaaggaaccaaattggtcgagaagaagaagagtagcagctttaacatagctctgttccccatagcagcctctactctctctctccctctatgcacacaacacagcaaacaatcgttttctgtctctctctgcacattttggatctgtatgactgtatctatgatttttcagttttttttttttttaatggttttctttattattttattatttccacccccgtcttagtgcctctggcttaagaattaagatcatagttatgaaaagcagccgaatcattgactcagtcgaaatagtggattagtggattaggggtccaatctatggattagtaattgattcgatttaattcggtctatattaaaaaattcaaaactatatacatatacatataactaacattatttgattaagaaaaatccattcataatttcatattcaaattaataattgaagtattaaagttgataatacaagtgtattaataataaaaaaagagcgtaaatagcaacaatcaaaatcaaaacagtaaaatggaaactgcataaaacaaaaaaggggtgcaaaaaacaaaactatattatatattcatatgtcattaacatttttctattaaaaaatataaaatggaagctccagaaattaataacatgggtacaaaaagcaacaatcaggcccaaattaaaaaaaccctaataatatatatgcttatctagttgtgctgagcaacttccattctttattccatatttccgacgcttccttcttgcagctggcttctctttcttttgctgggcatagaattttttaacatctccttaattttgctgcttcattccatattggcttctcttccttctcttggttaaaaacttaattccagaaactcttttttcaaaatggtgatttttttttaacatttcagaaagatgtttttggatgcggtggcggagtaggtggagcagagcttctccagcataaggtgtcggtgaagaagacgaagaaaatgcattttttctgagttttacaaaaactggtccgggttcctgaactcgtctgggtcgccgggtttggcaaaaattggctggttcttgccgggtttaactgggtcacttacatgatcggttccacactcaatccgatccggtgctaccaacagttcccgatctgaaccggttttaataacactgattaagatgacttacttttaaatctttatcattagagtaaattacatctaaacccctatgttttgtttaaatcttatttgatactccttcctttttgtattatacaaaaaatcccttaattgtttaactcacgttgcatccacatccttccgtcctaaacaccgtttaatgaaagtagacacgtgttggtcatataacttttaatgaaattttatatttaaaatacccgtatcttcttcctctcaatttgaaaatattttaatactcttgtttttttttttgtttttttttctaattgaacgcgaacccgactttttgttagacgtaaactcaccttcttggtacgcaatgttaacaccttcctttttcaattttttagttcaattttttatctttgattgaatatgatcatttgcttcaaatttagtgttttgttcctgcatttgtgttcttgtggtcccaaatatcaacattattttaatctacactaataaacaaatgattttcagttcattcattgtgtttcttgtggtcccaaatatcaacattattttaatcaataataataaacagataattttaaatatcataatggtttcaaactggtccccattaaaatctcattcagaaataggcaacaataaataatcaaaattaaataatattcttaaaatgtaatttatatacaaggtccaatagtcatttacaagcataaccttaacggtgaagaacgtgaaacctaaattatgaaagtatttgggaggggataatttgaattttacaattaaaatataaaaataatttcacctactcacatattttaattgacattagttaacgacattaacataagagagtaaaagtaatgtgaaaaaaatgaaggatataagatgaaatttgagcaaaacattggggatgcgagtgtaatttactcttatctttattgattaaaaataatttaatacttatttattttaaagtgcaacttaacctgtcttttttttttttgtcttgattcttatttatttatttaccaatttcggtctatttgactgattttttactccattgttttataaattgtctttattggattaattttcaaaactatattttgagcacaatttaaaaattcaattttgctattttgtcttgattcttaattatttatttagaggagtgctagcaacactttctcttacttactctctttgtgattggttaaaatttattaaaaatgaaaatgtcaactcctcatttatttatttacaccattttttatctatttgactaattttttactccattatttttctaaagtgtccctattgaactaattttcaaaattatgattataaaaaaatttggaaaatctaattttattcttagttatactattttgggtctatttgagcataataaaaaataaatcatatttttttatcaacttgctaaccatgtctcaataaaaaaaaattgctactaaatattaagtataaacgtaaaaggtgactaaactggcatatttttacaaattgaaaagctaaattcatcgatttaaaaatatagagatcaatccaaaatttgctgaaaatttaaggataaaaacacatttttttccttcattatattatgtcacctttgtacttgtagtcaaatctatgtataactaaaaacttaaaatttctatttatcacttaatataaaactgtcaaacttattaagaaatacgttattttaatataaaaatcacttttgcgactatttattttaaattattcagttataatatgttaaagtaaattaagaattacataaaatgttaattaaaataaaatttataaaataattatttaaatatcgagtgatatgatatcaatactagttattagtatatgctaaaagccaatactatatactaaattgcacagtaatatttttattaagaattatttttatccattaaattcaaatattatctaaactatttaactttaattttaatatattcaattacttgttttgaattacttgttttgatgtcgtatttaaattcgatagttatgatgatcttagaagatacagtcacaagagaattaatctttcattaaccgttaactaagtagttttaatgattattttatttttcatttaactaagtaatttgtccaaaattgaatattttattttatttatataatctgaatagaattattagccgttaactaccatgcctttgattggcactcattcaattctttgaagaggttaaaagtccaataattaacccattaggttatgcttcttccttcgtgatcgtgttacttccacctcaggttatggctgtatttgtatatggatttgaaccctctctagatacctctctccttaaccgttcagtgtcactctatttctcattaatgatcttttaaaattataagattgacttcaaaatagaaaggaaaaaaaagtggattcgaataatttatattaaaaaaaactaataaatctaatgattaacatttttctaattttttttaaaaaacttcatcattcatcttatttttgcatcctgtagctctttttttttttttttttttaattttgttcagttttttttctgcctaagcagcaccgcaggaaatgatctgttttggatatatatacatagatcataatttgataatttggcattttgaatttaattagatcctattggatatataaggataacgagaacaattttattttccctatataaccaaataaattatatcactactttttgtacacttattataatttcattcatgctttgacccgatacattattgagcgtttttattttagatataatgtaaagtattagcttaagcacgatgtttatattaagagtttcatcagttttatcctgtaaaaaaaaagtttcatcagttttatttttattaaataaggcaaagtctatatcaattgaaacaagtttttctactttgacagggattgaatcacacgttactctttctagctatacttttccaatttctgtgtctgaatttttatgcacatgcatatcccaacttaggaaactgcgcattgatcaccaaagcaacattaattccaaagtttatcctagacgcagttttagttcaaacttttgtgagtactgagtaccacaataattgttaattaaaatagtaactgtatcttacttttctgtagttcatttaacaaacatttcagatggttgaattaaagtaaaaaattaatttatattagttatttaaaaattacttgaatcaaattgccggcccttagataagaaaaatcatccttcacacaaagtctgcatttagagaaagcttaaccttaacttatagatgagaagaaaagaagttccaacggctctctaagcctttttcaaagcataatgaagtctagttcattaaagaacattataattaatacaatgaggacaatttagtcctctatgtgttgtaaattttttataccatttttgattcatatggataaaaaaaaaaatacacccaaagagaataaaagatctcataattaaatcctatcttactggtttcactgtcccacaagaattttcactcagatttggttcaacatgcaggtttaggaaccacgtgaccctacggcaaattcctgccaaaacaattcttaacgttgcaaaaagccaattttttgtcctttatatgcctcaccaatgaaagttgcttcttcaattcacgctcaaaagaaaaatggaaaccctcatatcgctgttcacctttctcttagatcaagctttccaagacaaattttttatcctttcacaaccgaagaccccatgaagctatttgagttgagtcatacaacgcatggggtagctgtggaacttgagcaaaagaaagtggaagaagcagaggttaatatgctgcaacaagcagatgatcactttgactgggtcatggagagtgtcatggaagagtttagatacttagaagaagaccttgagagaatgggaagtgtagcagaaaatgctgcttctgttgcttccaagaggtgtatttgtttgagtggatctgatacaaaggcttagtacttcaggcaacttaacctgttgagcattgaacacgcactgtatttaggggtttagcccatttttttcttgttttttattacttctttggttctgatttcttgactaatttgcgagtaaacaaatatcgactatattcatgcttattgtcttttttattagtgcatgtctcttgcagatattattgttagaactttttctttcacttttcaagatttcgattttgctttgaagctgtcagcccctagcccccacaacaccagggcctctcagattatgttattcagtggatcttacgtttcccttagtaatctcattctgcttcgaatagtataattcttgatttgatgagtgtacaacggatgtgacaccttctgcaaaactatgcaatgttcaagtagatatcggaccaactaggttaatagtataataattgataatgataaattattgtctcgagaatccaactcctctttatatatatcttaatgggttaagggttcatgagctttacgtgattaccattttggttaatcaatgctttgttgttagttacaagatgatcgtatggttaattttatattagtacactactttggtgtcttaggtcttacatttggaatctgtaaaaagtaaaaaaacatatctgaaatatgtaatcaaatacactatatgtttaaggtgatttcattcttaaggcaatttaattttaaacgttttattttaattttaagttatttttatttgacgaattaggaatctatggatttatttatcatcctttatgaattgttttcctttttatacgagataagaggatataatgacgtattcgttatgtaaagtttaattgtggtcaagcttttgtattaagataggaaagatgttataattattattagattgggaaaaaaatctttaagaataatttaaggataattcctacttttttttccttcttttgtgtgattgtatttttaaagaatcttattaattcctaataaaaaaagaatcttgttaattaatatttaatagtgctttctttggttattgatcaatgggaatttatcaattaagtcattcatagttcttatggtaactaaatactatagttatagataaatctaatgttgataactgaattaatcaattttcttaataagttaaagtaacatttaggaatattagtaaaaaaaaataatatttaaaaaattaatataacagttattttggaataaattatttttctaaatgtgacttactttgagatggaggaagtaacatgtaaagttggttttattcttaattgctgaattattaaacaaaggtcagtgttacactttatttcacgaagatggcaggttgcagaatatattaatagcagcacttctgagtttcaaagggcaggacctttcaggtggaaaaaaagattaaaaaaagaaaataatttaaatgtaatttaattctttggaaattggaagtgaatacacatatttgcatcaattaatcattttcaactgtttgatgattaatctcttgaccgaatagcaggcctcttctgtaaagaaaaagaaaaaatctgaaagaattatgaaaaaaatatatctaaacggtgttggtaaaacaaaatactcttccttaagaacaattgattacaaagaagtattaaaccaaaaaggaaagataaaatatacatattcaagaagtctctggctctgggaaaacttttttctccatgaaattgatgaaacgttgagcatatgtctttggttccaccactgaaatagtcatagggtcatattgcagtgatttgcaggcatgctcaagtttctttttcactgtgtattcttgcaatatatcaattatgcccatgtataggaccacatcataaacctcaaaaagctctacctctgattcctccaccttatcctcctgaagtttccgtgttgcttgagctggcatgtttactcctaattgcactctcaacctgagtaacactccatttcatattatgacatgtgttattacaatggaacacaataaagcaaacgatttctgcttaggacttttatttaaagaaagtgacattaagtacagtgaaagaaacagaatgcacaataattgctacatgcaactgtctaggaccaaaggagatacttgcaaaggtgctagattaatgaatattgaaaaggaaacaatcagaataatgttatagacgataccttgcagtaccaggaagtaaaagatcaacttgcttgtcacctatggagtatgctctcaatgtatttcctctaatgtgtggtcccggtgcagtgttgacaaacctaggttcatgagcaactaataacaagcctttaggaataatcaactgctccccttgtttttgtgcatctagtaaagcaaagcaagtcaaaaagtgctcaatcaaaagaaggaaactgaggcacaaatgcaagaaaatagagagaacagaatcagtttgtagtgaacttgaacagttgaaataaaaacttgaatatacctgaatttacaaaataaaataaacaaaagatggagatatatcataggaacaaaagtgcactgtatgaacttctggctaataggaaggtgctagatagttcagctggtctgtttttttttcagttattggatggatgcatggaaggattagttacttaataaatcattctacctcccattttataaaccattctaatgaatgctattgctaggtgtcatctataatcactaatttttgaaagaagaatcccatatcatgttctaaaataacaccagagaaggtatttactatcttcagagggtaagccatgttgaggctgcggtagtctgggaggttccactaaggcctttagattctccggagctctaaaatgtaatcccaacagaagactgtaatcaattatgtgctgagactccaagaacatgcagtctagagaaatttgtctgcaccagaaaaaagaagtttgagtcataactagaagctaagcgtatttttgattcatagaagctaagcttattaatccttcagtcgatgagtagtccaataaaattgtcatgataaatactttatatacactcgagcaaacagtcacaaatcagttctgtaacgttccaggctaagtgtgctggtatggaagtaaatcaatcataacccagaggtgtcccagtaattgatagttaggtgaattccatttagtcattatttaatgcatgaattataacttctctattgaaaagaaaaagaaaattcactgaaagaagtggaacctttgctaacagtttcataacaaatctaatcaccctacactaattatatctaatgcaacatctctacaatggtcacattttggtttgccgattctaatgtaaagttcaggattatatcttttcaattagaaaatatgaaaaggcacaactttcatgacttctgaagttcttaacttggaaattaaccagatattgaatcagtaaaagctgtaatagctggatcaaacaagaagcttgattcagactacggataatccaatatatctttgcattactttgaaaggtcatctatttcaattatggcaagtagagatagcaaccaaccagaatttcaagcaaattagtcccataaccttatggtttcaggggatcaacgaaacactctatcacaaccatgatcaatattgtgactagtatcattaataaactaataaagtaaaattattgctgtttggtgccataagcatttcttagagcaataacagttaagaatttcctctgaaataggcattatatgatctagaagaacaggattgttatattctggaactttgtcaacaaatactccccacttgtacagaaaaataaattgcataccaatcacttttaacagaagtagctcttaaaaagtaggaactcacttgaatagggattctcgtaattttttatccatatgaaattcatattttagatcaagatctttcaatgttgtattgctattgattttatcttcgtttgtatatcttccttgagtagaccccttcagatcataacgacggtgaatatgaagttctgtgcagaacatattccccatgaccacaaagcgaacctaatgaaaacaacacccaatgaagaaagaaagaaatatttatacaaaaacaataacatccaacccttttctcactaggtggggtggaaaacaaggttattcatatctgtagtactaattgaaaagaagctagagacagatatttgttatacctttttcccacctcttagtgttattcgatggagaccaaagaattttgtaataagagtattctcataacttcctacatgatggtagtatttaggaagcatattgagcataacctacaagaagagaaaaaatatatgtacataaccacgaactatggaattgtcatttaattgggtaaatcaaattgattatttactgtgagagatggaaacataagcaaccactgatttctctgtaaaagtgacttcttaactaacataagaacattttttcaccaaaaaggcccatctaaagcgcattcttgattagccattttggcattggatttcatgaactttgcctttaaaaattgtcatcagattataggcactggtagtattattggtgtctatggaactacaagagccagaaagataagccatcacgtattctggtctagaattgtcttttcagcataaaaacgtgtttatccagaaacgtctatcataatgtggccttcactagattggatttcatgaatattgtccttgaaaatagtaatcaaattactggcactagcaagtcctactggtgttgatggattgtcaaagatacacttataagcaatcatcttttctccatataacattaaaaaatacttctctccagaaaatacccacccaaatggtctcaattagccattttggcattggatttaattaaactttgccaccagattagtggcactataaagtattacttgtatctatggggtttggtaagtggatagtaggtatatatgaaactgtatatcactctaaagtgctgtctatgtgccagccatctaatatgcttatgtatccaactacacaaaagtcgaattcacataccagttgatgaattcaacacaatatgattaatataaaaatgttttctgatccatgaagaaagaaaaaaaaaatgtcattgcaaacctttagttcatattttttcagtgtctttatcacgaatctatcatcttgagaaagaaagaagatgctgccactttttccaggtgaagatatgtcccttagaccagaatcaccacaaatggacatcatgtactctgcagcatctaatttgaacatctctctcaaattcctggaaatatatgcttatgtaattacgcaaagaaagatagaaagaaaaaaaaaagatgctagaaagctacatgtaattaataaattgggaggcatacattaatcaagcacatgaaaccttcaattcattaaatgggcaaaatgttaatctgaaaatatggggttgtttatgttgagtctgccaatgaatacatcttgaaagatcatgtgcttttaaccataacccttaagcacttctattatgccactataatcacaaattcgtattatcgagaattcatgtatattattttgataatgactatgttcacatttaaaattggacatatttccttccttcttttatgcctaaggaaaagggttggaccaaacttcaacattgatactccagtttggaagttcttcataggaaatacattatgatgcaccaatggtttcataagctaacaataaaattaagaggtgataatgctttcatgccttacaactttgaaataagttgatcctactgtagccagatggaaagcgtttcaataaacattactaaacatataactcttcaggtgtgtatgtagtaaataaataccggaataccatagggcaataatccttccagtagaagtctatagaagaatgtggaggagtcaactgggaaccctccttggggaagtacatccttatcctagctcgatctccaaaatcagatgaccgaacttcacgtgcaggcactggtgtaatttttccaacagtgtacctgagaatttggccaaatttctttaaatcaaaccttcatatgaaacaaaaatacaaaataccaaatggaataagacacattaactttgatttacaaccccccaaccaaaaaaaaaaaaaaaccttcatcatactgatgcacgatgagaatgtaatttgtttgtcattgttttctattaactatttaaacaaaaactgcggtaaaaatacaagaaatataattgggtttatggatcttaagaatgaggtgaagaggaatgccttttgatagttaccgatcaacatcggacaaaagctctacatgatttcaacagaatatataattctttcctcctcatctctctgtttttcccctctcagatcatcctgaatgactagcatccaataatcatattacagcactgacgttaatatgagtgtaaaatatactattgttaaaggcggtttaagcattcatttctgcaaactaaataacctcgcatctgccttaagaataagcttttcaatgatgactctaaaacccttgggatagtcatgtatattttcttttacttaaatgtctttacattctctacccatacccaaatatatctgtcagtattgctgcgaacaacatgaaacagatcatttataataaaatcattccttatctttaatatgtgaatcaatcagcaagtatgcatcaatacactctaatgtatgctagcttcacggaaacttgttgagtagttctcagccattacttagacgtcatctaatttattggttggatcactttctatacatggtcttgatttaaaaataacaataagtataatgcagtagaaagaattatgatattactggtgacaaatagatacaatatcaattattccaaaataagctacaaggttcatgttagatcatataatttacctgatgccaagctgcaaattaagcttcaaataatagcttcggctgcctccaaaaatatcaatccatgaactcttcttagcttgcttgacactaaacttattttgacgtttgtttttatgtggtatttctgaatagtttctaattctctccataattagaactccttgcatatattccctttcgtaaaccaaagagtttacaccagatgcctcagattgactttcattaaaagtctgtgataatgtgggtgaagagtcacgacatatgcaatctccagcaggatcttgaatgatacaatttgcatctaatgatgaagtcctgtgagatatttgacgtgaactttttgatctaccactgacagaaatcttttcagaaaaactacgcgtaaatttttgttttggagctgtatgtttctctgtattcaataacaaaccatcatcactgttaagagagcacaacttctttagagatggttgtttaccaccagcaggatagaattttccttttccatcctttaggcccttactccatgtcccaatataaagccccccatcagcaaatctataaactccagatccttgtttaagtccatttaaccaacagccgtcaaaaatatcaccattagcccacttcataacccctctgccatctattttcccacttttccaatttccaatataagtatttccattctcccaagaataccttccgcagccttcacgaattccttctttccataaaccttcatatatatctgaattggaatactcttttcgtccaatcccatgatgagcatccatcctccaactaccagtataaatgcacccagtagaatgtgtaaaggtgccatgaccatgaaggtaacccccagagaattcaccctcatactttgctcctgttggccatgtaatcagtcctttccccgtcattttcccatttacccaatcaccttcatatactgttccatctgaccatgtgtactttcctttgccatggggaagcatgcccttgattttaccaatgtaaacatccccatttgaaaaggacttttcttcaaacctacactttacaagagacagtgatatcatagtacattcaagcacaacagatgcaaaaactacataaaacacagaacacaagaggatgaatggaacagagaaggagtttctatgaatattacctttcactgtcctccatgacttgcaggttttcagtattcactgatttatgctgataactcgaagaaaggttccatttcctttaaaaggttaaatgtgccactcattgatataataaggaaattcatctctgccttcaccacctttatgacactattgtgctcctcagtgaactctgaaacaggtacaaccatcataatgaatctcaaaatgcaatagaagaaaagtcacagtaaattctttagcagatttctgcattgaaaaatgcttttcagaattttcccacaaaatacaaataacaagggaaaaaaaaaaactctcctgcttttgatgtagtacttgtttcaatgggaacaaaaagtataaattaatatactaactgcagaatttggcataatgtttagggaggaataatttcttaatgaaataaagagggaggctaacaacacataatttgtttgtttactctcacaatttgctacaactaaaaccacactacctgtatatcaacaacatataataatataattgtaaacactgcatatgctgaatcattgtaaatcctataaaatttacacctgaaaagatgtgctcattctttctagagctgtgacaacccaagaatttttccgtattccttgtcaaatgagcctataattgacatcatatcgtaactcagcaaaaaaagaaaaaagcacatactccatttgcgtactatgaataaattccctactatgaagaacgaatgaataccccatttgcattccactatctgcataaaaacaagtaactacaccgatattcttccagaaatactatctgggtcaattcaataaaagggcatccaatacaacagcagaatctgccgtttatgtgactaatccacaacacacaacaaattcctagattccaacacaacaaaaaaatcaagataagaatcactgaactaaccttagactagatatattgaagtgccaacgaacaatatcctgtgatgtgaagcaaaagaagctgaaagcaagaagaggaagatgtaaccccccacccaataatcaaaaaccagcaaaaaaaacttaagctaagcgcttttcattctaaaacagtctgagacaaagctcacgaatccttgtccaactgccttagccgacaactgccccaccaccaaaaataatttattattctatagaatagttgcaacagattatacctccagctactatatatactatgctccaataatgacacgtcacctctctctctctctctctatagacttatgcgtgtgtgtttgtgataacagtaaacttgaaaaatcaaacgaattaacttagctcttatatatgacttttctttttctgctttattaataataataactaacgaaaacataagtactaagtagtggggtgtggttgtccttggcttgccatgcaaagaagaaagatgccacttttaactcacctgaaaagctattgcgtgggcatcgtttcaagtttggaatctggacacgtacgtggcagctccttactgtgtcggaatcttatgtataaaaggaaaaaaaagaaaaacaaatacaaagaatgtgacaagtgatcaaccatgaattctgtggctttgtttcaacgtatagtaatattggattttgaggaattatgtttttaggaaattgtatctagaaatattattcatacgagtatgttggattgaaatttattaatttcagaaacaattaattttttatttaataagaaaattgaaaatagaaaaagatttgtgaaaaaatgaacgttagagaattaatttttttcatgcatgtttggttcatgtggaggaattgattttgggttaaggatttattttagatatatttttatatatttaattttatgttaaagaaaaattcaaaattaattatgagttgaaataattttaaatagtttatatattaaatctaaattttataataaattttactcataacttgattttataataaaacatccaaacatgaattatattactttaaaattaattttattgatatcatctaaacacacacaaaattgagataagtagttattataattaaaaaaaaactttcattattatggaaatgtaagcatcttttattaagaggattaaaaaataaaaatattaataatttatattgctagaatcaacaatattttataatgtttatttatatatatatatatatatatatatatacactaaacattaaaatgtgatattcttgattttactttcaaaaatagtttttatatctcgaaacaaacatataatctaagtaatttcggttattgaaaaaaaatgataactttaataatttacatgcactgagaaaaaaaattgtcgttgatacatacaagatgtctattaatattgatattttaatatatccatgattattatatatacatatatagcaatattaattactgatattacttaaaaaaattattgattttagaaaagccaaattttaattatataatattatgtgtaggtcatctaattacaacacgagaagaaataaaattgtcaatacatcacacagctgtccgtgcatgatgcaaagtagtactcacagtatctatcacgaaaaggaaaaggcccactccagtattgggcgttgaataacacaccctcttgcagaggagtttcctttcaatacacaaaaaatatattgttaatctaaagtttagagttgtttaagaaagaaaatactagatatatgtgttccttggataagttatccgttagtgagtaatagtaatcttaaaactgccatatgaagtcaatcatttataaatcaattcatcaagctttaaaaaatggtttaattattgtttaaagataacttttaaaactcaagtagttccgtgtgaaaataaattttatgttgaataacttgaattgagtcaaacataaatttaaatatcgacttcttcttttttttggctaatgctgattcatggttatattgcttaagattatctaaaatttaaggaaaaacatacatttgtaagttgataattaattaggcattattataaattttacataccgtgaactataatattttatgtgtattaatgtaaatatatatatatatatatatattatgtgtatagatacgtctttccctttaatgtaaacatttttgtatattaaattttcgatatagaacagttgtttcatgaacgttacacattattactatatatatttttggagcgttataacaaaataaaatatcacttaaaatttaacaatttttcaaatcaaattaaacaagaaaatatgtataacaatgatgaaattttatttatttataatgttctatatgttacgtagtagtcaaactattggtttaattgtttgaaaatttgaatgataaacttccttccgcttgaaaatttcttttttacgattaactggttttcaaaacgtattatgacagagtacgaactttctggaattttggtcccactttgaccccccccccccaaaaaaaaaaaaaacctacaaattagggtttcctttccctctgaaacatgtaacgtgctcagtgctcacactgtattattggcatttggcatccaatgccggtcttcctttctcaattatcacggaatcaatgtaatgaattttagattacctttctcaacttattgagagaattttcctttaatttacagaaattcacattttcttaatgatatatcaatgtcaatccaccacttgataacatagtgtaaaaagaaagaacttacatcaacataacgaaatatgaaaatgtcttattctgtcaaacttaaatatcgacatgtgagtcaacatgaatgcaaatttgaactaattatcacaggaaactttagtatataagagacaacaatagaaaattgcacatgatcatgaagaataagtgcatggagagagattcttgcccagagcgagaggtaagtggagctgttaccaaagcctgccaaacatctggaacaaataattaacattgcatttttatatagaatattttagttagtgccccaaacttcaagtcacgttggaaccaagatttaagaaaaacaaaaagaggctaatcatgtctgaatcgccttgtgacaactttatgatataattaatttattgcttgctgattcagaaagttagctatagcaagcatatataaacgtctttctttatcaacgcataataaaatcaccgcccacatagatagcatcctattcttcctcaatagacaactttgatcggatgcaaagttaacaaaaatatcttaattaattcatcactgattaacaatatcataacgtgtgtgtatgtgtcatcttattcctccacaatttatatatataactttaatagcagatgcatagataaaaaagtttgaaatattcgttaattaaaaattataaagtgataaaaattattctctccatcccaaaataagtattgtagtaggttattttacatggacaaaaataaaattattaaatataacatttattaatattatatttaaatatcaaaataacatttattaaatatattaataaaaaagaataattaatattagattgaaaagtcaaatccaatatttattttgaaataaagtttttttcctagacatttattttgggacaaaggtagtattttttattaattcactaattaataatttcaaaccaaagagtgtgcggggctgcaggtcattaatttatattgatttcatatagtttactttaaaacaattaaatttttgcattcaatggaaaaaataataataaactatggtcttaatgaaaaataagatatttgtgtcttgttttaatcagcaggtattttatgctttgtaaggatatttataaattagagaaaattgaaaaagaatttaaaagaatattaatattaaaaagataaatgacgtatatgcataactaatttacaaatatttgaaaaaattaaggttaaaactataatattcaaatgtaataaaaaaaaactaaattcaaattttaaaaggcagatatgtaattaacatgccgtttctattgataataaaagactaaaataagttactctgaagtctgaagtatgtcctctctagttagggaatatattctcccataaaaaaaatcataaactatatataaaaattgttaatagatatataatgtgaattttccataaaccttatcgtctatatatataacatagattctagtttatcattcaagggggatgggaataggattaaacatgatttttgttactaattatgaagaaagtcgtcaatgatatgcaatttcacactcgcttttaacattcttttaattatcaggtgagattgcatattaaccaccccccccccccccccccttttaacttgatttaatactttattagtagaacctatgtaaattttcaccgacaaaagagtgtggttattaaataaagtcctgcaaacatttatttcatttcactaattattattattattattattattgatttttaatattcatattaaagtcacgtaatgatattttctataaatgtgacaaataagtaaaaatgtatttttattaaaaaagtcatataaaatttataactattccttaaaaaattgataattaagtaatttaaaagtataattaatatttccaatagatacttaatttataaatagataataataaagtaataatacagtaaaaaaaagtaatattctttctttattgaatgcaaagcaacacgagtatttttctcttttaattaaaatcaaacttttggattctgtttttattagatgaacaaaagtacaaatgactaaaacgtgtttaataaatttaattattttgctttggacatgaatagaaactagaaagctcctttttgtatcgggtgagaagtgaattaaaaagctactttaacccttatttaaaattaaatgaacaaatgcgtttaattgtgttttcatatttagtttttaaaactattttataaaataggtctgaaaattaagttttagatattgggaaagagggattgataaggtatttgtaaaaaatgaatatgagtaataaaaatatgaaattagaaaacaaaaaatttaaagatgttttggtattttaatttataaactgaaaaatatacgcataaaataatttttaaaaattactcttactaaaaaaataattttctttattttaccaataaataaataaacaaaccatcctaattcttttccttttcctccccgcacatatatatgcgcaaaggagccaaattaattctaactagtgtataactttatttaaaagtagagatatttggtgctaacagattcaaggtcaacctccaatgtataatttatacttctttttcgaaaagaaattgtccctcgggccaaagattctcagctcaactgacattttgagattattgatatttgatacgtgtttttttaaaataatagtatttattacgtgtttatagttttagttcaattttgaaaaaaccaattttttttaatatcttttgagaaaattagaaaactattagtatattactgttaaagacttatttggataaatttctctaaaagcacttttaaaaacaataaaaagaatttttttataagaaaaaataagtttttcattagttaattttaaaaaattcatcgataacatttacaaatcagttaatgaaaaattcattttaatttatttcattttttttctttactagaaaaacttacacccaaataaacccaaatcagatttagcatcatcctgttgttgtattcttcctaaatgaagtagatatggtttgtcatatatagaccttatatatcgctagggcacatgaagatagatttagattcaattgtttcgtgtaataaaatattttcgtaaacaacggcgtttattgttatatacgtgttatggattgggcaagaaacataatgtgagtaatgcaccatctcaggatagagcataggaccagcttaaaatgataagtattgattaaagtcaatattcggtaaaagattcgtgaaatatatctataactagtggattatgagaactcatacttggataacaaattgtagaataacaaaacgtacaattaagatggagaaaaagagagaaatttgagttcgaaatataataaatgatagactagaagagagataaacataaaatataaactattgtataagttattatttgttttatatctcgtgaattatagatgaatttagagtaaatttatgaaaaaataagttatgcattattagagtaaaatattttacatcattatttaatcacaataaacttaataatatatgatgagaatgatgattttttatgataatttatgattgaattgaataataatataaaattattttatattaaatgtgtatgaccgttaaattcttgaatttcattttttaccaataaactctaaagttattatgtggtaaatagaataatattgcttataaattgcattccatgccataaaattacaagttccatttatctcataaaattatggaagtcaatagtcggtgatggttcttgttcggcttaaaaaaaatgcatctatgctttttgtatctgattcttcttgttccatatttatgctcatacttttgtttttcaattcattacctttcatctgattctatcaatttttttccttatcaaaatttagttgatttaagtcccaataattcaccggaaagaatatgtttcaactcatgtccattagaaatatgagtttatttcttatctaaaaaaataacctttgttgatatattgattctatcaattcaacttcaagtattaattagcaatatgtagtgggtcaattaaccttaaattatttcaatttaatcaaaaattttaaattcgaatcatgaatacttaaatgtgttaaatatttaaaggataaattttatagttcataatgattcttatccaattcaaataagattagcttcaatagaagatacacatgatttagaaaaaataaacccttcaagttgtggttgagcaacatttgagttttatcatttcttaattttctgtttattattaacaggaaagtttgtgttgctcacagatttgatagatgaccctctctcttatagaatgtttctacaatgaccaaatattagaaacagtcaacatttcacttgagtgttctaaattttagtataagaaatattttagtaatttgtattatatatatatatataataaatgtttattttatataattaaacttataataaataaatatctttaaatactaaattatatttcaaatttataatgaaaaattgaaattgtaatataaagttactttaaaatatcaataatttatttttaaaaattaataaatttcaattaagagataaaaataaacaaggataaattacaaattaggcacggtaaaaatatcacaatcaaaatgaaatattctttaaatgaagatagtataaaagaaagtttaaattatctatttgtagaagggttaaggacaaattaagatgaaatttaaattcaagatttttattttgaaaaaagagtaaaattttaagaggtggagtactttttttcttattgaatatttattttggtagattaataaaataaaatacactgtaaccttacaaaattaagttcccctaggaggccttccttttaggtcggtttgttctcaaacaaataaggtttcttattctaaatattttacttattatcaatatttcttttcacaattaaaaataaaaataaaagaaagattttaataagggtgtaaggaaaacaatggtaggttaggttttgcaaggtccaagatggacttaactctcattctttaaacttatgcacctgttataggcctcttattttatgtttattataatctatttaaatagcttaagcataaaataaattttctctttctacttttgattaaattttagttttttagttgtaatcgaccaatatgtttcttatattttaaaaaataggatttagttctcacgtgctgaccaccgaagaatcaaataaagattaaattcacttattttttttaagttagaaacaaaattgatggatttaaaactacacatgctaaaatcaatttgaccgaaagttcaaaaacatatttttacccaagtcataatatagaagccttatgtttatttttttattttttttccctttcaacaaagaccaattttatataaggtttacaaaaaggggttaacttcctacacccagccaagttctaatacacccaacacttttgtgaaaaaggcaatattacccttgtacattttgctttactttcccttgtcattcattattttcacatacaccagctgctgaatcttcttccttctcttcttcttcttccgtctgatgtgtttgttggttctggcttcttggttctagcttcgattgttgtgggttgttgggttgaggtcgttgttagcagtcgtggaggtttcgttggccgggatcgtcgtcgtcggagtcgtcagaggtaagttgtactgtttctggggacgcacattcggattggcaatctgtacgagttatacagattagcaatccgtatgggttatacggattgccaatccgtatgggttttttttttctgtttgttttgatttttgttttttttttttttaaatatttgtgttgtttttgttaaaggtattaataattaatgtatttttccttttcaattaaaataacagttaagttttgaattatgacggaattttgttttgaattaatgacaaagttgtgaaatgaatataaagatactttttgttagtgattatttgttttgaatttgtttgtttattaagatggacaacgatgattggatgcatgatgatattatggcggaagaaaataatatgggtgaagacaacagaggtgaaccgtttgcattttagaataacaactctatgattgattgttctaatgcatttaagacttcaaatgtatttatgtgataaagtagcatattgaatgtcagtaaataattaatttcatgagattgagcatgtattctgaaaagttgtaggtgtttaattctcgtgacgaggtattgcaatgggctcgtagtcttgcatctgagattgattttgtagctgtgataatgaggtatgacacagcaactggcaagaggggaaggacctcatttattttgataggttgtgaaaggagtgaaaactatagagcattcaacaaagatttagttcgcatgaccactagcagtagaaaatgcggttgtccttttaagttgcgaggaaaactcgtcataggtggcaatccgtatgagccttacggattggcaatccatatgatccttacggattgtcaatccagaagcttgatacggattccaatccttcatacggatccataatccgtccaatgcacaggatacggattaccaatccataagcatcctaaaccaaagacgaaacgacaatgcaaagcaccacttacctcgtatcgctggaaaacaatgtcgccttcgtcgccgaccaccgaccaccacaaaacctccgtccacagcccaagataccagaacgacaaccgcagagcaccaaagtcgccacaaagcaggagagcacgaggagattggaagcagaaacgaaaagcaaatgacgggtgtattagaaatttgaaaagctttggtttttattattttaagcaagggtaatattgcctttttcacaaaagtgttgggtgtattagaactttgttgggtgtaggaagttaaccccttacaaacaatacaacagacctattagcccaaataagttagtggacctatatatgtaagtatgcggaactagtgcgcttctgatttcaacatgagcattatttgtgtaggaagtaaataataataataataagaagaagaagaagaaactattaacaaggctggtctattatgcttaacaggttttttttctctctctcttctcattaattattcttaaaattaaaaaaaacaattttaaaagtattaaaaattatgttaagtaatccttccgatattaaattttttaaaatcaatcccaaaattttactaaaatatattaactaagagacaaaaataataaaacatttaattattttaaaaattactacaactgcatgtgaaagagactaataaattaactaattaaacataaatgattaatatattaaaaataagtttgaatcattcatataaaatatcaaattcaatcgtaatcatattttactttttaattgatcaactctaaattaattaatatcttttttctctttattgaagggaggatttagaagaaaaaaaattggaggataaagttagtaattattatcctctagctcaaaaagcggattctttcacctattaaaaaacataaaaatagaaacaggcatggaataaaaaaaggaaactaataattcactgagtgagtgagtcacagtgttcactcgtgactccactgagtccactctctgtctcgggcatcaacattaccatgggaacgccgtacccaactccgatctcaccctccgaaacccgaatcgggtggatcggtatcggcgtaatgggcttcgccatggcctctcgcctcctttctgctggctacaccctctctttctacgcccgcaaccctgcccaccccaacgccctctctctccaatcccaaggcgccaccctggcccaatccccggcccaactggcccaattctccgacgtcctcttcaccatggtgggccacccctccgacgtacgctccctcctcctcgactcccccgtcctcccctccctccgccccaactccgtcgccgtcgacaccaccagctcccaccccgacctcgcccgccagatcttctccgcagcacgctccctaggggcctggtccgtcgacgcccccgtctccggcggcgacatcggcgcgcgcgacggtaagctcgccatcctcgccgccggagaaaaagccgtagtcgaatggctgaaccctctgttctcgatcctcgggagagccacttacatgggccccgcagggtgcgggcagagctgcaagatcgcgaaccagatcacgattggcgcgaacttgatcgggctgagcgaggggctggtgttcgcgaagcgtgcggggctggacctgaaggagttcgtggaagccataaaagacggtgctgcgggttcgaaggcacttgaattgttcggggagaggatgattgagagggattttcgaccagggggttttgcggagtatcaggttaaggatttggggatgggggttgatgttgtggaaggaggagatgatgctgatgttgttgtcttgccaggggcttcgttgtgtaaacagttgttttctagtatggtggctaataggcaggggaagcttggcgggcaagggattatctctgtaattgagaggatcaatgggatgaatcaaccaatgaatgaatgaaattcgcagtggtgtaccaccgagcacgtggatcaattggcgtggggttggtccaacttaatcaaaggtctcgattttaagtcttggttatgcagatgtgttaaatactcgaaggtataatcctatcttactggaacaaaattgtctccggtgaaaaagaaatttgcagtggtgtgtaataaaatgccaatgtaacattgaagttagaattcttaaggtggatcgtgcatgtatgtgtgtttaattttatttagtcagtgttaactctggtttgcttctattgatggtggaggattgtctttgtatgagaagcaacatgcattttattgaattggaatagttgcaattaatgcaagcctctgtttccttgactttgtgttcacaaagtcacaacgtctttaaggcttttttatgtcacaggttaacaagatcttacttttaatagtggttaccagttatcaataaccaactccattagttggttgatgtgggactcgtgatgaaaaatgtataaaaaagaagttgatgtgatgaatgcagtgtgatcattctctggcatggagttggcttcataaatagatttaaggagaagccaagaacatctcactatgcaacaaacaaacggatactgaggtacattaaaggggcgattgatttcgggttgctattttcaaatgagatgcagtgtagaagtgtaaagattggatgtatggactttggttggtgtggagataagaatgatcaaaagaatacaacttgttgtgttttcatgtgctgcaaatgcttggatgaagtattttaaaatttcaggaaatttaaaattcagggaaattaaaatacatcaattaaaatttttgtattttcaaaattttgtgtttggataaagaaattgaattttttcatttttaaaattttgaacttcattcacggaaaaaacacgtaaggtgagtggtgtcgtgagagtagaggaggtcggagtaagttggtgatttagacggagcaaaaaattgtacatttagagcttctaaaaaagaagagaatttcaatttctcaccttttagagggaaattcaaattccacttttttagttgtttaaaattctgttttaaaattccaaaaatttaaattcctcatataaaagtattcaaacagtaaattttaaattgaagaattttaaatctcctaataaattactttccccaattaaaattctctgtccaaagtgagcgagtcactgagattcaaaatttttggatctaagtttgagagacaaactgtgtgcattgtcgacacttcaacaccctttgctactcccacggcaaggaggagggcgttgaagtggagcttgaagtgttcgccggcgagaacgatggcagaggagagggcctggagcgcaccctggaagacgcaaaagttgttgtccttgaggagatccatacatatatcgacgagcgaggtgacctcagaagaggatgggctctttctagaagcttctagaaattggtggaggcactccacacctgccatcctctccttcgtgtccttcatgcgtgatagttccagcgcttcctctatttatttcttcgatcagatctaaagaagagtgagcgagtcactgagcgagcaagtgagaaactgatgagattacgcggcacatccgtcaaattcaaagagagtggctagattgacaggggaagaagatgaaggatgaagttgaaatgaaatcaaaacttgcttatgcggttgagcatgagtccgttggtcgggttgagatcaacgtcgccgaggtcgaggtcttcgtcgtcatcgatgcatgtccatcgcgggtggcggaattttagggttctctctttaatctctatacactggtgtgagtttgagtgactgaatgagtgagtggcgagcattgtcgatttttgctagaagagaaatgaaaccaggacgattttacaaaaaatgtttgtggaacgcaactttttaagataatttttgtaaatttgtcatcattgaagtcgtaatcgaatttcagatggttcttggaaaactgtcattatttcaccgtagtagaatacaaatttttttagtagtaatatgttttaatcaagttaattataaatatttaaattttttattataataaaaggaaatgagaaacatatatgttatgtctattctaagaagcactttccgcatgtccttatcaaatatgagttttgaaccttaaattttgttacattgaaacatataagttatgtatattgtttagatgaaattatttataagaaattaagttttatatgaataaatttttccataaataattataagagaaaaaaatataaaatagaatgaattgtaatttatataagtttaaattaattatgtactatttactttttataaaaattattttcatttgatttttctaaaaagctaaggttcctaaaatagttaattaagcttatatatagagaagttaaatatatttcactttcttatttttttttcttccaaataaatgtttcataaactaaagaagcttatgaaacgtataagaaaagaaaaaaataaattaaatttctctataaattaaaataaaatttatgccttttacttttatataaactttctcaataaattcttcaaaagatgaagtggatgaattcattttaatttgtgtgagaagtctagactgattttgaaatgaagtgatttgaaataaaatttatgccttttacttttatataaactttctcaataaattcttcaaaagatgaagtgcatgaatacttttaatttattattgaaaaattcaatataaatttttatctttaacataaaaattatctaaaaatatttaactcaaaatcaattctacaatataatccactatgcaatgtaagaccatacatgtaaacattttaattataatcacttcatgaatactcttcgttcataacagaacatatataaagaattttactgctaccaaagtatatcctttaaattgaaaacaaaagcaatacaatgacatacacatcgacttcttctccatccctgtctcttgaatcaacatcaaactaaggattttcacgtagaaagataaatttagtattttctcatatgtataacatcatctgaattttacaaaacaaatacattcacacgcatgcatcatctcatgtgtcagactaacttgtaggacgtgggtgggatgagattagaggatttcttgatcttggatacgaacaactcttgaaattctgaatccacgttaagagccacttgttgaacagtagatgacaacacaccccaaattgatgcctttccagccaactcttcaaacaaaggcctacaaataatataatcaaacatttttgttagtagtactaattaatcatactgggacatactctcaaataatatataatcaaccatttttaatgttattgcatgctataaaaattattttatataaaatcccaacagcttacttagtagttgtgacaatggagtaactttccattccttcatctcctgcaatttgggtaaccacaaaaaattgtggcacaacaagtaaatcaccagccttaataacttgagtgtctaatacacgttttccattcaagcccacaatttcaatcttgccacttcctctagcaatgtaaattaactgaactgcagtgttggtagggtatgatggtgtcttaatagcaccaggttcaagtttcactctaatcacacttaacccaacatccccaataaaaggaaaatctttctccgttaaggttttgactaatccagcattttccacaacattttgtgcacgtgcagcgtctatattatagactagcttcttggtcatgttcatttgtggcttaggcattggttgacttttgtctagcttgatgatcataaccccagtttgactttttgtgagcttttcaacctcatctttgtccaagttatataatttacttgtgaggtcattagagaaacctcctataagtcctatagccccagttagaaagaaataggtgaattggccaggaacaagagcctttgaagtttccccaagaaaaagcaattataagatcagagtctccatcgttgaaccaccacgagacagctccaataggcactggtataacatctccttgcttaagcttcaaaaccacctcttctttagtgttgggaagtaccatcccaactatgccatcgctccctgcacgtgtgccataaaattaaagaaattaatttgcaattgagtcatttttcatcaaagttctatgaaaattaattaacaccgtgaatcattgaagtttattacacgattgaatacgcaatcaattaccattgcgtctcactgattcacaaagagagcgacagagaatactatttggcattaatgtagtcttaaaaaagtatatgatgcagttaattggtcactgtgtgactttgatccattgtttaattaccctatttgtagtgatatatttttaatataacttcttagtttgatcaatttcttataacttagttacgtatagtataggccatatataggggaaaaaatatagtaaagatatagacgggctctgaccttgaatgacataacctatttttgatgaatctgcataatgaggaagggcaaaggcacgaggctgaagcacaaggcgaccagcacccacattcatcttagccagaatgggcatttgagaactcgaccaagtgtagtaacctccaccatctccctcaaacactggttgtgctgtctttggcattaaatccaactccattgatttgattttccttttgttcaggaaaaatatttcagataaatgaatgcattgttgttaaaagtagttgtgctaaattatataaccaaaaatcacatgctagacgtattgaggaatcaaattagaggagtcatgaaggcaacaaattaaaccaacaaaacactaaaaggctaattatactttttgatattgtagaacttaaatttaacatgttttttaactttgagcatcaagcatgcatatcttaaaattagaaattcatatatctagtgtacgtattcaaaaagttacaagggaaagtcacgcactcatatattcctttatcttacaacaaatcaaagatccgaaaaaccatattcataataagtcttgtattgtatgtacctgtgatttagaggcgaaagacatatataaccaagactttcctcaacctgtctatcttttttatgataactagtcgaaagaaagaaactaagaaaaagcagcgaattaagaggatttagtagcatcaacgatttggccaagacatgaagacctattgagggctgtatatagatattggctcattacaattatttttgaaacttcatatactttctgtccaataagagaaaacgtataccaatgaaacaccaccaacggaatgtgggacatgcctcgtgctgacttttattgccaccttacgcatacagaaacaatttagagttgaccttttaaaacaacacgtacgcaaataatcaacctactcaaaagtcaaaatcattcaacagattggtaaaagccaaattaagtggagagctcatggggctagcttgatcgatcttgtgttgcttactcatcaaaacaattgtaaaatgattgagagcgactgctacgcgtcgaagctagaatggatggaatcagtcatcatcggaattgtgatatttgtaaattaaatccacataatatttttaaatttatttaaattgtatgttatgtaagttttatgttgatgagataagaatatattttcttactatctcattattaataatgtatctattgaataaacatatattgattaaaatattattatagattatttatgtaacaatttccatataaaatgaatattacaaaaaaaataattatgttttaactcggcacattgttttggatgttcttttaattatgtaagaatttaaatttgtcacgtggagttataattataatatgtgatattttttttaaagtaaatttgtgtttttgtttatgatttgaaataatattttgaaaagttattgatataagaagaattcttgtattagatttttgagtggataaacttcttttcaaatatttatataaaaaaacaagatttagaacaaatattttatatttatagaatagcatttttatatttaatactctttattaaataataaaaatactttaagtcaatagaataaatatataagatgtatatatataactatataaggtataaaaattattataattttgtgtttatcatttattaaaaatgctgaaaaacatttattaaaaaaaatacgagaacttcaaataaaattattgtgtaaataggttggaagccttaatttgagtctttaggatatacttgtttcaaaaatacattttataaaaaaaatataaaaatacattattttattttgaaaatttgtttaaataaagaataacaaaacaatggtatcatatttgacggtacaaaatttcaaaaattaaaactgttattggactgttgtgagttatgtcgacgagggatcgttttctatgttgtggttttgtttttctctatagtgtgctttgctttcacgtggacaaaaatgaaatgtgactatgtgagtaataatacagaaacgcctcttcgaggtctctcattcttttttatctctttttctttttctatcgtacctatgtttaaaaaataaaaaataaaaagatttttttgacattttgctaatgctagtacacacttgagagagaaagagcgaggagagagaaaagtatatatataataagtgataataatttgatagaaagaaatatagagaaaataaaaatatcaatgtttgaaatttatagatgttaaaaaataagactcatacttttctgtttttttttatccatctctataggtattaaataatataatgggcataccattttttatttgtaaattcattaagaaaagaggaatcacatttggatatatagtcttatttaccaaatctcctctcatctctttgtcatactgttaagttttttattttttatttttcggttttttacacaacgaaagtatgttatagttggtctcttaatttatttgaatcaaattgaacagtcaaccgaaattgaatcaaactattttaaaggcaggtgtattaaattggattgaaccgattcaaattaagctattaagaactgcaccaaactatttttaaggggccttttttttgtagaaaatacttttttttttgcttttaatttaaaaaataccacattgtttagtttgccttctcattttaacattgatttgtgtttgaataaataagtaatgattttttatatgattgtgatttttcaaattgctatgaacaaaatattaaagataagttttagcatttttaaaattataggtttttgaatatttatgatcaacatatttgaaaattgcttatagaggccaaacgtgaaagcaaagcacattttttaatgaatgtatggagatttacatcgagtaaccatataatgggattggacaccacatcttaacccaaaatcttaaggctcaggtttatggattttctccttacttatatggtgttaaactttttttctatttctatccgacgtgagactttaactcacacatgtactcaacataatgagagggtataggagagaatattgtatgttggagaggagcgggatttatttttccaacactgatgaatatcagtttgtgagtgcactgaattgcctttttttagcagttaagtttttaaaagatggttcagttcaatttttatttaaacagttcaattttttttttttgtttattttggttcagttaattatagttcagtgaagttcggtttgtttttgccacccctacacatagccgttgttgcgaggtaagggtttcgtcaccatcaattaatataattaaccagcatcattgtctaattaattgggaaataatttctgtagtagcaaggttattaggttttcgtgtaacatgcatttctctgttggagatatggtgaatattgaacaatgggaagtcgaaagcaacaagcttgagggaagcatagggggatttaggttgtgttaggtcgcatggaaatagagagggggaggaaggaagagagtaaaaataaggaaacgttggttgtttggaacttacaagagtggtagtgtatagggcaattttttttaagaatatgtgaacccaattaaaaaaaatagcacaaataaatctgaaattgcaatatatatataagaggactgagaagaaacaccgtttaagtttccaccatattcgattaagttaggcttttccttcctcttgtatagttataatagtaaaatattaacaataaaaataaataaatgataatgtttttttaaaatcaattaatttaaaaatgaattttcactctattttatttttaatcaaacttattttttactttatttttcttttctcacctatatattccctttcattctcttaattacttttttcctcacaacaaaacagtgtacacgcaagcctaggtatgacatactgaataaaatattatctcctataaaaattacatgtaatttaataaataaaaagaagaagaaaagaaaagaaagaaaaaaaagttcatgagtggccacaagcttcaacatttcatcctgataattaaaagttgttgtttcaatcaaagaaattgtgattgtaattagttattgggtctacgcattcatatccttccattcatttattgctcaatatagaacacttaaataagtattatcacaaaaatatttttctttaaaacaaaagcaatacaacgacataatttttagaaagataagttcgatcagaattatcttacatcaatatcatcatctgaaaattatgcataaacaaatacggtagtacgtacatcacatgcatcgaactaagcagtaggagggatgagattggtagattccttgatcttggatatgaaaaacttttgaaaatcagaatccacgttaagagacacttgttgcagtgtaggcgaaaaggcgttccaaattgatccccttccagccaattcttcaaacaatggcctgtaaataagataatcaatcattttttttttgttaattttgttaacacttaattatactgtgtcatactttaaagtaatataatcaatcatttttaatgtcattgcatgccaccatgtgctacttcttggattaaatgaatatattttgtataaattaagtcatactttatagttattacgatggagtaactctcaattccttcttcacccgcaatttcagcaacatcaaagaattgtggcacgacaagcaaatgaccagcctcaactagagtgtttaatacactctttccactaaagtccacaatttcaatcttaccacctctcctctggcaatgtaaatcaactgaaccgtaaggttggttgggtatgagggtgctaccggttgaagtttcactctaatcacacttaacccaacatccccgataaaaggaaaatctttctccgttaaggttttgactaatccagcattttccacaacattttctgggcgtgcagcatctatattatagagtagctttttggtgatgttcatttgtggcttaaggcatgggttgacttttgtctaggtttgatgatcaaaaccccaagtttggctttatgagcttttccacctcattgtccaaaccatatactttgcttgtgagctcattggagaagcctcctataagtcctagagccccagttagaaagaaataggtgaattggacaggaacaagagcctttgaagtttctccaagaaaagcaatgatgcatgagatcagagtctccatcgttgaaccaccacgagacagctccaataggcactggtataacatctcccttcttaagcttcaaaaccacctcttctttaggctttgtttgggagagggattttggagggaaagagagggaaatgaaaggtttatgtagagacattcccttgtttgggagttttaatttttgagggaaaggatttgaggattttcaaaactcctccgagatcctccaaaaccttaaaattgttgtctcccctatttgggggtttttagaaggaaaaataactaaaattattattatactagtcagtgttaataaaattattatcctaccccagtcagtataaaatatataatatattatttttttaaataaggaaaaaattgtaaaatttttttattaactctctattttcctctcttgatatatttttaactcccaaacaaggagaaaagaactttccttattttcctccatttccttccccttgaatctctttccttcccctcccctcctaactctcaaacaaagccttagtgttggggagtaccatcccaatcccatctacgccatcagtccctgcatgcatgtgtgccataaaattgagaaatttaataggagacagtgatgatcaccaaagttctaagaaaactagcaccactagccatttaagtttattacacgtacgattcaatacataataccattatattatggatgtcactaattaaaaaaggaaaaaaattaaactaattcacaacaataatgatatttttgtaatttaattgactgtttttaatgagattttttttgttaattacatatttttcgtctatatatgttcgaaaataaaatcttaattaaaaattctaagcctaattttattcaaaccaaccactggttggtatgtcataactcataagtgtgtgaatattaaattaaactcgtatgtataacttgtcatagaaatgggaggggaaattaaaatttaaaaatagaaaagatatgatgatatctacgcgcgggtctgaccttgaatgacataaccaattttggatgaatctgcataatgaggaaggacaaagccacgaggctgaagcacaaggcgacctgcaccaacattattcttagccaggagtggcactttagaacttgaccaagtgtagtaaccttgttgtgtgatttatgcgaatgtgtatacggcaagtgcactgatcgtttaacaagtaataaagtaggtaagtgagtgatcgtctccacagggattgaaaggatttttcagcaattcgaacaattgtgattaaaacagaaaacagaaaagtacgcagaagttgttgaatgattgtgttgattaaaaaggaaatttaaacaaaacagtaaatttaaacttgaaagattaccaaagagaattaattgtggtcagacaaaatctcttataagcattacctccttcaattgactgattattttaacttgaagtttacataagataaatctctcctatagttgtaaatactagataactagtaatctcaccttttaatttgatcaagaaccctaaccttctagcgattctgtcaaactaagaattcagagaatagatcctatgggttcgtgttatgattactcggagaataagtctttcctatactagttaacccctaatttcttagtgaattaaccctttaaactgaatttataacctaatgtcttagtgaaattaatcagtttaagcaatcaaagaacatattataaactccgcactcatgcatccctatgtctaagtgaagaacaagtgttattcttaacaagtcagatgttataataccaacgtgtccattgcgaattataactcccaatactcattcaaagtgatcaattctaaacaagataaaatataagcacagaaaagaattaaagtaaacacaacatatgcatttaataccagtcaatttacagaggaaaactcataagttcatggcctttccacaatgagatgattagccagccatagacttcaagaacaccaaatcataagatgaattcataattgtgcagaactttggcctgaaatcttgattcctagggcttgcaatgactaaagctctattttctcctctctctctgtccaagtatatctttttattcagaaacctcccatatatatagagtaatttaattacagtaactgaatcaaccatttttcctaatttcgaaacatatatcttttaatacaggaaagaaaatcacaaccacgcgacccgcgcgcgataccacgcgagtcgcgtgggctggcagaagaaatggcgcttgtcgcgtgaattggcagaagataaatccttattccttaaagtcttggcgcgacccgcgtggctaccgcgtttgtcgcgtgagatggcagagatgaaaaggtttaaacattgaagttccaacgcgacatacgtgagaattggcgctacccgcgtgagttggcagagaagaattcattaatcctcagagttctgacgcgacatgcgtggactcgacgcttcatacgtgatcttcttgggtcttccacgcgactcgcgcgaataatggcgcgacacgtgatactccagaatttgctttctttattatttgctcttaagtccttctctttggcctgcaaatgcttaaatgatattaaaatgcttgacataattaaaaatactaaagatgattaatttttgaactattttctaactatttaattaaaatataacctaaaattaagctagaattaagatgtgtttgcaacacatcaaacctccaccatctccctcaaacaatgcttctgttaattgtcttcggtgttaagtccaactccattgatttaatcttccctttgctcgtgatcataaagcattagtagtgtcacttattttaaagaaattgtaatgctaaataaaccactccaacacaaaaattaatttacagaagtgatagatatttaaacacttattgaaataaaattaggcattcatgagaacgtatatatttagccggtttgtttacatgtacatcataaaattataaatttcatgtcttgtgagtctataaaaacgaaaagttatactagtattgctaggttgataatctcaaagctaggcagatacatggttagttcccttaacttatacttcttaactttatgtatcatgcaattaatctaatcattaatcaatattagaaatttcatatatagtagtccaaagctataattaagatttaagactactcttgcactcaaaaagtgcacgcgcgtgcacgcgcacacacacacatatatatatatatataattaattattgtctgtttatcttacaacaaattaaatatcagaacatagagttacaaattcatagtaagtcatgtgtttacatgtgaactagaggagaaaaaatataacgaggacttccctgaatccgtctttgtatttgaagataactaatcaaagaaagaaactatgaacaagcaacgaattgaactcaacaataaggggatttaggtgcatcaacgacttggccgagacatcaaaacctagagaattaatttgtatactttctttctgatgagaagagaaaacgggtagtcacttttctcattagagaaataccaaaattctctcatttaagataagtttttaagtgcatccaaagtacgtacgtatttgtttaaatagggttgcttattttaatttgatgaatcctataatgtcacatagatttaaacactccacacataaatttattctaatattaattgtaacgccccagctacaaccgaggtcattaccacgccttaattactatcattactagataatcatcagaattaagcagtttggaagcatacataacataaaagtgacatcaacaaatgccgtcatcatatacactgtacatatagcatgatgaatatacataaagtctctgtgtcttatacaaaactgtacatcaacctccctctcaggggtacaaatataaaaccaaaggcaagtacaaaacatctgagccacaactcaggtcatttagcctatggttacacatccagctatccctgcataggcttcttgccctgggatctatctgttccgcttgatgtttctcctgcaaaacataagccccacacacggggtgagatataaaatctcagtaaactcagggcccttgaagatatttccttcccctggttcacttttcaatacaaacaaatcttcatcataatcatatcatcaagcaaacacaatatcaaattatcatccacctggccacaaccaagtgtctcaagcattacctgaccacaatcaggtcatcaagtactacctgactacaatcaggtcatcaccactacctgactacaatcaggttatattcatggcatacgccaatcatcacatccataactgatatgcagaggctacatcatagtatgtaggaacatctcctcacagggaggctacctctacatactaggcacatctcttgcatatatccctagcggaggcttcctatgaatatataggtacatctctatctcgaggcttcatctatatatcaggtacatctcctttttggtgaggctacctctatgtacataggaacatctcttatcacgaggctacctctatgtatcacaggaccatctcatcctcgaacacaatacatttgcctagggagactgcctctgtgtatatgggaacatcatcacatatcatcccctttacaaaggattcatcatacattccatgcagttatcccctcatcaaagggttcaatacacattcctacataacatgccctcttcaaagggttcaatcaacatctcaagcatatccaaccattacaggccatacatattatccccctcatcaaagggttcagctcacctgtcaaacatgtacaataaatacatataatcccctcatcaaagggttcaatccacatacttaagcatacatatgcattacaccacattccctcatcaaagggtttcattcacattcaacatatatataatcatccctcaacaaagggttcagatcacattcaatgcatacatatatagtaatccctcatcaaagggttccattcatattcacactcatgttccgcatacatacaattagtcacatcagaaccatccctccactgagggtatggcggaacacagcaaatgacatacaacaaggtccaagagcttacctgctcttcgcaaaacgctggcttccccggtctcgtggctaccaccaccaacggtatcggactcacgtcctaaaagacatacaatcacatatcaaataccattctatccgtacaatgcataaatctctagcaaaacatgcggaaaagcataaactgctgcataaaattctgcaggttttacacccacttggaaaaatcacaaatccttgtgggaggctcctaaaatcacgagaatttagaggcatcaagatatatctcttatcttttaaacaaaactggtttcatcaaaaaccatgaaccacagcctctgcagcaaaccaaaaaccagaactgtcacacactaaaatagtgctgacagcaacagaccaactcaaccagccatctttagaggacaacccacaccaggttacttgtccaaatgagctgatattttacaggcatgaatttcacatacccatctttctatagccactgaaaacactcaatttggatcatcctagaaaaagttatgctttctgcaaaatggttctctgcagcagaaaaatatgctaaaaatagagcataacagcctgttataactctgcaccacaatttctaggaaactccaaaaatagcacgaaaattccagagtgaagctaactctcttagctttcaaatggcaccaattttacaccatttggacaccgatagctcctgctatgggcaaaacaccagaactgcccaaataggtgttcttggctgccatgaacaagcatgcatgatttatgcatggaacaccatttcaacttaaaaacaacttctacccactccaaatcatactttaaaactatctcaccctcttaaaacgcagcattcaacaatctcactccaaatcctaaccctaacctcaagaatcaaggagagataggaggagatttcaaaccttagggttcagtagaccaaattggagggtagaccagcactctatgactctcaatcgcagtttagcggcgccaaacgaaaatgggcagatttgaaacccactcttctcttcaatcaccaacacccaatgctcaaaagcaacaaagaacaaagaaaatggctttcctccttgcttgttttgtgatttcagccactaatctcatggaagtggtgagaagagggcttgagagaagagaagaaccaaggaagaagaaaagaggagaaaccctcaagcagaaacgtatctgctaccttttaataagaaacagggggtgcgttcagcaattactaaatacacccatacctccgacaaagaccaaactgccctttcgtaaatccgtttaattacgcaaatatcacccgaattaccttaattaaatttagtgatattacattaatgttgtttaacttaattttatactaaaaaatgacaagcttatttggaacttgagtcaaactagatgttacaggtcaaatccgcataccacaacaacatggaggtaactatggatgccagaaatttgaaactgcctagtaattggataaatttgaaactgcctagtaattcgatacaattgtggcgtttgaatattcctcctaaaaccaaacatattttatggagaattctttggggttgtctaccttcgcgaagggtgtctcttgcccgaatatttgtcctaattgcgaatcaagtgttgaaaacgattgacatgttttctttggatgccctaaagttattacttatcagtgtttgtttggctactgagttatggcccaatattcaaatttatctgtgcaatatatggagttctcctagctcaaaaggtgaaggatattggtttcatggagacaattagttagctatcagacgttggagtcattggcattgagattgagttagattgcgagaccatcatggatgcttttcaacaaacgacgttccatccagcactgaaattgacaccattattttagcttgtaaatataggctttcttatttttcaaactatatggttagtttggtaaggaggcaagggttgagccaagttagggtctacttaagttggatattacctactttatatttttatgtccaaagtttgaatatgctacttgtcatcagcttatttttaggtctaaactttgcctttatataagctcaacttgtcccattagcctatttcatataaaaaagtgtgaaaatttattatataataataaaatcagtatgcatgaagtattaacgacttacacattattcttatgttatcaaaaattgtatgtgttggatttttatttactttttttctttaacaaaacaaaagatttttattagaaataataggacaattttaaaccatgaaatctaacatatattaaaataattaacctattcaaaacattaaaatgattcaaatcatgatatcaactttcttgccaatccaacaagatcctatattaatattaatattaatatctttgactacattctaacatatattacatttcttattatcaataaaatgaaataaattcatttttattgaaaaaacatttaattttatggatcatacaagatgttaatttatctcattcaaagaataaaaagagtggtattttacctcttaaaaaaagcataaaaagaggttaatacaatttcccctatattttacaataatccaattttagtattttccctgtaattttgggagaatttgttgaatcagcctctgtgggaaagtactgggcgggaaaatggccactaattttgttttcaatttaatcaatttcgccgttgtacttatagtctcgtctcgtatgagtcgaagcccgaattctctcgagtagaggttgcgtttgggctttggagaagaagaaaatggcggagtcgaattacgagtacccaaggctccggcggccggaaatagtcacaatcttagcgcagttgcagatcgcgaacgtgacggagcaggacttcaccaaccctaaccctgatttcatctccgatctctacactcgcgtcctcattcatctcgacattctccttgagtctctctctctctctttctattttcttctcttttcgcaccttcttcgattctacattcctctctcagattcttattcttttcattttccgcagggaagacaacgagcaactcgagttccacgctctagagcatcttgaaaaccctgatttccacgtggattccgttcgcgccgtgaaactctacaaccagatcaacgaagttctcacaacactcgagtgtccgcgcaaattcaccctcgccgatcttctcatgccggatcctcaccgaaccgatctcttccttggctctcttctcaatttttgtctcgataggtcactctcttttaacctcttggattaattattgcctcgctgagagaaaacctaaacattttaatttttttatctcagggacgcgagaatgaactccgtctcggaaattgtggaggaagtgaacgctctagaggcgcagcgaacggagttggaggagaataggattttgcaggtttgtattggaatctcatctcaatctcaatttcaaactcgttgaggttttaactgagcgtgtgttttgctgagtgtttttttttagttgaaagcggagatttcggaatgcaatgaggcgaaggagaaggagatgcctcttgttgaggaggtggaggcccaagttaaagagctcaagcaaatgattgcggtgctgaacagcaaccagagttctctaagaagtactttgaggaagttgaaggagaagaccggggaaacggatgagaaggtcagtgattgtctttggccaataatggattgacatggtgttcgttttctgctgtgacaattggaaatttatgttttaaccagattaattatattttgttggatattagtgtttcctcatttgtgtagacactggacatggctttggttttgatgagtaggtctttattcttgtgcatattacattgtggtctgaatgttgttagcactgtttttagtttggattttgagattcctttctttgtctactaactaacatcaattcccgttccttctgaaaatttgactccttgatgtatgaattatgttaattcttattcattctattttccttttcgtatcccagatttcaaatgccgaatttacattggtacaaaatgtccaagaaaatgcaaatctacgttcaaaaatcggtcaatcacctgataaagtacaggtatttttccccctcttttatatggttctcccttgtagctagcaaccctaattcatttatgttgtttatttgctcttatgttgtaggcataatcaaagttaattggttttgtttatgtttttagctacaaaaatgtggcatactttgcatttctatccaaacaatctgcttgtgtgaatattatattggagattattggactatcttccttctgttagttccacaacttgacctgatactagttttggaaaaaacattggctcattttactctgccagttcttatgtaaattttatctctgattttccttgaagagggctttagaggaaaagaaattagctcgtgaggaggcaaggaatgctgaaagattagcaatgcaagcttttcatgagaagactgcccttgttgaagttttttccaaggtacattgtcaaagactctgcttttatccccctttcatctgcattttagcctttttggtcatggtaaagtgatcttatatcatcacacatatacacaaattttccattggagattttgaattgaaattaaaaggaaaatggaaggaattgaagttttgaatttttttttgaacttcttttcttctcactttctctctctaatcaaacaaaagaaaatatgtagttatttgtatttacgttcactctattttgttttcttccaaccaaacattccatcgagatttactttaggatgcaattgcaatttgcaacataaattcgaattttgtaaagccttgagctagtgagtcttatggcacatgtatcaactgagttgtcaattagttggtgctgaagctggattgggcttatgcaagccaaatcgtcccttgaatattgactggaagatcaaatgccaatatggattgactgattgaatttgatatgcatactgtgggttcattctgtcatatctacaatacttgaataatttatgcactgattttctggacatttttttactcattatttcagaaggcaagctacaatgtaaacagctgtaactatggataaattcatgatgttttgttcttgaatttagatctttttatcttttatcttatcttaggtgtacaagaaaatgtcaaaacactacaagctgatgcaggatatacaagaacaggtattaacatactcttgttagttgacgtctgctctggtgtttatcataatgattgaaaatttactatcaattcaccatgtatactgtgacaagaagcttatttatttattttttggatggaactcacaattggaatgctgtcttagagttagagatatgagatctattatggactgatagaaattgagaaattgtaaaactgatttcattgattagaaaaatatcaagccatgttacaaaggtccttgtcaactctttatatatagagagaccaacagaacctatagttaggaacatctaacaaactaacagattgcagttgacaatttccactaagtaaaaaaccaatacattttacttagtggagtaagaaactctaacttcagtcgaatctcctttagtttatcaaaccaggccctaggagcctgtttgagaccatagatggccttctgaagcttgcacaccattgatttggtggaagattcaaaacctggagtttgctgcatatacaccttctcaagaatgccattaagaaaagcatcattcacatctaactgttgaagaggccaaccataggtggcagccaaggagaggagaagtctcactatgatgggcttgatgacaggtgagaaagtttcagtgtaatctgttccatattgctgatgaaatcccttagctaccaatctggccttgtacttgtttactgaaccatctggatttttgtaatcctgaaaatccacttacagccaataggaactctgctaggaggcaaagaaacaagtgaccaagtaccattcttaatcaatgcatcatattcagctttcatggcagctagccatgtaggatcagccaaggcttgtttggtagacttaggttccatgtgagcaagaagaagagtaggatgaattctgtgttgcacaattccagacttggatttggtttgcattgggtgagtattttgaggaatagagggaatgagtggtagttgctgtatgtcagaactgggaacagaaaaatctgcagggtacagcagtatatgattccgactcatctacatgaatagcagtagataattgagaatctggttgagtgtcaagctttggttgagtgtcaactgaaaggagaggggcaggttgacttgactgtgagtgagagacagaattttgaggtagagaagaagttgaaatttctaaggtactggctggagaagcaacagaggaagagttatgtaattgtgtgggaggtatagacacaagcgggatagtggtgataggaacatgagactctaaagaagggtgtgaagaagtagaagatgaaaatagtttaggatagggaaatttagattcattaaaaacaatatccttagagatgtaaattctgccatctgaggaaagatacttgcatcctttgtgtccaggtgaataccctagaaaagcacattcttgggacctaaactgaaacttgtttttgttgtaaggtcttaagagaggaaaacaggcacagccaaacactctaagaaagtgaaaatcaggttgctgtttgtataatttgacaaagggtatatcaaaattaagggaagaggtgggaagtctgttgataagataaacactggttaagaatgcatgatcccagtaggtaagaggaagaagagattgagctaaaagagtgagaccaagctcaactacgtgtctatgttttctctctaccacaccattttgatgatgagtgtgagggcaaataaccctatgagttacacctaattgccgtaaaaaggcagtaaaaggtctgaactctccccccagtctgtttggacagctttaataggtagacttaattgcctttcagccatagcttgaaactgtttgaaaacatttagtgtttcagactttgttttaagcagaaaaaatgaaaaatccaggtatacctagtataggcatcaacaaaagtagcataatagctataccctgtagaggaaacaaagggagctggtccccaaatgtcactgaaaattagttccagaggttgattatataagttgtgagagaacagggagagtgtaatctgtgagctttaccaagacagcatgaataacaaaaagtcaagctcagttttattgataaatgaaatcttacaaagttgcattacaattttctgaacataaacactagaatggcctaacctagagtgccaagcgcttgaattaatggattttacagcgacagaatttaaaacagaaataggaaaaatagaactaggcctgggagagcttgtcttgacagtagatgaagaacatgacagcaaacttggaaatttgtacagtccatcagaacctagatttcctttgagaagtatctcattggatacctgagatttcaccaagcaaacattaggatgaatagttatctttggcaaattgactgacactcaagttagttgacagttacatatctgtagctgttatgtactcagtttctctttgggttgaatacaatactctttcacctcaatttagttctctctcagatttactttcagtttcgtttaagtttgagagtagtttgtggactgactctgattagaaatagaattctaattctgttgcacaaaattagcctaagcagtgttaaaattaacttgagcagtgtccaaattagaaatcagaggagcagaggatgttgttgcaacatcaatggaaacaacatttttcttgtgaaatttctcaattgagactcatgtgcaagaagcacttcttcacattgcttcaaagattattaccgtgcaaaaccttgtttgatggcagttgtgccttctataggtaaattctgctaaatctattgaaaaggatcttaaagcattgaaggctaaacttagtgatgaagaaatattggagaagtcacttgaggccaaattggttgaaaaacagagtaaaggtatgttcttgtgcaagcattgccgtgtctccatttctggctacatggtttaagaatgagtaatgataatttttacgaaacacattctgtaaaacctgttcacaagtaagctgcatgatttttgtccaataattttgttgtcctttttaatagcatttggtgattgaaaaccagcacatttgtacgccacattattttttaatgatttttgttgaaaactttcatgctacatataactgctctttaagcatgaatatttgttactagcatgttttacctccaactttttcgacttgtttttccttagttgagcagatggaagaatcatggaagcaattggagaaagagtgcaatattatgcgggaagaagcaactaaatacttaagtagtacaaaatcagatgttgaatctaagagatctgttacagaaacaaggcagagaaatgtcgaggctgttttatctgaggtggcattccttaagtttcatgatatattaattatattaggtgaaagaataaattgttatttcttatctgcaaatgacaggtcgatgccataagtagtaaaattatagcagtaaaagaagctggagcagttaaagtggcactgttagcgcgcaaatgtgaagagctagttgaagcggtaaatggccatttatcctattcttgaaacctgtgtgatctaatcaacaggcttggtttaaaaatctttaaattgcacccatctcctccatgaaagaaaaattaaattttaaaagtttctaaagttagccaatacaactttcgcttgaactctactattaagtttattgtttaatttttttgacggacttgcttcaatccttgctcttagcgttataatgttggttgtaaatattgcatgatgatgcgtgttttgcttattgttataatagagaaatagttgaatttttgggtgtgaattgtcgcagtttcacaactatgcgaacccgattgcacgcgtgattgaatctgagcaaagaagactcggggccactgaaggaggtggatttggcatttctgatccggtttaatcatgtatagactactaccaaaaatcaaattatactagagtgtttatttatttatttgacccaactagagtgcatagtttagttgactacatgttagcataaaaaatctggaagaatttttgcagtggttatgcctcaatcacatcaacatcttgctgcagaattgtgtagtgcctattctgtacaccgtgtttcttctattagcccagtagttgaatcaatgtgttgtttcctgtgatggtttgctctatatgtgattatgcctctaattgaatgaaaatttgctatgcgtaatgtatcattctatttgatttttatttattgcgcttgattctatttaatttaatatattttattaattatcaaatgttcaattaattcctaaaaaaatcaaaatgttcaaacacaactttttttgcgtcctttttgtgcaattcatttggtcaaatttctctacctcatgaacttacttttttattgttttgtatttattattattttatattaaaattgaattgtacaccgtgcggagcagaataacgtgcatgtttgagacagcctattattaactatctaatccaaaatgacaaaaatggtactagcagcctggttgaacactcctcaaaatcaagcatttacatgacatcttaatctttctttttagccaacttgttaataataaatgttaataattatatattcacatattagtccgtaattgatttttttcataataataaaaaacattaaacaagtattataatgtattattagttggtaatcggatgtattttctcataataattaaaaaaaatacaaaaaaggtaataaaatgtattactgcattcctgactcctaatctacatattatataaaatttaaacattttatattattgttttgtatctctcgcttctgttttttactaaaaaaaactgtgcacgggttccaagaataaaaatcccgaacagagtagtgtttgtgggagagagagagacagagagactctgttttgttgtccattatctaatccaaaatgacaacaacggtggtgccggtggcagcagctgcaacttggttgaaccatcctccaaaccaagcattaacatggtgtctctctgtgttgccccgaaacgttgcgttttggtcccaccaccatctcgtgaaggagaagaagaagaagctcatgtcttggtcaatttgtgcccagtcctcacctttcgacctttctcctcctcccatcgaccatgacttcctggtaattttccagcacttgtaaacttccctttcttatttcttgctctccactcttctcaatagcgtcgctacagcgtcgttcgcggcgcgattcagcgtcgccggaatcgcggagtgtaacgccgctatcgcgctgcacccgtaacattccgaaaaatccctcacgttaggtttttcttgcggctattttatgaaaaaggtttttcagcctcgacctagctttgcctctcttctctccgttccggctagtttttctcttctgtccggcgactcgtgcctctttcttctaagtcatggcaacgtccctcgcaacaggaagggtctgcatcagcgtcttcccctcaacaaggggaagatgttgcatgcaacgtgaattggttgcatgaatgtgacatggaagaaatgcgggcaattcggaaccttcgaagagggaaaggacctcaaacatcaagtgagttctttttacatgctgggaatgagatgcatgaacgtgacatggaagaataagggcaatttggaatttccgaagagggaaaaggtatctaacatcaagcgaggtctttttacctgctggcaatgagtttctgtaccgtgacttgacttggatgaaatgcagtaaatttcgaatctccgaagaggtaaaaggcatctaacaactggtgaggtctctttacctgccgggaatgagttgcaacatgagatggaagatatgcgggaaatttggaatctccaaagagggaaaaggcctctaacagcaggagaggtctctttatctgcttcgaagaaggcccgaaatgccaaagtttgtaatggtgcttctgacaggaaagctagagcaatatatagtacgattcttggttacaaacgggattcctttgtaaccaatggtgctgccatgtgtttagaggtccactccttaaaaaggagttggaatacacaaagggatttcttaagagtcatgaagaagaacgagcagtgtatggatgttcagttatgttagatgcattgacggatagaatgaatagaaccttgattatttttttggtggattttccaagggggatcaatgtttgtgaggagcgttgatgcttctaggtgcatgaagactgcggtgactcaggtgagactatttgagctcttggatagttttgatgaggatattggagaaaaactgtcgtgcaagtgatcacgaacaatggagctaattttgtattagcttgtaagaattattattaattaatttcacaattttaattgttaattgttagtttgttactcattttaagtttattgatttcagtcttggggaaaattttagaaatcaagagggagcatttgttttggactccatttgcttcctattgtatagacttgatgtaacatcctttataattttatttatttatgtatacttaattattttatttcgtttattcctttaatttgtcaaatagaaatttagtagaaagaatttaaaacaaaaagtcattagataatacattcatcgcatatcattacacatagttcatacgggctttaatttacaatcccatcatcctagtgtttttatttatttacaaagtgctccacccctcactttcaaacgtagtctccattactatcttcttcgctgagcactattatggggtccgtggtaggattcggatacacgggagcaaactgaaggaagggatcatatggattaaattcttcactaaaaacagagattggaaaatgagttccgaagtagatgtgagctcggagaactggctgcatggtgtctacataacaatttctgacttcatcaaaaatttctcagtagatttatttaatgttttatcttagatggcttccatcatactgttccttgatacattggatatagcttggtacgttgctgaagtcagaaattgttatgtagtcaccatgcagccagttctccgagctcacatctacttcggagctcattttccaatctctgtttttagtaaaaaatttaatccatatgatcccttccttcagtttgctcccgtgtatccgaatcctatcacggaccccataatagtgctcagcgaagaagatagtaatggagactacgtttgaaagtgaggggtggagcactttgtaaataaataaaaacactaggatgatgggattgtaaattaaagcccgtatgaactatgtgtaatgatatgcgatgaatgtattatctaatgactttttgttttaaattctttctactaaatttctatttgacgaattaaaggaataaacgaaataaaataattaagtatacataaataaataaaattataaaggatgttacacttgatgctagaggacattgggaagatggatgaagttaaaaaggctatacgaagaggcatctatcttgttagttttatctataaccacacattggctttgaacatgatgagaaagttcacaaacaagatggaattggttagacatggagtgaaaaggtttgttacttcatttcttactttgcaaaggctgcataatcagaaaaataatcttagaagaatgttcacttcggatgaatggatgaaaactaatattgctgaaaatcatgaggtgaatagggcagctggcattgttcttatgccttcatttaggaatgatgctgtttacatccttaaggctatgcggcctattgtgcatgtgcttaggctagttaataatgagaaaaagcctgcaatgggttacatttataaagcaattgatagagccaaggagacaattcaaagttctttcaaagggaatgaagaaaagtacaaagaaatatttgcaatcattgatagaagatggaaatgtcaactcaatcatccattgcatgcagcaggtcattttctaaaacccgagttcttctacaaaaaattcaagacttgatcttgatcctgaagtgatggaaggactttataggtgcattgagaggcttagtgaaaataacaaacctgtagataagattttaagcgagttgtctacgtataaagtggcaataaggcaaaagactacagtagctcctggtaagtgcaaaactgcatttctttttttgaaatttaatttcataacaatttatttaagttagttgccctaataaataaggtgttgcactgcattacagctgactggtggaggagggattgcatactccaaatcttcaaaagcttgccattaaagtactgagcttaacttgtagttcatggggatttgagcgtaattggagtacttttgagcacatacgtcaatattagaagttttaaatatatagagttttcatacaatgattgtgaaactaacttgttttaattataatatagatttacttgaagaagagaagtaggcttgagcatcaaaagattcaagacttggtttatattaaatataaccaagcgcttaagcaacgctttgacactcgtgatgtcatcccattgtccttgatgatattgatggtagtgatgaatggttagtgggagacatgaggagatggcgaggatgctgaagatgatttggattttgattgtgacaacaacttgattgggggagatgttgccaatttagctggtgtgggtgagacttcaacatgcactaggcatcaaataaaactgaggagaggtgctgcaccttcagcagaagaattagaaattgattatgttcaagaggaggaagaggaagaaatctacagctgtaacagtagtgaaaacgataaagacggtgacttggatttagaagatgatgattgatgattcatatctagaaaacttttattttgaatacgtttagacaatttaattatttctaaccttagaggcttaaaccttagtggatagtggttaccaattaccatgacttttgttggtattttcttgtatgttttgtgtaagacacctatgaatttttattgttaattatgaatgtcatgaattttgagtaatttttttatctgttttgagaatttatatggatatacattatataaactgtaaaaaaatccagaatagtgaccacgctgctatagcatttttagaaatagccactatgcgctgttatttgtgattgataacttatggcagtagagaactcgattttacaatttttttaaagaaaaaacagataattttgcttttaaaaggcttcctaattgtaaaaggctttcaatttagtctctatttgtataatatatttcaatgttgttcttgctgtttgttgccacttcatactgagactggtatggatttacgaataagtttacctaggaattgagttgaaaatgattgtcactacaaaaaaatagagtatttctgatccctacattttttatttggttctacactacattgagttatccctccgacagacaatatcatatcaacaacagacagtgattactaaatttaaaggatatgtgtagggactgaattgaaagtttgtcatataagaaccaaattaaaatgagtgtaacatataaggactaaaaatatattatgactcttgttttttggaatacccttatgatattgcttgagaagagaaatcaggtggctaagtgcaatttttttactgtcaaattattaattttactcattgcaggatactatcaaaactgcaggcgcagagatttctggtgaagggatcattgagacatttcataatgatgatgaagcgctggctgctgtggacaacggggttgtggtatgtaatttatttattgtttttttttttttacgcctgtagcttaatgtgctttcttgttatctctgcttgaacaacttcatttggtagaaacaatataaaccacaagaatcaatgcatgttttaattgtttgcttctttgaattgatttatttatggttctagagatgcttcgccttatagtccaaacaaaatatggtaaatcttcactgcttatttcgttggctcttaattctctttgactttggtggttcactttgatgctccctctaaaaaaaggtgtactgtactatttgttttttgaaattgcagtagactttatatcatatgctacaattaaatagtaaaagatacaggcttggtattattttttgaaattgaagactttatgtcaagtgttacacattgagtaatagaagttgcgaacttataaaatttcctggtttgagttataaaagttacaaactcataaaaattacagactttaatttttcaacctgtaacttctattacttactctggaacttcttttattcagtctgtaattttaaaaaaatagaagtagtacagtaaatgtgaactaacctacatgtcttttgtggacttggattagctcaaggttgtagattattgaattgtaattctagagtttctacaaaaatattatgtgatagcttgctatcaagtttttgtaaaagctaatacaaatttgaagtcttataattgcatgcttaccaatttataaaggtatattaatatattgttagataatgtaggatttatttgtttgcttaaattaattctttatgacatctgatggcataggttgtggatctttcacacttcggtcggataagaggtacttgcttttcttaggctattaagagttggtccttgacatatttcaatgttttcttaattttacatgcaaatgttttgcctcacctgaaccaaagtcagtggagaagatcgcattcagttccttcacaaccagagtactgcaaacttcgaatctctacacgaaggacaagtatgtattgaaagaaagtagcattgtttctacatttatatgttattggcaagttcttgtcaattcttttttatatttcatattataatacaggattaagtaattggatctctaactgaaatccttagggatgtgacactgtttttgtaacaccaacagctcgaacaatagatatcgcacatgcatggctcatggtgattttcttttcttatccttctcacaaaattcatttgtttgtcttttctacaatataattaattatcatgcagctgaccactttctcttgttggtttttgatagaaaaatgcgataacattagtggtttcaccagagacctgtacaaccattactgaaatgctgaacaagtaggtagtttcttgttagttgtgatgtaaggatttaccaacagaagtaaaactaaaaggataaagagagaaaccaaatagttttctttcctatgaatattatcaaatacatgaactaaatcttttacatgtaatgattttaaggtacatattttttgctgataaggtagagattcaagacataactaagcaaaccagtttttttgttttggtgggacccaaaagtggccaagtaagttacataattatacctattttgtgttgagaatgacagagttggtaattttcagtataatgaatgggcaggtgatggagaacttgaaccttggtgatcttgtcggaaaaccatatggcacacatctacattttaatgtaagctggatgaaactggcttttttgaagtatgtgttctaattaccagttgtctttttcatcaccggtttctctctacaagatacaactggtcatgtgtatttgatgatgactgcatgggtttatgcctttatttatttattttgtccaaaaacaacttacatgatcaatcatgtcttatttgctagttttaagcttcatgtatttgtttctcactgataactttctttctgtcagaaatgcatattttggttgtttaacgagcatatatttttgtaattgcaacttttgtttttggcaacaagttcccctggattgtggttgcatcttttacataacttcaaaatttagaatgtgttgaaaaggagtgctaacaacatctctcttattggttaaaatttatggaaaactgatagacactggttcagaatttaggaacgaaaagaattattattgctgaagaatgtgtttacagagctgctgtgatgagtattcgaggtactcatgcctcccaattacaatctcgataattcccccccactaccctgtttccgtatctgtatactaacccccccactaactgtctaacaattcagttagttattactaactatattgtgctaattgtccctccttttgtacacctgcccccacctcctaatcctactcctatcaataccccctccttcaagattgaccttgtcctcaaggtctaaatgagggaaaatctttttcatctcttcagccatttcccagctatcctcttcatgtggtaagtcctgccacttaattaggacttcttctctgccatctgctgcagtccttttctgcattattttttccggataaacctgtaattcccattcttcatttaaggccactggtaaagcttgtggagaacaactgggtttgatagccttctttaacaaggatacatgaaatactgggtgtattctgcttccaactggtaactccagctgataagccacctctcctatcctatgcagtacttgatatggtccatagtacctaggacttaatttttcatttagcttcttagctaatgatctcattcgatagggttgcaatttcagaaaaacccaatcaccttcctgcagtactacctccttcctgtgcttgttggcatattttctcatttgatcttgggctttcagtaaattgctcctcaattcttgcaacagctcatctctgtctctgctcaatctgttcacttcttccagctttgaaggactgtctccactcttaattaacaatggtgggtcctgtccatataatgctttaaatggagacatcctggcagatatattgaagttagtgttgaaccaaaattcagcccaagccaattgtttaacccactgtttgggtttggacccagtcaagcaccttagatatgcttccaaacacctattagcaacttcagactgcccatctgtttgtggatgataggcagtactcatttttaactgggttcctacttgtttgaatatttctttccaaaagaggctcataaacagcctatctctgtcagatacaatagattctggaaacccatgaagctttacaacctctctaatgaataagtcagcaacttctttggctgtataaggatgactcaatgcaaagaagtgagcatacttggttaatctgtcaattactaccaagatagtatcctttccttcagcttttggcagccctccaataaaatccatggatatgtcagtccataccctggttggtacaggtaagagttgtaacagaccagctggagatagggtactagctttattcctctgacaaatttcacatcctgccacatattctcttatagttttcttcattcccttccaaaatactacattagcaattcttttaaatgttctaaaaaatccagagtgtcctcccacaacagaatcatgtaaatctttcaacaaaagaggaattctagcagaattttttgacaaaactaatctgccattaaaatatagtttaccgccttttatagcataccctgccttctctgctgtcttagtcaaaattccctgataaattgcctgcaggtctggatcagcctttaattcttcctcccaatctccccattcatcttcttgtactcttgaaatagcatgaaaagcaaactgtctagataaagcatcagccacaatattttctcttcctggcctaaactgaatctcaaagctgtaaccaatcagtttagtggcccacttaaattgatcctcactcaataatctttgttcatttaaaaatttcaaactcctttgatcagttcttataataaattttttccccaaaatgtagtgtctccattttttcactgctagaacgacagccatgagttccctctcatacactgatttctgcttgcttctttctgacagtgccttactccaaaaggctaacggcttatcttcttgtagtaacactgctcctagcccagttcctgaggcatcagtttccaggataaacattttagaaaaatcaggtaccattaataaaggtaactgcttcattgcttccttcagttgaacaaaagccatggtagattccgcattccatttaaaagcatcttttttcagcaatgcattcaaaggctgtgctagcttcccatagcctctcacaaacctcctataatatcctgtcaatcccaagaaacctctcaacccttttacatctttgggaataggccagttagacatggcctctaatttgctgggatcagcttcaaccccctggcctgaaataatgtgacctaaatactctagggattcttggccaaaacaacacttctttttattcaccttcaattcctgctgcagtaacatttgcaatactgctcgtacatgcatattatgatcttctatagactgactatacaccagaatatcatcaaaaaatactaacacaaatctccttaaaaaaggcctgagtacctcgttcataagagcttggaaggtagatggtgcattggttaacccaaagggcataaccaagaattcatagtgtccctcatgagtcctgaaagctgtcttgtgaatgtcctcctccttcatcctgatttggtgatatcctgcccttaaatccagcttggtaaaccacttagctccccctatctcatccagtaattcctcaatgactggtatagggaatttatccaggccctgtgatcttatttaaagctctgtaatctacacaaaaccgccagcttccatctttctttttaactaaaatcacaggactagcaaatggactagtactgggccttataatacccacagacaacatttcccctaccaatctttctatttcatccttctggtaatgagggtacttatagggcctcaaattagggattttatttcctggttgaatgttcacagcatgatccttttctctgctaggtggcaacccctgaggttcttgaaacacttgttcaaattccctcaatgtctgttccatcactttaggaatgtttcctttccgttcttcttgtttcatggatttcaactcaaccacatacccctgatcctcctctttccatgctctttttatcaatttcagactgattgcagcttttatcaattctggatcagccttaagagtcacccttttgtcctgcaccttgacagttaaagtcaacttatcaaagttagcttctaattcacccaatccagccagccactccactcccaacaccacatcagctcctcccaattcaaaaagttagcaatcctggatgatctgcatttcctgtagaactatgggcagagctttacaaactcctttacaccttatcttatgcccatcccctacctccaccgaatatgggcttgtcggggtcacttccaaacccaattcctctaccaattttctggaaatgaagttatgggttgccccacaatcaatcaacacaattaccattttgttttttatgctaccccacagcttcaatgatttcttggtggtaaatccttcaatgctgtgtaatgacagttgatgtaactcatgcttatcttcttcctcctcctctttttcctcctctgtgtcttcctcttcctccattaacatcaccctcaactgcttatttttacaaacatgattgggatgatatttctcctcacatgtaaagcattcccctttcttcatcttctcacttacctctaatggagacaacctcttgaatggccttcttcccttccattcattctcccctcccctgctgcttggcactgcttcaacgggcttactgctgtaaattggcacttctcttgcattcctttgattcgtaaaactgggtctctgcacattgaaccccttgctgtagcctctgtttatgtttcccagcactctattcttctcttccacttgccttgctttattcatagcatccatcaaacatctcggctcatgcaatctcacctcagtgcttatttcctccttcaatcctttgaggaaaatttctattaaaaacgattcttccaatcctttcactgtgcctacacacttctcaaactggctaatgaattcttgcacagttgtctcttgtttcaaggctagcagcaactgaaatgggcttcccagattagccccttggaacctctgaacaattgcaatcttgaacccttcccaagaatggtttgggttccaagattcccaccactgataccaacccagtgcatccccttccattgccatcattactgcctccagtttatcatcctctcgtacacattgcaggcggaaatacctttccattttggaaagccacccaagtgggtcttctcccgtaaagaaaggtaattcaagattccgccacttccctcccccaattccggcgttctccttgttgcgaatcctcgtttcctcctccctagctttcgccgccgccgctggttgctcccagaccgccgcaagcttctgaattgcgtcctccatagatcgtaagcgagtttccatggagtcgcgcgtttcctcgatagcccgctccatcatatccattctcgcctccattcttccgttgtttttctgcaccattaatcaggcccagctccaagatcggagctctgataccagttgatagacactggttcagaatttaggaacgaaaagaattattattgctgaagaatgtgtttacagagctgctgtgatgagtattcgaggtactcatgcctcccaattacaatctcgataattcccccccactaccctgtttccgtatctgtatactaacccccccactaactgtctaacaattcagttagttattactaactatattgtgctaattgtccctccttttgtacacctgcccccacctcctaatcctactcctatcaaaaactaaaacatcatgaatgaacttcattaaataagaagtgaacctgcacaatttttgtgattttcattaaattttagccaagagtagagagtgtattcaaaagagtgtgctagagagtgtattgttagcatttctcatgtgtatatgtgttacttccaaagtagtaaactttcaactgcaataccaaaacctagtaattgttttttccaattgtttattccttttgttgaaagcttaaagacctgtatagtcttttgttattatcgtgaacaaattctctcaaatatatttgtattgtaatttgtaggttgataagcagcctgtaactataggggttggaaacatcatttctgaagatggtttttcattattgatgtctccagcggctgctgcatccatttggaaagctattcttactcaaggagcaatcccaatgggttctaatgcatggaataaattacggattattcgaggtactgaattgtttagattgtgtgcatatttctatgtctgtcattggtttctacagttgaataatatagcatactaacttatttcctgcatattgtttctgtcgtaatttaggaattatttaggagtagtcttggagactaatgatactggcataaataaatctttgttctttttccccaagatccaattttccactaatgaaaattgaggttgcacagttgcacacttgcacactggaattaggaattatgacattacttgaattctcatcatgttattttcaacctaattcttccggtgtatgtaaaaaatgcttcaagcccatgcggacttttggtgcaagaaagaatacaaatgcatttagatgtcaattgtggagtgcacaatttccttctagttaagaatagctagtattaccaatgagggttggaagtaatggaagatagtccccataacgtggtgaactacagtttcagtccctattgggagaggttctcattttgtgtttgatcatatgtcaagcaaatttcttcctatggaggatatttttgtaaaaccaaaaaatgaatgactggtttttataactactagaagatttgtaagcatttaatatttgcctttgggttgaatggtatattctattggataatgaaactgggaagttttttgaaatgcgagtaatttttttttttttttttttgtgtgtatatagtttcactccctatgattcttttatctaatattgatcataacttgatttcttaggaaggcccactcctggaatggagcttacaaatgaattcaatgtcctggaggcctgtctttggaactcggtttctctaaataagggtgtgtaactgttcttttgccgctacccatctgcgtaaaagttgaaacttgctgaataattagtctgactgaatttttcaggttgttacaaaggtcaggagactatatctaggctcataacatatgatggaatcaagcagaggttatggggatttcatctttctgctcctgcagaacctggcagcattattacagttgatgggaaaaaggtgctatataatttcttttgaaaaatgttcactatttttttcttcaatccttatgtatttgttaaaaaggaagatggaaatttgcatagcgtaattcccagttgaaactaaagatgacaggtacgtggtgaaaactccagttacaatgtttctctggagaaccatcttgtaaaaaaaatggataactaatagtggttccctgagtcagtagcctagtgcttgtgatgttgggttgctttctgtaatcctaacattctccttaacgagttggaaagaaattgatggtttttgcaagttttgcaggttggaaagttaaccagctacacatctggaaggaaggaatctgaacactttggattaggttacatcaagaggcgagctgcttcggaaggagacactgtaattgtcggtgacaacatcaagggaacagtggtggaagtaccttttctttcacagcagcgtccaccatctgctagttgagcttcctgtgtggtggcgctttttggtgtgttgttgaagaagcagatgcataatactagtaaattagttaaactgttagtgaaggtgtttttgttatctttatcatgtttgcggcgaattagtacatctgttgtcaatagcaccaatcttggaaaataatacatcttttgcttctgttcttgtcttcttggaggctgcctccttttccagggtactctcgaatgacctttctacagtcctaacagaagaattagaatgaagcagcctgagtccattcaacataggagtctaaataactttcccaatttgtgaccatgtcttcttttttttttttgatgaaatttgtgattatgtcttctaaaccaacggtgtttcgtttcgccaatttggccaattaagactacagcagcagcccttcgacgcgtaatttgttccttttctccaacctgcttctcttcattctttagaaagtggaatgttatcttgtagaattagaaaacaaaattttgctacgttattcttagtatagctttgaaacaaaaaccttgaattaattaagaatatcacgattagtattaggatgaccaatagcttgcttgcttgtctgaataccaattttagaagtcacgtggacccaagtcagttgtcataaacaagagatacacaattatttgttaactaaattaactttgctatcatgacaatagttttatagaatgaaattaatttaattttttttgacgttgttctcttctatatttcttcaattaaatatttattattctataaaaaatttctttgtgacaaatttatatctcagtaaaggttctttatttttaaatttcttaaacgagtttttagaatttaactgagaagacgccgagagagacattaaaaaaaaacttgattcttaactaatgttttatatgttgaaaaaggaagattaacttttcggttcgatgttcaattccattcaaagacacatcaagaacattagcagtgaaatacgacttgttaatttatgaacaacctttttctctttttcttttctctttttatggttatgaacaaccttttatattgttaataaattagtaaatatatatattaagcacgacagcagtgaaatgctgactttctacctaaaaaatacaaaagaaaagcaaagaacgaagggggttgttgtatatccaatccatgggttcttcagctcatgtttgacaaatctaagggatctttcacgtgcagcgtcttggttgaaaactgcatgcgggaaacgtcttggttgaataatttcatctgaaaattactgaatttaaattttaaaaaattatacatacaaaaaattatatttatttaaaattattggatgccttcattcatatatatgtgtgtatatatatatatatatatatatatatatcataattaatgtaatatatagttttaaaatgtcagaatatgaataaattgattaactttttattattttataaagatttggaaaaaacttgatatttaacaaggcttgagactggagcgtatatcttgaacagatattgattcagacttggcaccctctgttgccacaactgtctttttgagatgatgaaacaaatagttagaaatcaaaacaaatcgaaaagtacttaaccaaacaaaagtcaacatacagaagatacagctctatttccatgttttgaaaaaaccgttggcagttgatttcccagcctttgcttttgatgttgcaccctctgaaactgctctaccataagttcctcaagtggtcatccatagaaactcttgaaatttacacactgatgcaaaaacactacccaattcaacaaaataacacagatgtacttttgttttaacaagtttccttttcaaagatgtatatatatatatatatatatatatatatatatatatatatatatcactaggcacaagtatttttcaagcacattggaaaccagaaagatggagttctacagtgtatggcatacctagaatcttaaaaccagtagctagtgtatttaatgcagcattcctagtttccccatcccgttctgcaatcaaacttgcaacaatttgcaacgactttagctgcccactaatctgtccacataatgcaaggagaaaatactgaataataataccaaaaatagtaataatacctccaccatgatgatcaataataaatccaacaagattggcacattcaattcgagttcggttattctctgagcgaaaaccctctaatatataagggaaacatttagatgcagaatatatggcaacaaattgttttgtcagctcccgcattttttctcgtactttctcaatgttatgccctaactgcaacagtaaaataagaaatgcattgtgacttcctcatctgtaacacccaaggaagtacactagtcaaactagtatctacgtaaaccaaaaatttgctgaaatcaaccataccatcagatagattcactggaataacaacatcctcaggtgtcacaaatattaaagttgctaatataaaccttctctactaggcacagaagaaacactgccccttcagattcggtccaagagtacccctcgtccttcaaagtgtcaagcagttcaggaagaaattccggcacctatgcaattaagaaaagataagactctatcaagtaagtatactcctataaattaaattgaataaagttaagactaacaccagacatctccttgaaaaggaaggaaaggaaaagaagaaaactgaaatcacaacaaaaacaaaaataaattgaactttcaatagacatattgtgtttgatttgaagaactgcaacacaaaccacctcagaagactgtccaaaacttgtataacttcctcagcaatggatggaagtgtctgaaatatgcaatagcagtttgtacaagttctagtgcactcaacacttcaaaagaatgtaattcagaaggttaaaagaacaacaccttctgcagaatttcaagtccatcaacttgcttcttaaaatctgcacttaagagtctcctatgtaattcctctctgaaatactttatcattctgaaaattgcaggcacatttattataattcaatacttatagatagttcaagttatgcatgattattcctcaacaaacagccccaccttaagatcttgaatttgctcaatacgtggctcctcaaacttaaaccttcgaaccaccattctctctcgatcttcctgcttgcaagaaaatccagatgacagtccaaccacatatttataagattttaaacaacgtttggtatactccagttcagccaacaataccttatttgaatccttgatatttaacaaggcttgagactgatcctgaaaatatattgattcagacttggcactctctgttgccacaactatcttttgagatgatgaaacaaatagttagaaatcaaaacaaatttaaaagtacttaatcaaagaaacatcaacatacagcagatatagctctatttccatggtttaaaacaccattggcagttgatttgcttttgatgttgcacccacaaactgctctacccgactcaaatgactctaaagaccatagaaaggagtaagggaagatatataagcacaaattcaccaacattcgcaaagaagaatgaaccaaagaacatgccttgaaaagctccttatggttttaacttctcaataattagtgtcggtgctggtccatgaatgtctttaaccatcttttcaatctaaaaataagtaaacaatgaagatgcttgatattacaagaatattaaggaaacaagggaagaaagcagcattcttcttatacacataccatttcatgtctactagctctcagtatctcattaatacaagctctgatgccttgcgaacatcggaagatttatcctaagaagaagtcatcatacattttgttccaagaacatggaacactagacctaattcgataaatggtataaaaaatgaaaaagcagaatgcagagtaaccagatcatactgtcattgcagaagaggcaggcttcagcagttgtgcaccttcagcaaaactacttaacacagaaagttgccccgataaccaataaaaaaatattacgtccttctgcaccaagtttagagtccatcaaagcaattgcaatatatggaacctataggaaaaccatgctaaggacacagataccaggacaaaagaatgaaagaacacagaaccagcacagaatacagaccatttcaaccagatggacagcagccagccaagcatctaatgtattcagcacacattctctcatgtgcttcttgttgtcaccaagacatttcaatatatatcagacagaataccctgcaacaaaccatttccagaaatgttcaaacagcaaaacagcaccaaattggggtgggtggggggggggggagggggggagggttaatacgaaaacagaacagtatcctcttaccttgcttgccttcttcacagcttgacccattgctgatgcaacattgccaattgctgtcaaggaagccatgacaatgtttttgttgctatcaacaagtcgtcccctaagagccccaaacaactcacctggtaataaaacagttaggaacaattatcaaaataatcagctagaaatctagaataactacaaaaagataccatgcaacttatccatttggggaggaagttgatgaaaagggagactaaagagagagcataaggttaaaaaaaatgctaatggagtaccagttccagttgcttgaatgtgcttattagcctcttccaatgacattcatcattaacaacaaaaagtctagacgtcttatacaaaacatacaagtaaataccaacaaacgttaaatacaagcttcctagataggaattatatatcatcaacaatcattttttaaatcaaagccttcttcatcattttcactataattacatctacaaatatgattttaggaaattaaatcccacaaatagccctccaaacaagccctaatgtctctattcagagggattttttggaatcaacacatagcacccactacagacactattcaacccgctatttggttcactgtggacactacactaaactacttcactacagcagcacccgtagcgggcaggggtcactctgctctgctacaccgctatagcattctatttaagaccctgcatagaactaacctcatcaaacataatatacctaaaatggattcatctcatactttgtatccggggcactgaacagtgcaggctttacatcagtaagaagaaaccctttaatgtctgcaaggagaaaaacattagagccttgaaaacaaaattgagagaaatcaaaatttgaaagttaatgcaaagtgaccttgaccaacaaatctatgcagaacacccaagaattaattgatgcatttctagtagcagcattacttgactgcagcccatttctttaagaaaatcaattaagtcctgcaaaataggatttacaataaaccatacaaacttccaacaacaaataaaatatctaaaaaacttgcaaattcagataatgcacattaagctttatatgtgagacaccaaaatcttaaacagcagaaaccatccgcaaaattccctaaccttggggttcttatgctccttcatgatcttgtaaagctacaataaaattctcagtttttcaaacattatttgataatacaaaattcccacgtcaagatcttgaatttactcaatacgtggttcctcaaacttaaaacttcaaaccacaattctctcttgaacttcctgcttccaagaaaatccagatggcagtccaaccacatatttataagattttaagcaacgtttggtgtactccagttcagcctacaataccttatgtgaatccttggtacttaacaaggcttgagactggaccgctatatcttgaacagatattgatcagacttggcaccctttgttgccacttgccacaactctcttatgtgataatgaaacaaataggtagaaatcaaaacaaatctaaaagtacttaaccaaagaaaaatcaacatgcagaagatacagctctatttccatgttttgaaacaccattggcagttgatttcccagcctttgctttcgatgttgcatccactgaaactgttctagctgactcaaatgactctaaagacaaaaaaaaagggagttaagagaagatatgtaagcacaaattcaccaacattcgcgaagaagaatgaaccaaagaacgtgccttgaaaagctccatatggtttcaacttctcaacaattagcgtcagtgctggtccatgaatgtctttaaccatcttttcaatctaaaaataagtaaacaattccaagattattgaaattacaagaatattaaggaaacaagagaagaaagcagcatttttgtcatacacataccgttgcatgtccactaactcccagtatctcattaattcaaacctgaaagagggataggtggtgcccgtggtggggttcaggggaagaatccaacacttctggagcaattaacacgacaagaagggtagaaagaaaaacaatacttccttcttgaaaaacaatactttagaacaagtcaccttggtcattttctttaataatttcctgcaatatatcttatcaatgcaatcaagaactctgccttaaaagatgaatacatattagataaaacctcaccttcaatatcagtccaagcaattgtctaaagagtacgagaaagaagagaaaacataagagaagaaggaagacgcagagaacatgctttctgccatgcatgcatgtcaaaagaaaaaatcagtattctctcatcttcttccctctattagattttttctcttccttcttgaatagaaatcctgaaccataaagcaatgcagaagcctgttttgatgaaagtaggattgtggaagaatcagacacaatagcaatgtatttatagatgaatcaattgaaacgtcgttagaaagaacgaaacggtcatgtcaaagaactaagaaagaatgaataaattgaagcgccgttagaaagaacgaaacggtcatatcagagaactaataaagaaggctaaactaaatgtgatatttattttgataataatgatcattagtggataaaaaaattacaaaattaaatatttttcttacgaaatcatgttaaaattataaaaaaatgattttttttatctaaatgttaacataaatgtagactatacatcataaatcattttataaaataattaaattaaatttatttgataatatatcatattttatatatatatatatatatatatatatatcattatcataatgtaataaaaaaacatgaaaagataaagaataacgataagataacaattcaaatttttaaattaatttgtttaagaaattgacactatcttattcttactagtaaaagaatatcacctagtaagaataagataatttcagttaccttctttagttcatgaatcatatccataatgaattctaattaacaacatattaattgttagaaacgtaaacgtgatattttgataatttacaactttaaaactagctcttgtaaatagaaatgtctttcccatttaaactttttaacactaaaatactaatatagtaattcaaagatttaattggcatttagttttgtaaatattgaaagacataaaataatcaaatcacacaaattgatagtgttggtttcgttgagaggtttagggagaaggaggtaaaggaggcaatatggcaatgtggaagtgctaaaagcctgagtttaaatgaatctaactttaaattcattaaagctttttgacatatattgaaggaggacatcgtgaggtttatggaagaatttcatagattttgtattttttcaagaggctcaaattcatcattcatagctctaattccaaaggttgacgacccacaaggccttggggagtttagacctatcttcctagtaggatgtatgtacaagatcgtgacaaaagtgttacacttgaagaaagtacttaatgatgttattgatcaaaggcaaaagtgccttcttgggcaagagatttattgtacatagtgtgttgtggctattgaggtggtgggagaagctaaaaggaaaaacaaaagttgtttggtcttcaaggtagattatcaaaaagcctatgattcagtgaattgagatttattttatgaataattctgacaactttgggagaaaagattaaaataaataaaaaaatgctaacttattaaaaccaaaaacatatttaaatcttgtaagaaattaagatttttatcaattagtattttcgtaaatgaactactaagtaatcaagaattaaatgtagttcaagatttttccatgaatcatttaattttaatttctcctattcttatctttattgtctttttttacaaatgaagaaggagttattatatgaaataaacatttttcatgaaaaacaaagcttttataaaatgttttgttgcatttgaatcatcctcctagttcacaaaacccatttcattcttacattggttgctaaagtttttcaaaaaagcttttgatcaatttcaaaaaggtttaagagatctcaaaaacataatttaaattctttcttattttcttatgttttttttccctctcttgtatttgcagttgatatgaaagttcaacctcatgagttaagcatgtaatagtatggagaataaagattcaagggacatgattcataggtttcttgaattattttaaaaaaattaagaatataattaaaatacattgacaatttaaaaatttttatattgtcatctattacatataataaaatttacttttgtcataattactaaaaaaatcacatttaataatatttttttagttgataatataaaaatctttaaaataaaaatatatcaaaattaaactataattttaatcaatttcttatacttaatagaatccaatgaggaacaacaactgaaaaagactattaatattgaggagtaaaaaaagaaattcacttgaaaaagagctcgtgtttgattagctaatttgtgaggtaataacttaccaataagatgatctgactcaaaaaaatgatcaaccaaaataatattattacattcctaaattcctttatgatatcttctaaggaatcaaattgatttccaaattaacaggctagtgtgagtttatccatttagttatacacctttaaataaaaaataatttttgaaatgatcacttgccgaaattaggagaagcaacatgtattattgtgggccaatccattgaagagttcagcactcaacttaacattaagaacttttcatcgctggctggagtaaaaaaattcaattaaaaaatatttataagttaaaattcattttttttttctgaaatatatgaacttattttaaaaactctaaatagtttttatggaaaaattttaaatagttaagaaactgacatattataatatataaagtataaacaatataatactacatttttctgaataacttctaatattgttattaatttatcaaaggcgcaaaaaagtatttttttttataaaaaaaatcctttttatttttagtaaccgaaatgtaattatctaaaaaaggtaaccaagatgtaacatgggatcgctgcactaacgtacttagtgcagtcgtcgcctttggtcgtctcttcccaaaaaacctgcgagtcctcgaagtgagaacaaagatcgaaactttcgaagctcctctcacttcctcagctgtcgcacgtgcaaatggggcatcaattctgaacccacattcattctcgctccacaaattcaaatggggtgcctttggagatctcgatgttgggttctcattgtgttggtgttgtcgaatattggttcagccattgctgacactcctcagagacccaagaatgttcaaactgcactccgtgctaagtggtctggaactcccctgcttttggaagctgcgtatgtccttgctcttcctttttcaaacatttttatgtgtttttgtaatgtggggtggtgttatttttagacttgtttctaatgttttgttgaaattgtgttgaagtatacgaatgcgtgtaaaggagtgtgaaatgggaatatcattgtcatttgtttgagttagacatgacataatggactgtagtgtctaaaactagaatttccaactcaaatttagtagtgtgtgggggtcaggtggtggaattttgaagcattatgtgatacttttcctgattgtttttctttctgaagtcttttgtggtcggaagagattgtttagatgacaaaaagatcatcagattattaagtttggcacatggtgctcgtcttatgattcatatagatggatgatatggaaatattcggctgaactgaaaatcatggaatttgatttatctttacatcatgtggttagttatgacttatgaggatgagtgtgaaatacttttgttgtgtcgttccctcttattcttatgtacaacatatattactgttttcaaccgagttaaatgccttgttacttcatatgcagcattcgactgcagcacatattgtcttttacattatcatacactatttttctttttttaaatctgtctacaatttttggccaattgtaaaatttccatgttataacatccatttattgtttggaaacagcgaattattatctaacgaaaaaaaggaccttttctgggtcttcgttgagatttggcttaatactgataacgatgctgttagatctcaaacagctaaagattgtctgaagaaaattttggaatgtgggcgccctcttctaagggaaccattaaaatcattatttgagttctctcttatgctgagatcagcatcccctagactgatgctctaccagcaattagcggaagaatctcttgcatcttttcccctaggtgatgaaaattattcagatgatgagactgaggaaaagttgctaacagaaaagattgaaaggagaaaattagatcccctgcatggtgtaaacctgaaaagccatggaggaaaatgttgttgggtggataccggtgaacacttgtttttggatgtttatgaattactggagtggcttcagggctctgctgagctgtgagtactttgttgccattagtgcacttctgtttgtttgtttgtttatttttttattttatttatttattttttttaaaattttccaatgttgttgtcaattgtaaacttttgccttcagggtaggtgattcatttcagacacctgaaatatttgattttgaccacgtctattatgagttaagtgttggaagtccagttgctatcctttacggtgcacttggaaccaattgttttaaggagtttcatgttgctttagttaaagctgccaaagaggtacattccttaacttgtatttcttgttttggtattaactattaggaatttaggatcttgctaaccaatgccctttaggcatttctaaatgcttctatttacttaaaaagcacatgtaaaatgatttttgtattacccaatataataaaagctctcatttcttataaaaacttttttacttttgtttacttaacagagcgtttgcctaactctttagaaaatataatgtgatgtagtttttggcagctattataatcatttagcattctgctgtacaagcctccaaaatggatttgctttcaagtatcaaatgatgtaaacataatcattttttgataaaaccccaggagatttcaatggagagaagaatgtgaaacaaaaggtgtaaaactgataagagtaatgtaaattatttgaattgcacctgaattatgagatgtccatcttctgtgttataaaatatcccagatattatatatctcttcaagtgaagtttagattaatatgttagttgtatgcaacactaatgttttttgaagatatggtaatagtcaaggagttgtgaaacgatgaaatcattaaacagatttatattgttgtcccatatattaagattggaatttgaaaaaaaaatgtaatgcttatctaatatatttcccatgcaactatattaatatgttgactgaataatttttaggggaaagttaagtatgttgtacggccagtgttgcctgctggatgtgaatcaaatatcaatcattgtagttctgttggtgctggtgaatcagtgaacttgggtggttatggtgtggaacttgcactgaagaatatggaatataaggccatggatgacagtacagtaaaaaaaggttagaatgattgacacatgttgagtgaaggcttctagttctctttaactttgcatactgagtcaattgtagaagaaagttagtacatgaaattgtgattgcctgatcatcctttccaattttttactctttgtaatttttgtaatttttaaaatgtcatatttttcgagaaattataaaagtattctttctttaattttctttgacttcatgacctccatgcttgcattgctattcctaggatttgacaattttattaatccttgttaggaaccaattgcaaggtatggggcaattggatcctaacaatactctttatgtaagttttctttgaacttgcattttttttttttacgatgtcaattttagatttggactaagaaacctgtgacatgcttgagtgattagcactagcagagttaatacacacacttttgaattaattaattgcatattacatttacaagaagaataagcacaagtgcaactacctaagtacttgaattaaagcaccttgcatgaatctaaaatttcatgaatctaagctttaaattcagctattcccaatagatttgttgcagtttccaacaatgtcctttcattcattttgcatggtaatatgtactattctcaaggtctaattctgctatttaaagaagttttccttaccctttatggtctttctatctggttacttgagttagttagcattgaccttctccaaccttacctcaatgcattgatttataagtttatcgttcgttaaagactctccatcttgttttcctacaatgagtttcaggtttgaagattttattaattataactttgaaatagataattgaaaagtacatttcttagtgttaaattatttctggattcacaaattcttttggtgttttgtatattgctaatccaattaaaatggttggatatttatatacatcaagaaagattacttgtgattaaatgattgattctctcattaacacagttgaggattgcaggtgtgactttagaggatcctcgaactgaagatcttagccaggaagtcagaggattcatattctctaaacttctggtgtgtaaactcacatttgtttttggacacacacatgataatgagaattttgtaattttcaataaatttcaaccaataatagaagatgtgtgttagagattgtgttgctagcatttctttttttttttttttttataaaagagtgttaaatgtgataatattatgtgctttgcgagatataatgtaaagttgtgtccatttgccttctcactgccttgcagcttgatatatttactgtaggatattatttaatgccttttagtcgattaatatgaaaggttttggcaggatgaaggaagctaagatcctttggcattgcccactttttgcatacttgtggtgttatgaacagaaaagagtgcatagttttgaatcagaaatttatttcctagtctcttttgtgggattagatttttttttctgcttccatatggttgtcaactcattatttgctttggttaatttcataacattataaaagtatattaatatttatagtgaagtatatttattgccccacctcaaaattatccagacactagtgttaccaataaatttacctgtttttgtttactcacaggaacgtaaacctgacttaacatctgaggtcatggcttttcgggattatctattgtcatcaactgtatcagacacacttgatgtttgggaattaaagggtatttaaaatatttttctcttttcctctgataattggaaagattggaagctgaatcctatcgcagttggcttcaatgaacagtgttctatgttttttccccttctttctgatggtaacagatctaggacatcaaactgtacagagaattgtccgtgcttctgatcctctgcagtcaatgcaggaaatcaatcaaaacttccctagcatagtttcttccttgtctcgcatgaaggtacataatcttgttaattgttatttatgttaggcactcacatatttttagacattttccttggaaaaaaatgtctattattcttacggaactgcttctcatgacagcttgatgattctgttcgagatgaaataatggcaaaccagcggatggtcccacctggcaagtctttaatggctctcaatggtgctttagtcaatgtcgaagatgttgacctctatctgtaataactttttttcctactgataatttatacattatcttgtcgtattcatgtttgtgcctctattatagctagagttagtatttttcaatcccctccagcacattaagactttgctgtctcatatttatggttcttttgatgttagttagcacttagcacaagattggaagagccaaacccaggtctatttatatacctatggtttggttttgtgtttatttgagttgagcctattcaaagtatcttacttatcgtatggaattcctttttttatgttggattaaagtcatttcctatatataattgtaaatgctttgtcaactaattgttattattgtttgggagaattgtttttaggttctaagaatgtaaatatttagcagtggtttgatcctggtttggcagtgctgaaatttttgaatttctgatactattttcctgttattctttattaggttgattgacttgatccgtcaggatctcttgttgactgatcagttctcaaaattgaaggtgaatgccatctaattttcattttgtcatatttttactattgcactaatttctgtttaactattcactgacctagtaattgacagatgaaaaatagtcatctgatgcatattacctaagaaaatgttgttttcaaaagtaacattggatagtctcctaagaaaacaatttgtattgaaaggagggaagatgagtgggaggtgaagaagttaatggtattttttccatagaaaaaatggcacgattacctgtttggattaagaaaatgttttggttttcatttcctattttcataaataattaccaaggtgggattttgtaattatttatggaaacataaattttttctcaaactggacaagcccttaattttttaaacttctattaattgctaccatttttttctctttataaaactcatttgtgatatgtacatacacctgaactgtattgttgatattctcactatttgcagattcctcaagccactttgaagaaattgctctcaacttcacctcctccagagtccagtatatttcgagttgattttcattctagtcatgttcattatctcaacaacttggaagaagatgctaaatataaatggtggagtaacaatttagaagaggtgaattagtgtgtttggattagctttatttttttaattaaaaaatataaaaatcaaagtgttcaagagatttttctgactgaagtactgtttgtgtaaagatttagcctaacctaacatattttacatttattttgcttagttcttgatgccagccttccctgggcagctacgttacatccgtaaaaaccttttccatgctgtctttgttcttgatccagcaacccgttgtggtctggaggcaagttttttttcctcaagcttaacattttcacattattcattgtatatgtttccaagcaaaatcttagtcacttgctttattgtttggaattttgcagtccattgatatgatcatatcattgtatgaaaataattttcctgtgaggtttgggattgtgttgtattcttcgatgtttgttacacagttagaaaatcatgctacaaaagagcacagcgatggagatatttcaactacggtaatttttaccttttgttgttcaggaatgtgtgtgtgataaatgtcatagaaatttttctatatgttatagtttcactggcaagtttatgacatcattttttttctcttttcagattatatgtctcttcagttatatcaacgagaattatggtgctgaaatggcttaccggtttttgagcaatgtatgagtgtgatacttagtcattagtgtcatcttcagttcaatgtctttccatgaacttacttacgtctggtttaaaagttaaaacttcatatgccagaagcacatgacttaaatccaaaattaggaaagaaaagtggcagatgcagttaatattgttatgttgttctttcattttactccacccatcttgaacctaactacatatctatttgatatcattaaagttcaaaatttgaaccttccaagttgcttgatttgacttaactttgaattttcaaccttatgactcactaatctttttttctttttaaattttccccttgtctatcactatgcaaatttctagataatcactttcctatgaattcaattatttattttaaaaaaaatcatgaacctagtgcgtaacatttgacaaccttttaagtggcttcatctcttccccattaacatgacaaaaaagggaaaaataaatctgaaaggtttgtttagaggtttttatttatattgataaaaataaaaatgtttatgctgttggaattagcatacacaaatagatgatgctattatatctaagatttttatgaaacacattttagcagttgttttgagactttaaaactaatcttattttcaattcaattaaaggaactatattgtacatttttgtaggttaacaaattacacatcgagtcagatggcaatgcatatgatgctcttgaactgcaccatgttgaaggagtgtttgtggaaacaatattgtaagttttatagtactttttgttgattagtatccttctgacatttgactaatgtagtgcttcaatattttagcagtaacattacgttctaatttattttaaacatgaattaaatattctctgtatttctatagatcaaaggtaaagtccccacctcaagagatattactaaagctgtataagaatcaaaagttgaaggaattgtcacaagaaagctccaagtttgtatttaagcttggtttgtctaagcttcaatgttcattgttgatgaatggccttgttattgatcccactgaggtaatgatttttttaacattttccactgccttaaaattttatttcctctttttttttgtactttttcttcaattctgctgtcaattcacaatattttatattgtacaaggtggttggccaagatataagtgttgagagaaagagaaaatgaaaaatgtgatgaattgctgtgtattaaagagcaaattatatatacagagtgtaataagtaccgtacaaggatttatagttacatgattactgtaattacgtgatatcactaattacataatcgacctataattactctgtttacattaattctgatagaattcagagaaagagaaaaaagatttgtgcaactgaaagtaaactgtattattgattcttgttgtaagatttactgttgtgtgttgtcatattggaccacaagaaatactcttatttataatgaaggaggtttacaaaataaggaaacaaaataatgagtaataatggaaataatcccatactaaactgctctaattaaaacatatcagatatttttgacactttccctcgagctggagcatatatatcatatgaaccaagcttgttacaaatgtggcaaacccaacagaaacaaaagacgattccgatcatggggttgtgcagaataaacctcggcggcaaccaacgaaagcctgtagtggcgatgggtattgttcacctttgaaaatagcatgccctgaggcagaaggatgcggttccagtgtgacacgtcacatgttatgtgcttgaacttttctcgctggaaaagggccctgcgtggggttgctgtggcggtgtgttgagttggttgcacatgtggacagcctggtggtaggtgtcatgggtagctggcatgtgatgcacacacgctggagagtggtggtgtgtgcgtcgttgaacggcgacatgacagggtgcacgctggtcgccgggaggtggagactccgggggtatggttgcgtcggagatagaaggcacgatgactgccaatagagggttgcagcagcttgcggtactgttcatgcgagaacgaaggcacactgcagtgataatggaaccaaaactgtttggcgtgtagaagaaaggagaaagggtcatcaaaagaagggcagtgagcataaaggtccaccgatgacagtaggtccccgatggagaacgactttcattatttctttgtcaataataacctgctctgataccatgtaagaattatttactgttgtgttgtcgtatcagaccacaggaaatactcttatttataatgaaggaggtttacaaaataagaaaacaaaataatgagtaataatggaaatcatctcatactaaactgctgtagttaaaacatataatctttgacacttgaaaaaatcagttacaactgatagaagctgactatgggctagctgataagcttggcccagaccactaactgaagcccaaaacagaaaaagaaaattacagtgcaagcatgagaggtgatctctaatactactttctgtaataatacctaacagtaatattgtggtcttctttgtaaaatgagttctttctctttgttttttatatgtgctttttcttaatgctggcaacccaaaacaaaataaaataaatagcactggatacactttatgtagtaaaatgcagatgagtctcttacaatgcactaataaactcacagctatctataaatttgtaagatccccttcatatacttatcattgtttgactacttgcacttatccatactgttgtagttttccttagtgtgttgtttaattttggatattctgcatgtgctcaactttagtttaaggtgagttgtgcccaatttttctttgtctagtataactgtgatgtattaatagtgttagtagaatagatttttcctctacttatttctatgcaattgtgtttaccaggaagctcttataaatgccttgaatgatgagactccaagaatacaggaacaagtatattttggacaaataatgtctgacactgatgtattagctaagtttctatcagaagctggtatacaacgttataatcctaaggtatagtagttaaataatttaataatttaaattttgggaacatttatagtgatactcattaaccagtttctaatgctaatcgtttggtatagattatttctgacagcaaaccaaggttcatatctctgtcaatgtttacttttggggaggaatctgtactaaatgacattgtctacttgcattctcctggaagtaagttgtttaaatattagaatctttaatttcttttgtacagtctgtttcttttgttgtcacatgtgaattgttttgatccaaaccagcaatggatgatacgaaggctgtgacacatcttcttgctgttgatatcacttcaaggaatgggatgaaattacttcaacaaggcatacattatctggttaataccaatatgcatttcttttaaatcttcttggttctttttaaattattgtgcctaatgcctattatgagttggagcaatttatttgatgcttttaagcatatttgatgtttttgttatttgaacataatgctacagatagaaggatccaaaaatgctcgtgtaggtcttctatttaatgccaatcggaatcctaatttgtttagcctcctatttgttaaggtctttgaaatcactgcatccttgtataggtatgtgtttggattttgcttttaattcaaaagctggttaaattttaattgattgtttaatttcaattctgtgattttgtcaattcctttccaaagtggaagcaccatttttatatcaaatgtttgaatgcatggtgtgcagtcataagacgaatgtattggacttcttggatcagctttgctcactgtatgagaagaattacatccttacacctcctatggaagctgaaagcactcaagcatttgttgatattgtttgcgagcttggtgaagccaatgggttaccatctaagggctataggtctgccctcctagaatttcctgccggtgaagtgagaaagcatttgactaaggtacttctagtttatcttgccatttggacatttgcttttagttcttaacaacccaaccctgtgcctcatacttttactttttctatttgatactaatacctgaaggaaatggtttcctgctgctttttttttccatttctgcttctcttttatgtatttcattttagtttgcactatgttaaacaatttcagagtttttcactaatatttttttgtctgttaattgtgataatttgtattaattagacgtcttgttatcaggtgcagaattctttgtatagggtgcttgggcttgaatctggtgtcaatgctgtcttcactaatggaagggtaatattgttttggtgtcttcagctatttcatagtataactgatttctgatgaataattgttttcattgcttgtttacaaatataattttgctcttctctctcaaaatttgctgatgaattttcaccaatccttaaatttccttattaatcttgtgttctttccttaatatctatctttaataggtaacttatccaattgacgaaagcacatttttgagtgctgatctgcatcttctggaatcaatagaatttaaacaaaggacaaagcacattgtggaaattattgaaaaggtggaatggcatgatgtttaccccgccatgctaacaaggtttcttgaacttttctgtctctgtttgactcactttaatttttgtttgatttctctatggatcattacatatatcaccttcctatgacatgctttcttttaactaaaaaatgttggagggagggtctggaaaaccaaagcctaaaagtgaggtgttacatgacatttttggcacaacgcaagtgcacagatcatacaaagaataaagtgatgagataatcataagtattgtttcccaatgattgattgagaaaccatgctagctatagaccaatttctgcagaatttatattcaagcaaatgaatatgggaatcagttgaatagaaagtaagtttagaaacaagaaattaaagaattaaaaagtgcataggtgataggtcacatgaagcatgttgggaatcagaatataatgttctgaattcattgtaataattgtagtttataggcatataatctctgatttataggaaactgaatatcctctatttatgtgcaatgaatactataagcctatataaactctcatccatggtgtattcagacacacggtttcagttcaatatgcctatgattttcttttcttttaaaatagcaaactcccatactgtgtcttatgtgctgtgcaagctcatctattgttacatttttctgctactactgatttgttgagttcttgagaatttttggagaatgttgggtgtgccataagtcctctgatttatagtaacttaaacagattttttgttcaatcacgtctgtttactgaatatttaacaattctttaatgttgccctatgttgtttgcagcaaattcattagtgatattgtcatggccttatcatcttcaatggccatgcgggagcggaattctgaaagtgctcgttttgagattctgaatgatcagcataggttatttttattagttacaatgcactcaaacatttttttccttatgatttagtcatttttggattgctcatttatatgtattatatgatgtcagtatttctttttccatcatttatctgtgcagtgtcattattctaaataatgtaaattcaagtattcatattgatgcggttcttgatcctttaagtccaaccagccagaggttgtctggaattcttcgagttttgtggaaatacattcagcccagcatgagaattgtactgaatccagtggttggttcaaatctatctattgttctgcaaacatatataattatataataattttttttctgcaactgaaattgttccttcaataagattctttttaggcatttggaataaaaaagaagatggaaaaaaattgtttctctctcattgtgattggatgagacaagccaaagtgttgcccttgtgttgtggaactgtgaattttcccctaatttggctttcataaggccttctgttattcagtcttatgtttaggccttttatgccgataaaaaaaaaatgtttaggccttttatttttgacacagaatatatgattacaaagaatcaggaggttaaaatccttcttaaaataaaaaggaaatacagacaacagagaacaaagaaagaaaatctatccaatccctcaactgagttgtaaatgaaacttagtataaaaaaccatgtcggctttacaccaagtaaaaaccaattgtctgatcttatcttatcccaaagtagctgcttatccaaaggaactccttgatgcaatagttacacttaaaccaaatgtgcatgtattagtccattcacattatgatcaataggcttgtaggagttaattcatctatccctcatctgttctactctaaatagtttttagcttgtaacctgccaagagccaactctcccaaatgcttaactgtttaggtgaaggctcttgattagtttgatatccattgcactccctcttgcaagatccattaatgtgaaggcccgatctatcttgtatcgaaatttagcctttatttagaagaatggagcaacaaggattgaactcctgatttctagtgatagtcttatgcgagattttctacaagatatatttcttttaattttcgtccagcaaaatgtgttgccaagttctttatacatttgctaatttgtattgaatgctgtttttcatcttatgacagagttctcttgctgatcttcctctgaagagctactacagatatgtggtaccaacaatggtatatcttatttatttaactcttaattctctaagataattccagacatgatatttgatgctaggtctcacagggtttctgatttttgcaggatgattttagcaacactgactctgcaataaatggcccacaagcactctttgcaaacatgccattgtctaagactctcaccatgaatcttgatgttcctgagtcttggcttgttgagcccgttattgcattgtatgtattattttagaatttgttaatatactgattcttttatcaattttttgtttgaatgtaactggagacgagtaaattattgtgaataaattacactggtcttcctcatttaaaatttatagtaaccgtaacctattccattaagtagctgttagactcattaaaccattctaatgtcaatgtttatgttagtccaaatgtacccttgtctttgttaataaagaagcatgttataaagttgaattaatagcgtaaaaatggggtgaacatttaaaaagaataaagtttttggcatctaaatttgaatgaatctcataattagtgacacacaccaactctggtagataaataatcaacttaaattgttgaattaaattataaactctgaatgctttgtatttttctgtcatcctttgatatttcgggaatgggggaaataaatatgatttttccatgccttgagggaggtctatgtaatacatttctgagtttttatatgtaatgactactttttgtgaattttaatagtccttagtaatatctctcatgctgcagccatgacctggataacattcttcttgagaaccttggtgacacaaggacattgcaagcagtttttgagcttgaagctcttgtcctcactggtaagattgcatcttgtttattagaaatacaagctgttagtgatattattaaataatcattgctacttgttagaatgctaggccacatctatttgtgtagtagtctagttcattagcataattaacgcttttttaagaaaaaaagttatataagaaatttttcttttagaggccctctttaaaaaaaagaaaaaagaacagccacgaaatgacaacaacaaaaaaatgaagcaaagtttcccaaccttaacattcctgtaattgacaccacttttaaaagtccctacaactactacaattcaaatgcctaatcttatcccaaagaatatgcttgtccaaagggatcccttaaaaacaaaaataatgctcctgcataatcatcaaagtgtagcatagattgcacattaccataaaaatttggcttctttacttctaccataacaattaaagctagtcaacaaaatctaatccatggacctagggcacacccaacacactgaaatgtgaaacaaacaatttcatgaagaaacagatgcagaacaatttaagaacaaagaaaatggggaacctactctgctcattacacagtaagggaaaatgaatatagccatttgtagcctgtgaaccagcagcatgtcactggttaaatttctattaaacacttctgtgcaattaggatgtttaatatgtgtagttatgtctataacattagcttctgttttctccttgttagcttacaattatgaaacacaacaacaacaaagctttttcccactaggtgagattggctaaagggatcatacgaggccataaattactgtcatatgtttaactgtaaatatgggattggtctccttctacctctaactaatgaaatatgttccatctggttaaacatctttattggtgtttctaccagtattcactaaacatacccaaaccaactaatagaggctctatcaactttcctaaaatctctctaattattatattcctaattctgtcatctcttctatgttaacaatcattaatgagcactgtgtactaatctattgtcactcttgtcaaatctaatcaggtcactgttctgagaaagatcacgatcctcctcggggacttcagctgatccttgggacaaagactactccccatttagttgatacccttgtgatggccaacctgggatattggcaaatgaaagtctcacctggagtttggtacttgcagcttgctcctggaagaagttccgagctttacattttaaaggaagatggtgaaggaagttacgataaacaatcatcaaaactcattactattaatgatttacggggtaaaatatttcatatggaagtagtgaaaaaaaagggcaaggagcatgaggaattacttcttcctgatgacaatgcacaagatgagaagaaagtgagtgctttctattaaaaattgttctttaaaaacatgttttgaagcataaaatgataaacattattatttaaaggctaaagccagtgcaatccataacagatatcttcatgatatttttatagggaagtggcttgaattccaacttcttaaaatgggcttctggtttcattggcggcaacaaattatctaaaaaggctgaaaaaagttcgcaagtatgtcttttatttacttgtccgttagttttctgtcagaatttctgtctcgaatgctttcccttcattctgctgttcatccataaataatacagatttattgtcattaaagacgcatttcagccattaagacacaatgattctatttcctaatttatacaacctaaatcaggaaagctaataatatactggaaacaacataataacagaatcccttattgacatcccccctcaaattgatgcggctaatctagaagcatcaatttgctgctaagaaactgatgtcgaggacgaggtacaaccttggtgaggatatccacaagctgaagttgcggcgtgacatgaggaagagatataacatgagcgtccaatacttctcgaatagaatggcaatcaacgtcaatatgtttcgtgcgctcatgaaaaactggattagtagctatctgaatggcactagtattgtcagcatagagaggtgtggctgcaatttgagggaagcctatctcatctaagagtccacgaagccaaatgatttcagaacaagccattgacatagctcgatactctgatccaatggaggacttcgatagacatgattgctttttactcttccaagagattagcgcaggaccaagaaacatgcgccaacctgtgacagatcttggtgtatcagggcaaccggcccaatctgcatcactgtaggcaaccaaactaggagacttcccagtaggaaaaaataaaccacgagttgaagtgccttttaagtaacgaatgatggggcgaacaacggccaaatgaagatgacatggggaatgcataaattggctcacctgctggactgcaaatgaaatgtccaggaatgttatcgtcaaataattaagacttcccaccagctgacgatataataaaggatccgacaaaagatctccttcatcacgatgatatttaacattaacctctaggggagtatcaattggagtggctgaagcaagaccagccaaagaaattaagtcgtttgtatacttgtgctggtgaagaaagatacctctagaatcagtataaacttcaaggcccaagaaatacttaaggcaaccaagatctttcatattaaaggaggctttgagttactgcttaagacgttgaatgtcggcatgatcataaccagtaattatcatatcattgacataaataagaacaattccaatatttgtgcgatgaatgaataaggaggagtcataccggctctgagtaaaagaaaatcaaaggagagtagagtcaaacttttcaaaccatgctcgaggagcttgtcacaagccatagagagaacaattgagcttgcacacaccagcagacgaggaaaataggcctggaggaggagtcatgtaaatatcccctgccaaatcaccatgaataaaggcgttcttcacatccatttgagtcagtgaccatccctgagaggcagcaatagaaagaatggttcgaatagacgtcgtctttgcaacgggtgcaaacgtctcatcataatccaacccgtatttctgtttgttacccagtgcaaccaatcaagccttgaaacgattaacagtgccatcagaattcagcttcactgaatagacccatttgcaaccaatgggcttaacactaggggtttgaggaacaatgtcccatgtgaaattttcttggagggcagcgagttcttcgtctattgccttgacccaataagcatctttaatggcctgtgaataacatgtaggaacagatgtgccagatagagtagctgtaagagaaataggcccaaattcatgcctatctggggcacgagacacctgagacgagcattgcagtagagcaggcacaggtggcagatcagcagccgaaagggacaaagaaggctgacatctaacataaacatgacctggtttgaaacgttctatagaatgagaaatatcagaaaaattagggaggttaacaatatcattagatgaagacttaaaacatgggaagaaaatttaatagtcaaagaaaaccactttcctagagaaatgaaagtgatgagaggtggcatcataacataacacaagaatcctttgtgagtggtactataacctaagaacacacatgattgattgggccccaagcttatgacgtttaggaggtggaagtggacaaaaaaaacacaaccaaaggggtgaagatcaatataatccggatgaacttgaaagaggcgaaagaaaggagaatcaaactcgagaacttgggaaggaaaatgatttatcagaaagacagctgttgacagagtctcaacccaaaaattggctgggacagatgctgcaagaaataatcagcgtctgacatcaagcaaattttgactttttcgttctgcaatgccattttgctgaggtgtataaggacaagaacgctgagaaatgatgcctttttgttgtaggtattcttgaaaggcatgagacatgtactccccaccagagtcagtgcgcaaaatcttaatgcttgtctgaaactggttctcaatataagcaaaaaaattcttaaacataggaaaaacttcatctttagaacaaaggaagtaaatccaagtaaaacgactatagtcattaatatacataacaaagtatttatacttagaatgcaacaagacaggagacacaccccacacatcagtgtgtataattgtaaaacatttgttagcacgagtagcattatgggaaaatgggagatttttgcttttggcaagtttgcacactaaacacgtaaaggatgagtcagaaacaagagttttattgcccaacagaccattctctattaaatgagacaaaacaactgactttggatgtcctagtttattatgccaatcctcgaatgaggacgggacagtagtacaagaaaatgaggaaaaactaggagaagtaaactggactggaaacaatctgcctactttaggtcccttcttgatcactttccccgacacctgatcctgcacaaaactagtctgggagaaattaacattacaattattatccaccaattgcccaaccgaaattaaattagaagcaagttccagtgacacaaatacatctcagaagacagaattaatgtcaccaacagctgaaataaaaccaattggcactaagtaaagctgctcaacaaatatataagctgcaccccgagaattaaggcagacgatgtaagacttcctaacattttccacccgtctattttacaaaaatcatcatttattatatttccttgaaaaccttattagtttttggtacattaagttaatgttatatgaaaagattttatcagattgatgttgcttttaggctttgaagctttaattgatgtaatgatttggcatttttacattggaatgcacaaaatctccgttcaacgtggtttcaacgtgtatccaaacacaccctaacagattgaaccttattaagtgtttaccctgtgctttgtccttccatttttatctttgtgtcatcatttccaaagttgtaacagattgaacctttttcccatataggagaaaggaaggggtggacggcatggaaaaactattaatatcttttctattgcttctgggcacctgtaagtggttcgcttattataagttgttacaattttcctttcttgtttttccttttagttttgccttttaacatatgtttgttcaagtttggtcctttatttcgaaatttaaacagtgattactatatgtgatgtatcatgttggaaaaattgtcttgtacagcagaaaatatcatttattgatgttttatgcttcttcatggaatggggtcaatcatgtatgttgattcagatttcgtggaatgggatttggggttccattgcagaatacaatttcagtttcaagtgcctgtaattaataggaaatttagggacgttaatttcttgtgcaagttttactaagcacaatctttcaaacaaatgttatacacttccaaatgcatggtaactattaaactccatacttggattctataatattttttcatatttagttgagcctggtggtattttatttgtcatcagggatgcaatcttcactttgtgcttcttgtcaatttgccagatatgaacgctttatgaagattatgattctaagtgttctaaagaatactcatcgtccagttaaattctggttcataaagaactacctctctcctccttttaaggttatatatccacccaaattatatatgcttacattttaattcatttgtatattggaatgtaaagtagaatgatgagtttgcctgacatcctgaaccattttggttgacttaacatacaggacttaattccacacatggccctagaatatggttttaaatatgaactagtcacgtacaagtggcccacatggttgcataagcagaaagaaaagcagcgaataatttgggcatataaaatcttattcctagatgtcattttccccctttctttggagaaggtatcatggtttcttcttctgcatcaagttccatgcttttggtttttgtcttttgtacaattaatttcaatgtcacactacacaattcttaggatgttggtttgagcctaactcaaccccaaaaactagctcatagggtgaaggttgcctctcacttgtatattctatcttgggtttatctctatccaatgtgggacttgggtttttcccaataacaatgttatgacaaagataatgaagaatgaaaatcccttacaaggtaatctgtctaaaatctaccaatatatgcaggtcatttttgtggatgctgatcaagttgttagggcagacatgggagtactctatgacatggatataagaggaaaacccctggcatataccccattttgtgataataataaggagatggatggatataggttttggagacaggtaaatgtcactgtcgaaattctaattattgttcaattccaatctatatgatactcttggttttcattacgcccgtgtaattttaatgcagtattggctataaatatttgttaaccttttttccctgtgtcatagggtttctggaatgatcatttgcgggggaaaccataccatattaggttagtagctacttttatattctattgccaaatataatttcaatgcttactgtttcaatttcggttttcagtgctttatatgttgttgatctgaagaagttccgagagactgcagctggagataatcttagagttatttatgaaacactaagcagggatccaaatagtctagccaacttggatcaggtaagaggtttaagttaatagttccttttacctgcaaatgaatccttacttaagagagcgtgttgttaagcaagtttgactggtttttgtagtcccaatataacatgaaaacccagtgcattataaatgactgctttatatcaaaacttgtggaatatgcaacaacaatgagttgaagttttcaagaatatagatagactcctttctcgaggatctaaaattgtgtcccaattctataggaagattttaggaggtatttgtctttcactcagacaaaatgatgagttgggtattgatactcatgaccattatgatcataataaagcctctctcccttagaaatgtcgtgagtagcaaccacaaaaaaaaaaaaaaaaccttgcattcaccatcaacattgtatctcacacatttacagttctgcttcttcctaccttcccgtgtatgattgtttatgccactcataaagggagcgatgagtgatgtttccacgtttatcagcacagctaacaacactttgagaactttctgctctaagaatggacataatactgtcacaatcatcacgttcctggttgtcaaggtaatccacatcgccaatgtattcagcaataattgtcatatccttgattaggtcatcagcctcaacagtataactttcacacgaatcataaacaaccataaagggagggaattcacctcttttagacatagcaatgcagtgttctatggtctccatgtcttccttggaaagaatcttcatgccaccgttttttagtgtggcttgattcacagatctaggagcctttccaggcaagcatttgaggtgatcactgaattccatatttaatgctgttaaagcagaagcatggtctgggcaggatcttttgtaggaacaaatggtaacaatctcctctgtttcttatgtaatatcagaggtcgtgaatttttccaacacttggcatcctgagaaggacgcttgtcattaccatcaccagaactccctccaaatcccgaagaaatcaattcttcttttgggagaaagttctcaaagtcttgttatatgagctgataaacgtggaaacatcgctcactttatcagtggcattaacaatcgtacacaggaaggtaggaagaagcagaagtgtggatgtgtgagatacaatgttgatggtaaatgcaaggttttttttggttgctacttgttagatttgagagagtttaaagatagagaaatcatagaggaaattgtattattgagaaaaattcaaatcaacctgtatacacccccttatttatagattttaatacaaagcagctaagtctaactgtggaatattctagaatattagaattagttgtagaatattctagagtattggaattagatgtggaatattctagagtattataattagttgtgaaatattctagagtattagaattagttgtggaatattctagagtattagaataagttgtggaatattctagaatattagacatagttgtatataatgaaccctttgggtttcaatctgaaaaaatgaaaaagtgtgttcattacttatattccaacatggtatcaagagcagatttccctattatcgttctgcaactctgaaacccatttttttgaaaaaccttaagtcatctctctctgtcatttcccataaacactatctagtcacctccaattgcatttgttcctgtccttcacagtaacttatggattcttcttcttcatccggcatttcttctagtgcctctcctaattctgatggtgtttttatctctaaggcggagtatgagcaatttcagaaagtgatgcctcaatctgctgaagcaactagtcatgttgctcaacaaggtacgacattccatgctgatcgtagtaatcgttggattcttgattcaggggcttctgatcatatgacaggtaatgcaaccttgttttgttcttataccccttactatcaactgtcacgaataagaacggccgatggcaacttctttactattgctggaaagggatccattaaaatttctgaacacattactttgaactcagtccttcatgttccctctcttacttgtaacctcatttctataagcaaacttacatctgagttaaattgcgttgttaaattctctgtccatgcttgtgattttcatgaacaagactcgaggctgaagattggcagtgctagagaggaagaagggctttactattttgaaaaggatcctaatgaaacaaaagtttttgcacaccactcattatctttgactgatgattgtaatgatgttttgttgtggcatcgtcggttaggacacccaaatttcttttatcttcagaagttgttcccaaacttatttatcaataaaaaacccagttcttttttttgtgatatttgtcagtttgcaaagcattctcgtgtttcttatcctcctagagttcatcatgagttttctccatttaccttgattcatagggatatatggggcccaccccgtgagaaaaatatctccggtgctcgttggtttattacttttattgatgatcattctagggtatgttgggtatatcttttaaaggataagtcagatgctgcatccacctttaaaaactttcatgctatgattcaaactcagttccagacctttatcaaaattcttcgaactgacaatggtactaaatattttaattctgttcttggagactatctcacccaacatggtattctccaccaaaattcttgtcctaacacccctcaacaaaatggggtggctgaaagaaaaaatagacatcttcttgaagttgctcaagctcttttgtttaccatgcatgtccctaaacatctatggggggaagctgtcttgcatgcatcatatctcatcaatcggatgccttctcgtgtcctaaattttcattcccctttatcttgtcttaccgacgcctttccttttttccgaaatcctcttcccttcctctcaagttgtttggctgtgtggcttttgtacatattcctccccatcaaaggtccaagctcgatcctaagtctattcgatgtgtcttcataggatatcctcctaaccaaaagggttacaaatgttactcaccttctctccgtaaggtctttgtttctatggatgtcacattttatgagacacaatcctttttttcttcgacttctcttcaaggggagtctattggggtagatgaagataaatcttggaaaccaaatgagtctgttgttctacctttgcctttggagacagggggagttattgagcatgagatagggcgagctactgtgccaaaaactggagatcctcctggtaaatggggaaaaatttacagcaggtgaaaaacacttcaaaagcctctagactgccaagattctgactcgagtcctaattccaacaacccaatacctaaatacactgatgcagccgacctaaatttacctattgctcttcgaaaaggtaccagatcttgtactgctcaccctatttctcatcatatctcgtatgaaaagttatccccaggttttcgtgctttcaacactattttagacagtacaaaaatacccaaaaacatccaagaagcacttgatgacccaaaatggaggaatgttgtctttgaagaaatggatgcacttaaaaaaaaatggaacctgggaatctgtagcattgcccagaggaaagaaaacagtaggttgcaagtgggtgttcacaataaaatttaatgcagataatagcattaacaagtataagacgaggttggttgctaaaggattcactcaaactcatgggatagattatcaagaaacatttgccccagttgccaaactgaacactatccgagttctattatcatttgctgccaaccttgatgagcccttgcaacagttagatgtaaagaatgccttcttgaatggagatttacatgaagaagtttatatggatccaccacctggttttgagaaaggagacggatcagtatgcaagttgaagaagtctctctatgggcttaaacaatcacctagagagtggtttgaaaagtttacccaggctatgaaaggaagaggattcctccaagctcagactgatcatactctattttataaacactctgatggtgacaaaattgctattctcattgtttatgttgatgacataattgtcacaggaaatgattgtgaggatataaactctttgaagcagtgtttagctgatcagtttgaactgaaagatcttggagttctcaaatatttccttggcatggaggttgctcgtagtaagacaggaatttctttaactcagaagaaatatattctagacctgttgcaagaaacatgaatgcttgggtgcaaaccagcagagacttcaattgatcctaatattaaattgggaaatgaagatgggaaagaagttgacaaagagcagtatcagaggttggtggggaagttgatctacttatctcacactcggcctgatattgcatttgcgataagcatggttagtcaattcatgcattctcctaaggaaagacaccttagtgcagtttatagaatcctcaaatacctcaaaaacacccctggtcgaggaatactctttcaaaggggacacaagaggatgattgaaatctatacagatgcagattgggctggctcagtaatggaccgaagatctacttcagggtattgtacctatgtctggggaaatcttgtgacctggagaagtaagaaacaaacagttgttgccagaagtagtgcagaagcagaatttcgagctctagtccatggcatttgtgaaggaatctggttaaaaagacttcttgaggaattgaagatctcttattccctacctatcagattgtattgtgataataaggctgctgtcagtattgctcaaaatccagttcaccatgacagaactaaacatgtggaggttgatcgtcattttatcaaagaaaaattggaggatggtagtgtatgtttgtcatatatacctaccaaagagcagactgcggatattcttaccaaaggattacacaagccaacctttgaggatttacttagcaagttgggaatgattaatatttatctcccgacttgagggggagtgtggaatattctagaatattagaattagttgtagaatattctagagtattggaattagatgtggaatattctagagtattataattagttgtgaaatattctagagtattagaattagttgtggaatattctagagtattagaataagttgtggaatattctagaatattagacatagttgtatataatgaaccctttgggtttcaatctgaaaaaatgaaaaagtgtgttcattacttatattccaacactaactaaccccaataactagtgatatttccatgggagagaggctttataacaattataatggtcatgagtatcaatacccaactcatcatttttgtctaagtgaaagacgtaagtatctcctaaaatcctcccatagaattgggacacaatttgggtttggacgtaacttaatcccacaatgggatctccaatacacacccctcaccaaggactagatggctaggtaggcctaactataatctctaggatacactcaatagcatttaacaatttaggtttgggcctaactcaaccccacaagaccggggcttgtaaggtgagggttgtcccccacttatatacattactttggccttatcactagttgatgtggtatctccaacatttctcttagaatttggatttaaggcataactcaaccccataaaacttgcttgcaaggtgaggattacccaagccttataagcactacttaggccttatctctaatcaatggggatctcaatcccctaagagccgcatcctagtggctgcactctaccatgttaaactcagcctttctggtcttaggtagccctttttggcgtagggatgaccgcaattaaggaaactttccaacaacttcataagatggaggcataaggaaccatctctaatccacttacgattagtaacactactacatatcccattacccagaggtttcacgctatgcacaggtaagggggaaggatattgtacctaaccttatccttgcatatgcaaagaggctgtttctggagttgaacccatgaccaacaaacttaggattagtaacactgctctaaacaaaacggttaacctaaaacagtatgctgttaaacaagggccaaagaatagttgttttaacttttgatgtatatgccttatcaaagtgaattcttaaagaatatgtaacctcttcaatccgttaaccaaaaatgaaaggaaaactagggagcaactttatgatatgctctttgaatctgtctttggtgactattgatgagtgatcatattataaatttataacaggttgtataatttatttagagaatagaaactttttaatttgattatttcagtatgtttatacccattgatcaagatggtatttccgtatttgttggaaacattgtgtgatcactgtcgtaaaaaatttactggtaaagactgctcatgtacagcatgtccttgttggcaaggcttatggtatgtttggcggcttttttttttttttttttcttaaaagttactttcaagttaaagctaaattaagaactttaaagaaaaggtaaaagttgtttggaagtttttatcttttctaactaaaagctctttttaagttaaaagttgtatggtaatttatttgaaactaattatcaaagtatatttataaaacaaaaaaatattgtgttaaattaatttaattcatattaaatcattttaatgataataaaagtaaattaaaatattaaaataaatatattaaaaatttgaaattacttcaattaatataattttatttcagtgataatttgcaaacgaaagtacaacttatagaaactttctcaacaacaaaaatatattgttaagcataaggatttcaatgttatgggaagaataaaaaaagcagcatcattattccacagaaaagctgcaggggcacgcacatataagaaaggaggaaatgaatttattttagaaaaggaaatacatgaaaggccggtagatgggattcgaaggatggttgttgctagaaaagctccgcacaagctataaaaagctactccaaggagcttcttaataagctccttattttcatcttttagtcttaaaaataagctacttataattttaaggacttttatatatatatatatatatgagtgtttggcccagcttttaaggagaaaaaaaggcaaaataagctggtccaaacactaccttagtgttgaatcaatatcatttttgtgcaagttggaatcaggtctttccttcttaccatttgaaatttgaaaaaatatttcagaatttgaaagagtcaatttcataaattgtatgaagggctaaaattggatacttaggactgtaaaatcaagttactagtttcgtagtatatttcatattatttattatgaagattaatctttatgtacttccaatgtagccttcttctctcttttgaatgcatgcttttgtttttggtttgaggtgcctttttgctaaaatttgccctgaaatggtctaggatcttcctaattacgctcagcataccgtgcctattttctctttgccgcaagaatggctatggtgtgaatcatggtgtggtaatgcaacaaaatacaaggcaaaaaccattgatctgtgcaacaatcccatgacaaaagaacccaaactgcaggtaaatgttttgctgttttaagttgtgttcatggaaacttgtttcctatcacaacttatgtttttgcactcctctgtcttctatgtccatttttttactactttatctcggaacattagggtgctagacgaatagtttctgagtggccagacctggattttgaggcaagaagattcacagcacaaatcttgggcgatgatcaagaatcagaatcaatacaaccccctaatcaatccaaggacttcaatagtgaagattcatcaaatgaggacacggaatccagggccgagttatgaacaagggacagatgttgtgcaagttgaaatttattcaagaaatctatgatccttgcagcaatttgtcaccatgtagcatcatgacttctttccatccaaacagtgccaattccaaggtctcaaaggagatcttgattagaagaaacttttagtgaatttgaatcgtaccttcaatttgatgactgtggacatagtaacctattaggccatctaaattcattaatgttatataccagcaatcaacccctcaccttttttttttctcaggataattgtttaattcaatggggaagaatgctggattttgggaatgtcaaatattacagtgatagtgttaacttgttacaagtttgcttacagcatcaacataatctttggtgattattcatgtgtctctcacattgtgggtgcttgaacttgctggtaacagactggaatataagaaaaccatgttacttttgactgaattctgtgtctttcagcacccctaattcttacaggaatgtatttttcctgcttttatgtctaataattaaccgcgactcttgataaattttgactgaattttgctaaatttctatggttttattttatcatttgtatagctatgtagcatttttctataaacaattgtctatgatttctatttatacagttatgcacctacaggaatttgtcaacctctcttatccagccaatttttgacgaaagtcaattattatcatataaccacatcatattatgtataaggcaaatgctaattagtgttcttgattaaatagcattgattaaataaaagatttttattagaatatgtaaaattgggttattcataactttttttatgttatcttatgatattcataataaatattcataataagattctatctataattgtattataatttaacttgaatatcgatgaaaagttttcacattaatacgctattatattacttaaatggatttaatatttttatgtattgtcaaacacgttaagtaacaagacaatatatttggataataaagtgaacttctacgttaacaatgtttcaaaattaacttggtatactacctataattgaagcagagcattctgatcaacccaagactattttgttattagctaactgatatctagtaattagctttcataatcttttattgcgaactaaatcttttctttctgtgacttgtgtatctgtctatatgtcataatcctttcgaattctttttcattcatgctcaaacaatcttgtgctcatggacttaatttgtgcaattttttctataaaaatagtttttatttctactattcattcacccattcctttttctatactttcgcactgcttaaaatactttaatttatattcataattttattaataaagaaattatgtatcagatgaaaacagacccaatataactgtagcattcataatgaaacaatataatctcttgaagaataaccaaaaattgattattgtttattcatagtataaaaagtcaactttttcaacttactgtaagagtaattttaataaatatttgtacatattaaacattattaattcaatcattaaattaaaaattcttattcaataggtcaaatctataaattttaatatcatttaaaaattatctgatacttcgttatattaatttagtgtatgtatacttttaaaaatataaatgaatgttgactgtataggaacatatctagtgagaaagtcatgtttatataaaagtgagaagaacagtaaatcggaattatacaattataatgattaagatttgatgttatgtaaaaaaatttaaaaaatcatgattttttttataaaaaagaactcacgtgatttatatattttgatcttgataacttataataagatttaatagtaaatatttatcattctcacttgtataataataaaggttatcttactatcgaaaacgcgtgtatctaattttgcaattttgggtatatatgatgtgctcatgaactatggaaagtgacaattacaagaataataaataccttgcaacagacttcacaatgtcaaataaaagaaatcatgtataagatctagacaagtcaattgtgtggacaccaacaaaaacaaatctacataggaatgttgttatagatcatctaaataaaatgaatatggtcttaatttatgtgtcaaatcgaatcaattatacgtagaactagccacacacctaggacgacgatgagtcaatatcagaaataacatcactaatatacttgaatactctcaaggaaaaagtgattataagtgagaaattttcttaatacatgactaatatctatgaatatttgatttggtttcctgcacccttaaaatcagctaaactgtgggaaaaagcaatatatataagtgttgtcctttcagatagattagtttgattatgctttggtgcattatcctttcgttaaaacttagcctttcaaatggctattcttaatgtgtgcaatgatttggtgaaaataaatctacacaacaaaaactcagtcagaaaaaattgaagtcaaccttaaattgttattcaaagtgtgaacgtcaatagcaagaacataatgtgaacattatagtcattacaaaaacattacatatattaacaaagacaaagttattaaacttacctccattaatataatatccatttatcagaaaataaaattaaatatagaccttatattatgggtgtatagttgtattatactgcggttatagtcttccaattgaggtctaattaatcccttcttttaggggatgagttaggcattgttggtattcgtaagtgatggtttgttccgttcttgttttcactgaataaaaaaaactactgtggtatatatttatttattaagttgattaacaatttaattttaattaactaaaaaatatattaatgggaataagcttaacgatcaatatttttttattagtatatgacattagacatttgtttgtagtgaatatgaaaaggaaaaaaaaaaaagccgcaatagttttgagtttaatttgaggatcacagttgatatattcattcttattcttctctacaggatgagaaaaaccaaaatggacgacgtaccacgttttttaagaataccaaaacgaaaaggtgcagtgtgctcgtgtagaagaggttaaaacatgggccgagaagaaagagaaaataaaaaatagaaaagaagccgaagggaagcactttaaatgcaacagctagcgagccaaatccaaatagaagaatgagaagcagaatcttaagccaaagtagtcaatcttttatactccaacaagtagcagaatccaatctcatactgaaacctcgattcgatggaataacaaaagaaatagaaaaaccatcaagtacgagaaattggggtcggggggaactatttatatagttttcataatgcatatttttttaatgctctacatatgatccacagtactatatattcttaagattatttgcctctttctctctcttgacatttgtttgttcaataggaataaaaagtaattgcagcagattcccaatcatcctctccaggttttttatcaatctatattacttatctcctaataattcacaatctacattacttcttaatttaatttctgaactatactatcctttaaaaatttctgttttcagatccgattctccaccttcgcttaacccaacttctttattgagttttgtttaatgttattttgttaaatttaattaattttttatattatttaatttttagaatatgataatatttttagtttaatattttatatttatccataatacatcataaataaaatacatgaacaataataacaactttttcaattatgacattattgttgatatatttcacattttttttatatcttgttcaatttcttcatccattttcagtgggaatgtaatttgaaactgaactaccctttgcacttttccttttccttggatcatgacccattgatctccttcatattcttgtcatattaattcgtgtgacagtaaaccaaaggagttatcgtagacgcgtgcaatatgttttgtaaagtaaatagcggcacatagtttatgggatcaacattaacagatttataggcagtcattatatgaaaacacgataagtgcttagtctgaaattcgccactttcgcaattctaggattataacataactctaaactttccaggtgatataggagtttcaagtgggacttgagtctctgttacaataaatgtgttgttgtgtttgtcaaatttgttaacaatgtgcgtatttgattcatgttgacccctatttattgccttagagacgactttggaatactacgagccggagttgatcattgtttggatttgtcgacctctaatagcaaaaagttttgtggtcttaaaatacgtctcctcaacaaacaatgacacagacaaatatttttgtgcctttgaacatggaattaaccaaggatactggttacccaatattttttgtacaattaatcaagtcgttcagctacacttgacttattcgcacaaatatccccaatgttaatgtgtaataagcaatactgcttgttgaccttatagaattattatgtatcatcaatagaacacccgatactatactcaacctacttcgattcaccatcactagttcctactcatgatgcaatgttgtaatacaatagcaagtgcaagataccacgacaaggtattttttgggttactccttcactgaaacaaacccaaaaagatttaaaattccttcaatatgcagcatcaaaacacttaaggatgtcatcaagcaaattgtgcctttagagattccccttatggaagtcaccaatcacatgtggttagaaaattgttctttcgacagttaggccatacaaaatattaaaaaaaatcgaatatgaaataatagaatgatgatgaagacgtgttaaagatgttgccggaatccaactaccagaagtgtttttgtccaatataaattttagttatttttagcaaactagtaaccaaaccagcctcaattatcgatcaacatgttgcaataacctatgcagatgttgtgcataataaacaacttgctagaatgattcaaatggaagaagacatgtctgatgcataatatctttcaaactatgattagtatcatcattttcgtgtttcatttttattcttagtacatttagttatttttgttttattatgttctatttattatgtttgtctctctaattgttagtattttttgttatttgagtattttaatttttttatataatataattgagatttgataagtatatattcactatttttttaaccaatctattttttaatcactttgttctttttatttattttaacactattaattaattatttaagattactaataagttattaaaccaaaaaatattatcatttttaaattaaataatataacaaaattattattttaaattaaatttaataaaataacatttaccaaaaaaaaaaaaaacttagatgggaagtcaagtcctgaaaacatgacttctcaaaaatagtgtatttagagaattaaattaaaaagtaatgtaaattgagaattatttgaagataaatagtgtaaattggaaagaaaaaaaaaaaaaaaaaagcatccactccactctataggaaacagccataattacacccaatagtaactttcaccataccataaaaaagaagttagaatcctctaagctacccactttcttgattgcttaatctcttttcaacttaatcttccaattatataaatctatcaatctccatcaacttcccttcaacctttcatgatgagtagttcttcatgcacaaactcttctgtcaatggcttctacatcttcctcactcaaggactcaatgagcttcaccaatccttcctctcccatgacttcatgtcaatccaattcatttcagaggtcttctcatccctccaatccttccattcccagttaaccattttggtccaaaggctttgcttgtcagttggaggaaaatggctgaatgaatacatggatgaaagctcaaggctttgggatatctgccatgtactcaaatcagccatttctggaatagagaactattccttaactggctccaacatagcttcctcagtggatggctaccatcatttgactccagagttttcacatcaggttggtatatagtatatatacacctcaaattctgttcaaaattactttttagtcaaaagcttagtagtgcttttacaaaactaaatcaactttatttaattaatgactctaatagcgtgttttgattgcacgtttcagatgtgatttttcatgtttaatcagaagctaatagttatagctttcattaagctaaattgatgtgattttttttgttttttttatgagtttccaaacatgcactaaattcttctagaaaacatgtattgcaggttattagggccataaatatttgtcaaagggagagtctaggattggtagaggaaaataaaagcttgatggaaaatagaattcaggcattgtctcaatgtctaaatcagaacatgtgtatgaaatcaaagttaaacgagttcaatggcttccgaggtgttctttgtgcaatgatgagggttagctcattgcttctgatgattttgctatgtggggttgcatattgttggtcttcctcatgctttgaccaacaagggtatgaggggcacgtggagcacgtggtttatggctcaggttttatggcttctatggcaagattgcagcagaaagttgcacaagagattgaccagaataatgtccagccagggattctgcttcttgaattcaaacaagccaagattgccatggaggaattgaaagtggagttggagagaatggtgggttatgatgcacaatatgagatccaagcaaaagttgacaacttgaaacgttgctttgggttgttgagatgtggggttgagactataacagggcaacttgatgatttctttgatgaaattgtggaaggaaggaagaagttgttgaatatgtgtagtcataagtagatgtatataatttggtttagtgaagccatagcaaatgtggaaaaatacttgagagcaaaatgaagctctttaagggaaaataagaaaggaaaaattatgttgaaaaatgcaagcaatgtcataaattttttctggtcttcccttgtttctctttatttgctgagttgatggtgttgaggccttgaagaagcttttccaatgaaaagcaaagaaaagagaaaaaaaaaattgcaaaagagaatgtgatgcttgctttgaagtaaagcaacattactctcgtcatacatgagaaaccagaattttaaaatgccaatgccttcaagtaataagagaaacgtctttctagacagagtagtagtattcttttcctgtattaggtacatgggaaagaaataaaaaaaaaaatagaattcaaaagactagatgatatttgataataaaaatgatgctttttctttatcaatggagtcaagtagaatcttttgtcaagaataattagagatcaatatgcttctactatctttgtgtgggagaatttccactcaatatctcaatattgaataaaaattttatatcctgaaatattcaatattttgaacagattcatctgtattttacattagatatataaaaaaaatatgttacggaatacaaggagataaaatattgaagaaacttttgttaatgaaatcatgagtcaattacagataaatttaatacttaacatttatttacttaaaaccttaagacatcgagtatatatatttttgtcatttatatgttgttcaaaccaatatgagactttttactctcacttgcattctatcataatgcagattttatcaataaaaatcaattaaatgtaagtaaattttggaccaataaaccatagtgcaccgcacgttcatgtactcaaaccattcactccttgtaaaaacccagttacccgaatatacatgctattctgcaggttaaagaaatttctgtttgttagatttcatttttaaagatcatgactcaaataaacgtgttgctatattgtattattgtctttaaatgggtcgtttttagcttgtaaagaagagaaacagaattatgtagggaaaataatctagcctttctgcaaaggttaacggtatctgcagacatggttaagacataggacacaaaagagaaaaactttctccaagaatgacagccatataaagccgaaaaatatgaagtactatgtgaaatctacctttcaaataaagctttctagtcccaagggtggttgataactcaacaacaagaacagatcttcctctgttaaagttaaattgattgtctgggaaaagaagaaagtagatatgataatgatttataacatagaaaataggattgtgctgtctgctcactggacaaagggagaaccttagacaacaaatttatattttaatgaaatagcaaactttccttttcaccttgtttgacaatctcttttcacctcctttttggatatctaattttctactgtttttcaattaatttccttactttaaagtaaggatggcctagtgctaatttagtttaataacgttcggcgggggaaatctagtactcatatgcatttatcatgtttaaggtgaacggtcggggaatgaaaggaatttcttctctacatttaccttttttaaagtgtaggtttactttagggaataaaaatgcaaacatcaacttttatagaaaaatattaattgttaagttttttttgttaataaaagaaattgaataaattatattttcctctcttctttcttttttcatcaccaaggcaagtttgtaactcccaaaaatacatatacatcttagattatatttgacaaaactagttgaaaagttagtttcactaaaattaattattgaaatagctgaaaaatgtaaaataacataaaaataatgaaatcataatttatttaaaaaagataataagaaaatttaatatatatattgaggataaaaatgaaaaaaaaaatataaaaataaaaaattagaaactagcattttaaaaaatattacttaaatgacatttcaagaaatgttagaatctattaagaagttattaaaataagtttgtttatcgagtttttcagctagtaaaaaaactaaaaactgactaaaatattttgttaaatttaaccttaatgaaaaggaatgagttatccatcctaatatggaatgaactgggagtagatagagaaaaattggaagaaaaaaggaaaggtagaaaaataaagtaacatatatgatgaatgctatgataaaaaaaaagaaaaatattgtagttttaatgaaatggaataaaagtagataaatgattataattttgaaaaaaaatcatgttttaatattaatgcacatgataaatttgttagaattttctttaattttttttataatttttaatttttatttataattaagatagttttatttctagcatatattattttttttcttatattttattctacaggtaatattataagattataagagttaataatcttataatgcataacaatcaataattaagaatatgtttagattcctattaaaacctaaatagtgggaataccaatgcactttagcatagaaataataaaggtgatgcttctccaaaattacggaagacaaccaatagtaacctctaaccaaatatgcactaaatgatatagtctaaaacttttacattacaaatactatatttttattgattttttaataattgtcccacctttaataacctcctctttttaaaggccataattttttttctcgtaatcaaactttagtaatataatgctggaaatccaaacagaaaagtaaattaacttgtataaaacaacaacgaatgaagacagtttagtattttagcctcaagattaggatattaattagcttggctttcaattccgttcgagtgcgtcaaatagtttactttcaacatctttaatcgatataatttaaataattcattttaaattctttactttatattaatttattcttataaattataatatcacatcatagttaataaacaattcatattttactccaattatataattttaagtgattcttaaattatttccttaaagaatctctaaataacaagaaaatatttttttactcataaactatcttagcttaattttaagtaatctaatataatataatatgtagatcatctccaataataataaaaagtaataatatttaaaaataagtaactcgttgaacaacgaagttaaaaatatctagtatagagtctgcaatgattaaagtcaaatcccacctatatatatatatatagagagagagagatgggatcattttataccggtgtaaaactttatagttttacaccgtttaataactttttactgaataagtattttacaaaatccaccgttaaattaaaagcttatatcatgtagatcatatgtatcaaatttcacaaaaatccgaaatcatttgaaacctaattgatatatataaaaattaacggtatatgtacttctaaattatgtaaaaattagactattttgattaggtttcaaattatttcagatttttgtgaaatatgatatatgtgatctacatgatataagctttcaatctaacggtggattttgtaaaatacttatccaataaaaagttattaaacggtgtaaaatgatcgcatctcatatatatatatatatcaacaattagcaggcaaagattttgttgcgcgattatagttaatcttttcccaattattacttgcatgaagcaaaaagaactctcgaactctcaagggcagagtcatttttttattttattttttcttcttgcagaaattcgaatttagaaagctaataaccgaaggtttaattataatatttaaaaattcattaaaaaatataatatttaaaaattgcataaatgactcaaaagaatcagttaaagatcaacatcaataatatttttaacttaaactaattggatttataatagatgaagttaatgataaataaataaaaaagttataaaaaataggagtatggattattaccttggattaaagataacaaaaacaaatataagcatgaaagaatagatatgacatattctgtaatcagttatcacaaagagatccaagcataatccccttaatgtcgactccaatattcagttgtaaataatacgcttgtctttatcaataagggtcactatcaaagtctcgtccgtggcagctccattgaaaatttgtgaaaaagtgcttcatttgcgttgtaaaaataggagcattagtgattacttttcgcgaaaatacattgtatgtgccaaaggaagttgacgtttcaaatgtcctaacatagcgtaccaccacctcccttgtgttttttttatgtttcccagtttatttcttgccgtgaattgagattaatcttgaccaagtatgtaattacaatttacagcttccatgaaaaagagaattaatgtgtgactaaattacattgatatatggtaagaatgatgaacacgtaggtatagtactatagttggactagcaatgctatctaacatggagaaatatgcatgaacctgagaattaattcgggggacaaaagcaaggtcagacggatcattttgttccaaaccaattaaattaaagtaggcaggttaggatcaggttgatttttgggaattttaatgtttagtctgaatagggtgtagttgcattgaaaaataaaggttttaaaatattcattggaaaggtttgaatattgactgaaactaaacgagttttatgattttttaccctacctcatctatccttcatgctttaagtcgagtcagacttctcaaaaaaaaaaaaatcaagtcaggttattgctcgaacctttatccacctctactatttctgagacatgcaacaatttttaaggtgttgattaaaaattgaaagtaattcaatttagttattttgtaatttcatgaaattgttctgaaattataattataatggtgcattttagatgtcaaacaagcattaaaggctatgtttggatatttaatgatggaagaaattgaagaaaatgagaaaatgcaccaggaaatatatttaaattgttattttattatttgaagattttgtgataaaataaaagaaaaaaaatgaaattctttcgtttgactttacttcattctattttctttcatgaaagatttctttctaaaatggtaacagaacaatcataatacttgcatccacaactagtaattagacccctatatagttttcttctcaaagaaatcaaaaaccaagaaaaggccaaatgaatgtagatatagcaatctgaccctaaatcactgcgcaagatagaggcaagtgatgtgttaatgtgtcatctattcctatcatagctcattgctttgaagactgaacataacatcatattcagagggagaaaacgaagacctcttataaatcacaataatgctgtcacaactcaactacaaactttgtaccatatcaacaaaaatgtacagttcaactttatgtcataaaactaaaatttgatacatagatacaggcaaaacatttaccttaagttagtggggataagtgaacaacaaatctaatttattatccaaaaaaatgaatatggttggtgcttccttgactcgcttctcataaatgatttcatctacctcggcattatcatttcttcccttccccaatcaatctctcttatagatttggactggaagttgcaggtgtagttttggcctcgttgacaatgttcatgatctcttctatacttttaagaggatattttgtattttcttcactgtagtaaacatcttgagccccttctctcaattccttaggcaagttctttaaaaaccatggatgtagtgactttatttccttcatgatgattctctgcaacataattataaggcatagttacaataacatacaccaagtaatatcatgctacagttataagtgtttttattttataatgttccctccaaaaaataattaaatgactatgttcatatacataccattgctggatttgccacaaaaatgcgggatatcagatttttactgtcttgagatatgcaaactttgtcagggaacttgtattgaacagccataactctctggataatatatatatatatatatatatacacacacatagggagtcagaaagagtacatataagacatgatgattcatgaatctatcaacagagctagttcaaaaataaaaagtaaaatagcatatgtactaaatggtgtaaaaagattagagatttcacataagtttgttcacttctataatgattatcttaagtcatacttaagataatttctgattgattgacacttgacggtctaaaaacttttatactgatagtatataaaaattaaattaaaaaaataaagcaaattacctttatggttttgtggagattttggtatcctctttgtcctcaaatggcaattctcctaccagcattatataaagtattactccgcaggaccatacatctgccaactgaacaggtacaaaacagtaacacatcagccaaaaaatgaacaaaactaccatataatacagagaaactcatcaagtcagaatcagtaactctaaggcattttaagtgcttcatagtagtcactaaaatatgttatttctatttcactttaaaaaggaaatgtcactgcgtgtgctaagtgactgttgaataattgtatcagtctataattaatacaacatgaatcttctagtctttttcatgatctaaagttagaaactgtagtattacgaacctctggtgcaatataggctggagctccaatcattgaatgaggcctcgaatgaagtaggtatgactagaaaagtaaaggttgtcttgtcagaataaaaaattatcaaataatgtatatttaaatttaattggttatatgtttaagcattcaaggttggtatatatgattttgtcaattgaaccttagaatatccgaaatcacaaattttaagattattagcagggcttccatccaataaggtattctccaacttcaaatctcgatgacatatttcatacaaaataaaaaaacatatcactaccaacacactgaaaacaaattacaattcgttctcatagtaatgtactaatgtgtatttcatctaccatgctgtggctataattaactcctgaaatcaactgctggaagaaatatcgagcctgaaatatgtatacacaagaagaatgagaaagaaattgcatattacgaacagtaaccatgacttgtgaacattggaatttatttattatattatacttttatagaagagaaatgctaccagacaagctttcaaactaattgatcgtggtcgtacgcaaccaaattaatttgattttaaaatgtagtactaggaaagtgactcctaggtcgtctctcaaggatcaattgtcaatgtttaagggattgaaaacgtgttggggggtatttggcagaatgcgagaattctaaattaaacagaatgtgaaaactaaattaaacagaattaacaattaactgcagtaattaaaaacaagtcagacccttagaacagattgcgcctctaatttcctcggttcacgaaagataacctgtcctgcttaatccttatcagtccagattaatcaactaagcgaagattaatctaaaacgtcattacacgaattaagcaaacgtgaacctcgttagggcaaactctcagaattaagcaaactgagaatactgaatcaatcaatatcaaaatcattaagcatgactctaattcgaaaaatacagaacagaaactcaaacaaggaagaacaagcagaaaacgaattagaagaacaagaacctccattaaaggtctgcaatctgtcctagggtccaaccctaggtttagccttccattaattcgaaattaacaacagaaacgtaaattgaattgaaacgaaacattaaacaaaattaagaacagaaacgaaattaagaacagaaacgaaattaagaacaaaaacgaaattaagaacagaaacgaaattgaaattgagaaaatgaagcagaaagcgaaaacaatactgaaactgaagcagaaaacgaaaatattaaaactaaaggaaaactgaactaaaattgtattgtaggctgtatgttcttgtctgtctgttgtgtgttgtgtgtattgttgttttgtgtgggcacaaaaccctcaatatatagtaactgcctaacctaaaagaatggaccttttcctaacaattttggcccaaaatcactaaagataagataagataatataaaataaaaacgaaatccatattctgatatggaaaatattaagcataaataaaaacgaaatctataatttgatatgggaaatattaagctgatgctgacgtggcgcactaatcttcagtccataaattaattccaagcctaattaattattaatctgccctgaaaaatcaaattagaaataattaacttaaaataatccaaattaattaaaattcgaattattggtctaattaaatcctaaatgagaaacaatgcaaaatataaacaattaagcacaagttagggattaaaatgagtacagaaagatgagtaaatagtgataaatagtgactcatcactaattctttattattcgttgaaattatctaattaatcaactgtgcaaaacctttttattctaaccgaacatacccattaatatcaattttttggatactctagttattttatattaattaatccaagaatgtttagcattttcaccccactattatttctaatacagttttgttaatcactgtatatggttataccattaataaataaatattgaaactcattatgaaaatgcattgataatatgaaatacagtaatatacttttagttgaatatatttaatatatatatatatatttaaacaataaataaataatatgttcacatacaaacatgataagttaatgtatgtttatatgggtccatatgggttagagtccaatagtttactatatcattaaggttcttcctttgctgaaggtaacactattgaacattatacatttgatgtctcttagtgtaatacttcaagcatccaacactaaattattctctcaaactccttacctctaacaatcttgaagtattagcttcgtgtgtcggatttgagcaaataaggtgttatttcgaagatctcatcaagagcaactcaaaggtggtatcactttcgtgttttgacgaaaggattaaccgggatctgagtttgaaaactttgttgccgcaacctttgaatccagatcccaaaaatttcaaccgatttcatgagttaaaaccttgcgggctttgttctactctccgagacgatcattttgactggtcacttgcgtaaaacgaaggtcggacgaatgagatatagtcgttggaagtttctacagttttccgatgactggtttgttttctagctaccggcgactttctggcgaacaaaaaaagtcgttcctaaggttttttgggtatttcgaattcatttttaaggtcaaatttgacaaatttcacctctataatgttgtttaaaaaaaacgttagaagatttgatatattttggaggattttaaggtgcactctttctaactattttactctgattaaaatggaaaaacatagctactatgatatcataaagctgaaatcttttgatgtcactgaattttatggttgaaaatttcatgttccatttggcatgaaggaacgtgacatgttctacactgtgttgagtaattttgcatctattgttgaaaatgtggatgaatatcaatggattaaagataaagatttttgtataaattacttgttaaactctttaaatcctcgtctggatatcacttataatgagtataagattgcaaaagagatatgggatcacttgaacactcaatttcaaaagcaaaataggctttctaagattcttctagggaagaagttctttgactttaagtttaatatgaatttcaaacatcacttttcaattaattgaacttgagaacatgaggaacaagctaaaagaggacaattctaatttatctattaatctctttgttggtattgtgttgagtaagctatctgctaaatgaaattcttttaagactgacatgcacagactaaaagaacagatgaaaccggatgaacatatgagatttgtctgataatccattcagtaggtactcaacataagaccaatcccatatgttcatccagtcttatctgttcttttagtctgtgcatgtcagtcttaaaagaatttcattcaacaagtagcttactcaacataagaccaacaaaaagattaatagaccaatcaaaattgtcctcttttagcttgttcctcatgttctcaagttcacttatttgagaagtgatgtttgaattcatattaaacttaaagttaaagaacttctatactagaagactcttagaaagtctctcttgtttttaaaattgagtgctcaaatgatctcatatctcctttgcaatcttatattcactatatagctagacgaagatttaaagagtttaacaagtaatctccataaaaagtttcatcgtttaattcattaatattcatacacattttcaataatatatgtaaaatcacttaacacattatagaatatgtcaccttctttcatgtcaaattgaacatgaaattttcaatcatgaaattcaatgacatcaaaagatttcaactttatgatatcataggagttatgttttgtcattttaatcagagtaaaatagttagaaaaaatgcaccttaaaattctctaaagtatattaaatcttctaatttttttttaaaaaaaatagcattgtagaaatgaaatttgtcaaatcttactccaaaatgaatatggaacatactccataaccattttacgtgaaatttgtcacatcttttgcaaacttggtcatacagctgtccacccgctacatactccataactattgtaagatgtgtgggagtcaaggccaccttcaaagttcaaattccatatagaacaaattatctcaacataatactaatgtactgtataaacacataacgagtggttaaagacattaatgaccaattaatattattcattgaatatttctaatcttttgtattattgatttcatttaaaatttaacttattcactgttatacttttcacttatattatttgtaatcttacccaatgctattattttatgaaaaaatatattatagtctgacattatatataaaacagttttattttatcgctgatcaatcacaatctattattatataagataaatttattaacttttatgaaaattaacctaaacctcatattttataataatagaagccaagcaaatattttgaaagaagagagggagagtaaaaacagatcatacctacttgaaccgaacaatattcggatgacgaagagaactaaggtttacgatttcccttgccaccttctcaataatctgcaaaaaagtgttaaatttgctttgaaaacaatgtttattaaagtgaatgggtgtttgtattttttaaaagcaagagatctaagtcacgttttatttcacagattatttctttaattttgagattttttttttaaaatataacatgaaaaatataattttaaatattttaaaaatgaataatatacccatagttgtgaaatcagatccgatcattgacccgatcgaggtagtagaccaatggtctaatcggtgggtccttaattaacctgatttgactcattttatctcggtatatattaaaaatttaaaattatataatattatttgattaagaaaagtctatctatattccaaaatccaaaataacaattgataataatccaaattttttaaaaaataaaatttttaaaaataaaaaaagttataaaaccggtataattaaatcagtccaactgagatttggtgatcttcttggtcggatttgatcgggtcatcccgagtcaattacacaacttattcaataaagaaaccgatccgattaggccactaattcttgacccaatcagtccaaattgtcgagacggaccgattttaagaacactaaatatactaaataataattatttattaccaactaataaacgtgagaagaaatttttttaacccatatttgagaaataaataaataattccttaaacaaaatctcaaattcaaatattatagatgaaaaaaacataattaaaaagaaaaattttcattaaaaatatcagtcaagtcctaataaatagagacaacgacgccacagaagaaaaaaaaaattaccgaaatgctatgtgaccaaaacatattaccagattgtcacgcgtcatattttgctagacctcctagcgaattacacacagcacataattcgctagagggagtagcgaattacgtataatatataataaataattacttccactttccaataaataactgcttccctacttccactttccaataaataacggcttccattttttcataacgtatcttatctctttatttttgcaaattttttcaactaaattggatggtaagagacagatttttattcaaaataatttttaaaaaactatattgtttataaaactaatttagttaataaaattaattttcaactaaataaaaaaatatttgaaaataaaaatacatttagaaaatctatttaaaattgatttaatttttataatcaatttaaaactgattcaaaataccagttttattcaaaatgatttttaaaaaaattatattggtttaaaaaactaatttagttaatagaaataattttcaactaaataaaaaatatttgaaaataaaaaaatagtaaaaaaatcaattaaaaattgatctatttcttataatcaatttaaaattgattcaaaatatcggtttttattcaaaataatttaaaaaaaattgtattgttgtacaaaactaatttagttaatagaactaatttttaactaaataaaaaatatttaaaaataaaaaaaaattaaaaaatctatttaaaattattctaattcttattataaatttaaaattgattcaagatatttcaaatttaaatcaacaattatttggaaaaaaaaataagtgaaacaatttgaaacgtagttggtttgatttttttcaaatattttttttcaaatatttttttatttaattgaaaattaattctattaactaaattagttttgtaaaataatacagtttattttaaaattattttgaataaaaaatatgtcggttaccattcaatttagtttaaaaagatatgcaaaaataaatggatgaaatatattatagccttataggaaagtggaggcaattatttattggaaagtgcagtagttatttatgtcatatcaacataccgttgctagctacaaagagtagcgaattatgtgatgtgtaattcgctgagaagtctaacgaaatatgacgcgtgacagtctgataatatgttttggtcgcgtggcatttcggtaattttttttccttccgtggcagtagggtcgtttgtctctaataaatattagttacaaacaaaagagatatatcaatattattattataataataataataataaaaaataaaaattcgtctcctagggtttatgatttccctttcctccatcaaatcattcggaaaacaaaatacaggtgtttacataagtagcaacttaccttgtcttcccgtcagatgtatttccgtcagatgtatttgacggcaatgagatctttggtttctttgtgacgcataagccgtatgaccgcgtatctcccaacccctatgtccccattcactacctcgtacttctccatattcacacacaccttcctttctgtttctttttcaaagttctaacaccacacttgatcagccaataactactaactaggcactagcacaaatcactgatcaatcaaactctaatcgatatatatatatatatatatatatatatatatatatatatatatagataaatagccaagctgttaaatgatcagtcgcgggaagaaaaacgcgcattaattagagagatacttttcaatataaatcttccaaagtgtgaatataaataaaaaagttaagagatagaaatattatcgttattattagataatagtgatataatcacgtatcttaatagaggaaaacggataataaaatataactttattgaagatgtgagatttttttaactgagacaaaattataaagctaaattattaaaaaacggtgcaaatatatatatatatatatatatatatatatatatattaatagtgatgaagttgtttcaaactcaggatataatgggaaaatcaattgaataataatctaaattcgaagattttttagataaatataataaactaaagtgttacggtttgggccagggctcaattgttatgaacgatcgtgccaataacttatctatggaacgtggaggctgacctggtccatgatggacattgagaacgtgcaggacgaggccgagaattcagggagcagttccaatgcccgttatgaggtaatctgcctataaatacacattaattcctggtgaaaggtacacacacactctagctttctctctttcaattacacagagcacacactccactcccattggtgtatctctatgatcttctgcttcaaggtatcatcctccattgatatccttggacttgcagagttagagtgatcagacagtgaacacgtagcatcttcgtgctatacagttgtgttctgggaaatatacagaacattggcgccgtctgtggggaaacgataaaattcgagtctcacacctttccacaatggtaaacacaagaaatagccactctgtaccacattcagagacgccgaacagggagatttgcctaccggagaatcagaacgtggcacggagggaaaaagtacatgtgacggaagctgtttccgacgaagcttcctctcccgcccagacagaccaacagaggactccagcagtgcgaaggatgggtcaggagggggagctcggaggacaactcgtcagcaatgtcctcaattcaatcctaacccgaattgagaacatggagaaacgacaaaatttacagagacaagaagacattcgaaacattactcgccaaatggaagaacgtaatgaggagtggagacgtgtcgaaacgcaacgaatggcacaattggagcagcagctgcgaatgataactgaccgggtacaaatttcaaatcctgagggcgagacgcaggatctgaggatgcacctgaatcaaagaagaagtacggacctggagagtcaaagacggatagaggagccacaagatttgaggacacacataaatcagagacgagatgtcgacccgggagaccaaaggaggacagatgagccgcatcagagtcaaagccgggcacgaaatgaggcacaagacgaagttgacacaaaccatagccctgacgaaaatccgaacatacgaacgaaacacgacgacaatcccattttcagggcaaacaatgagaaggttccgcaaaacggcggacacgataagccgggagaacagaattttcgcgaaaaaagcaggaccagtgtatcgtcggaaatatagccggggacagcaaaacaatagtccattcgtggatgacattgtaaaggctagatatttggacgactttgatgggtctttcctatcaaaatatgacggaacacaggacccgcaagtgcatatcgatgaatttgatttgcagatgtgtgtccggggcattgatgagcccataatatcgaggatattcgtcacaactttggcgggctcggcgcagacgtggttccacactttaccgcctaggtcgataaagaattttgaagactttggccagaaatttttattgaattttgagaccagcaaaaagcagccgaaatccgagttcaccctgggtaaagtcagacagttacccgaagaaacgctgcagagctatctggatagatttaaagaggccgccttgcaagttgaggggttagaagagcgagtccacgtatacttgatatcggctggactcgacggttcgtcaagatttgccaagtccatttataaggacccggtgaagtctttgatggaatttcgtgcccgtgcaaagaaatacttggaattggaacagatggaggtcgtcaacaactctggacgaggaaaggagcgtcatgaaaggaggagctcacctccgaaaaataggggatacccggagaatcgagctcggaataatgacccgaaaccccgaccagggagatacgaaaacaagtacgagaaatacactacgttgaacgtatcccgttcacaaatctggaaggaggtcgcgcttacagagatgaagaaggttgaacaaccccgtccagttttcaacaaggccggattggataaatcatgattctgtgaattccacaacggacccgggcacaccacagatcaatgttgggatctgcgggatgcaattgagaagtttatccgggaaggaagactcaaacagtacgtcattcggacacaaggaaggaagaacaaacggaagggagacgagaatcaacataaagacgaaggaaagaaaccccgggaagataacgatgagatcccggagcccaagttcgaatgtaacgtaatctcaggaggcatgggcggtggcggggatactgccactcaaagaaaaaaaatacctgaaagaagtgctatcggtccaggcacaacccaaattcaaagcccggattggaaagccataacctccactcttgtattttaccaaacaagacatggagggggtggtacccggacatgaagacgggctggtgatatcagcaacggtgggaaattgccgggtaagaagaatgtacgtagacaacggaagttccgccgacataatcctgttgaatgcatttcggaagatgaaattggatgtaaaggaattaaggccgtgcaaaacaatgttgatcggtttcaatggcggcaacacgaatgtgatggggtctatccgtctgcgtttaaccctggggacgagagaagcttacaagtctgaagaagtggagttcatcgtggcagactttccatcccaatataacatgatattggggagaccaaccattcataagtgggacatcttaatgtccacaaaacaccagaaactcaagttcgttggcagcaacagacaggtggtaaccatatgcggcgatcagaaagaatctcgacaatgttactacgatacggttcgaaaaagtgaaagagaagccaacgatgacagctccaaccgggtacgttcggtaaatgtcgtggaactggatatgcgagaggccccggatgagtggagaccggaacccgcagagaaagtcgagcatattctgatcggagatcaggccggtcaggtgaccagcattggtgaagcattggaacccgaactgagggagcaattgatccattgtttaaagaaaaatcatgatatattcgcatggaaggcgtcagagatacccgatgtcgatcccgagttctgcagtcacaaattggcaatgtacccgggatcgaaaccggtggaacagaagaaacggaagttgggaccagagagagctcaagccttgcaggctcatattgacgagctgttgcaggccggtttcatacgcgaaatccaatataccacttggctgtcgaatgtcgtaatggttcgtaagccgaatgggaaatggagggtgtgcacggattacaccgacttgaacaaaatgtgccccaaagacgcatatcccatgccaaatatgtaatgccccagctacaaccgaggtcattacctagccttaagcactatcattatcagataaacatcagagttaagcagtttggaagcatacaataaacataaacagggcatcaacaaatgtcgtcatcatatacactgtacataagtcatggtgaatatacatcaactgtagtgtcttatacaaaactgtacataacttccctctatggggtacaaaataaaaccaaaggcatatacaaaatatatgagctacaactcatgttatctagcctatggttttcagatccagctatccctgcataggcttcttgccttgggatctatccgctccgctcgatgattcacctacaaaacatagccccatacacggggtgagatataaaatctcagtaaactcagggcccttgaaggtatttccttcccttggttcactttccaacacataataacatcatcatcataaccatatcatcaagcaaacacaatatcaaatcatcatccacctggccacaaccaagtgtctcaagcattacctgaccacaatcaggttatcaagcactacctgaccacaatcaggttataaaccactgcctgactacaatcagactgtactcgtgacataatatcgtcacatcaataactgtcatgcgaaggctacatcgtagtatataggaacatctcctcacagggaggctacctctatataccaggcacatctcctgcataaatccctagcggaggcttcctctgaatatacaggcacatctctatctcacgaggctcatctatatatatcagacacatctccttttggtgaggctacctctaggtacataggaacatctctcatcaaagaggctacctctatgtaacccaaggccatctcatcctctatcaccctaccattgcctggggaggcttcttctgtgtatatgggaacatctcctcgtaggaggctacctccatatcacaggctcatctcttaccaggtctttctcaatcatctatcctactacaataggatactattcatccaattctaggattcacatatcatcccctttcaatgggttcatcatacattgtaagtcattcccccatcaaagggttcactacacattcatacataacatgccctcatcaagggttcaatcaacattccattacatatcacatcccctcatcaaagggtttaactatacacaatatatataatacttccccatcaagggttcagtttacatttcaagcatgacaaaccattacaggccacacatattatccccctcatcaaagggttcagctcacctgtcatacaagtacaatgaaggcatataatcccctcatcaaagggttcaatccacgtattcaagcatacatatgcattacacaacattccctcaccaaagggtttcattcgcattcaacatatataatcatccctcatccaagggttcaaaccacattcgatacatacatatatagtactccctcatcaaagggtttcattccacatctcatacatgtgccacacacatacaacatatcacaatataaccattctccatctggagcatggtggaaccaagcaaaggacacacaatcaaggtccaagagcttacctgctctaagcaacacatcggctttcccggtctcgtggctaccaccaccagagatatcaagctcacgtcctaaaaagcatacaatcacatatcaaataccattctatccgtataacgcataaatctctagcaaaacatgcggaaaagcataaactgctgcataaaattctgcagattttacacccacttggaaaaatcacaaatcctcgtgggaggctcctaaaatcacgagaatttagaggcatcaatatatatctcttatattttaaacaaaactggtttcatcaaaaaccatgaaccatagcctccgcggcaaaccgaaaaccagaactgtcacacaccaaaatagtgctgacagcaacagaccaactcaaccagccatttttcgaggactatccacaccaggtcacttgtccaaatgagctgatattttacaggaatgaatttcacatacccatctttctatagcctttgaaaacacttgatttggaccaccctagacaaagttatgctttctgcaaaatggttctctgcagcagaaaaatctgctaaaaacagagtataacagcctgttataactctgcaccacaatttctaggagactccaaaaatagcacgaaaaatccagaatgaagctaactctcttagctttcaaatggaaccggtttcataccatttggacaccgataactcctgttatgagcaaaacaccagaactgcccaagtggtgttcttggctgtcatgaacttgcatgcttgatttaagcatggaacaccatttcaacttaaaaacaacttctacccactccaaatcacacatcaaaactgtctcaccctcctaaaactcagcattcattaatctcactccaaaccctaaccctaactcaagaataaaggggaaataggaggagatttcaaacattagggttcaatagaccaaattggagggtagaccagcactctaaggctctcactcgcagtttagcggcgccaaacaaaaatgggcagatttgaaacccactcttctcttcaaatcaccaacacccaaagctcaaagcaacaagaacaaggaaaaagagctttctttctagcttatttgtgatttcagccactaatctcatggaagtggtgagaagagggcttgagagaagagaagaaccaaagaagaagaaaaaaagaagaagccaacaagcagaaaacgtatctgctggcttttaacaagaaacagggggtgcgttcagcaattactaactgcacctgcccctccgacaaagaccaaactgccctttcgtaaattcgtttaattacgaaattatcacccaaattaccttaattaaatttagtgatattacaaaatatagaccaactggtggacaattcatccgggtacaggatattgtctttcatggatgcattctccgggtacaatcagatcccaatgcacccagacgaccaggagaaaacggcgttcataggcgacaaagccaactattgctataacgtcatgccattcggcctcaagaatgcaggggccacatatcaaaggatgatgaatagagtattcgagtcgcaactcggacgaaatatcgaggtctatatagacgacatgatcgtcaaaaccacaaatgttagcaagcacgtcgaggatcttgaagaaacctttaatcgattacgaaagttcaacatacggctcaatccgttaaaatgtacctttggagtcggggccggaaaattcttgggtttcatgttaacacacagagggatagaagctaatccggataagtgtcgcgccgtgctggatatgcaattcccaaccagcaaaaaggaagttcaacaattaacgggtcgaatacccgccctcacacgttttatgccaaaatcagcagagaaggcgttgccgttcttcaagatgttgaagaaacaggccgtcatagaatggaactcggaatgtgagaccgcctttactgacatgaagagatctttggcgtcgcccccagtattgtcaaggccggaagcaggagaaacattggtcatgtacttgtcggtaggcgaagaagctgtaagtgcagttttagtaagagaggtagagtccacgcagaagccggtatatttcgtaagctgagcattgcgcgactccgagttgcggtatcaaaagttggagaagttggtcttcaccttgatcgtcgccgccaaaaaactgcgtccatattttcagagccataccatagtcatacggacagatcagccaattcgacagatcctacataagccggacttggcaggaagattgacccactgggccgtccagttgtccgagtttgatttgaaatttgaggctcgccacgcgattaaatcccaagcgttggcagatttcatccgagaactcaccccccacaccccgacgatcggagagtggtggactctatacgtggacggatcctccaacaagaaagggagcggagccggaattataattgagaatccggaaggagtagcaacggaaatctcactgcaattaggctttccaacgtcaaacaaccaagccgagtacgaagccttgatcgccgggctcttacaggcaaaggaacaggaagccaggaatgtgaaagtgtacacggatgcacagttagttgcatctcagatcgaaggacgatatcaagtgaaagggccattgctggcaaagtacttgagccgagtaaaagaactgatgtccgagttcggcgagattacggtaaatcatatcccccgagaagaaaatgcacgggctgatatcttgtcaaaactggcaagcactaaaaaacccgggaacaaccgaaccgtaattcagcaacagacgttgcagccgacgtgcataatgatgattaccaccgatcatgattggcgacgcccaatagtaagctatttggagaaggggacattaccagacgacgagctcgaagctcgacgtttgatacgaacgtcggctatgttcacgattattgacggggagctatacagaaaaggattgcatagccctttgttggtatgtgtggccccagaccgagtagaatatatcctatctgaaatacatgaaggaattaacggacaacacatggggggcagggcactgacgaggaaggcactccgggctggttatttctggccgacaataagcgcggatgccgccgaacatgtgaggtcatgtgaaaactgccaaatgcacgcttcaagggtattatccccgcctgaagaattgcaatccatctcggcgccgtggccattttacaaatggggcatggatcttttgggtccattcaaaccggcagaaggacagatgaagtggctgatagtcgccgtagactattataccaagtagattgaggtggccccctcgaccacaatcacttcggcccgagtataaaaattctttgagagaaatataatttctcagtttggaattcctggagaagtaatcactgacaacaggactcagttcacggacagaggatttcaagagatgatggctagtcttcacattcgacaccggttcgcgtcggtagagcaccctcaatccaacggccaagctgaggccgcaaacaaaacaattctggaggctctacggaagcgaatgtatgaggccgggtcgacctgggtggaacaactatattatgtcctatgggggatccgaacttctgtccaatcgtcaaccggggaaaccccattccggatgacttacggaaatgaagctatgatcccagtcgaaatcggacaacagtcatggcgacggagtcaaacgctgcgagacggagaggaaacaaacaatgaagttttggctttggagtcgacactcattgaagaagtccggataacagcgcatgcccgggaattaaagatgaaacaacagatggcatgcgcctacaataaaaaggtggtcccgcgacagttcaaggagaccgacctagtactgcgacgtgccgacgtcggaaacaaaaacgcccgggacggaaaattagcagctaactgggagggcccgtatcgggtcactaaaaaattagacaaatgggcgtatatgttggaaacattacaaggcaaaccggtcaagcgaacatggaatgctgacaaattgaagaaatattacagttgaaattgtcgaccttctttttaataggggtacgaatccaaaaaatgttgcatctgaatccgtatggtccctattcatcaagggtacacgaggcagtagaacaatgcaatctcggtatcgagggtatggactcggaatagatatatccgagcccatatggtcctctttcacgatgaagacattgttaatggatacgaactcgaaagcctaccttctgagcacatcattttcactttgttgaataagttatatcgttgtaattcctaagtgttagtctgatcctactcggacacacatattgttatcgtaacaacgaatataaatgcaagtattattgattaccataagtattgagtcattctatacgattttgtggtatggtaacgactataaataatacgctaaacggccctgatcaggccggataacggattcattagtgaagttgtttatggtcagataacgtgaacaataagcaataaatgcaaatataatgaatggtcgttggaaccaaaaagatgcgcgcacaagatattttatgaatcaagtaaagagcttgagcaatatataaacgaacctagtaattgttccgggcaccgggcccaataaagaaaatggaaagtaattgttctgggcaccgggcccaacaaaaaaataaaaaacacaagtaaaaaccggcatcccggcccttcaatttggtggaggctgggagtcagtagcagattgcggcgtagtggtatcggaaatggggttggcaccaggttgggtggcatcaacggaagcagtggcatcaacggaagcaccaagagtaggttctcccatcgacaaaacttctgttgtagtcgccgaagggtcttcagatgcaggaggggggaaaagttgtccatctttgacatacgccaagaaatgcatcccggcattagtcatagctaccctggggttcaaaaatgtgatctgttcaagggcgttgctgaagccttcctcggcagcatcacgaaaggttgctttcatagcagctagtcgaccctcgtaatcctggacgcaggcttctttgtcggccttgacagaatcgagggatgaagtcaggagggccaccttctgatcggcagcttcaaggaaaccttgagacctcgccaaatctacccgcagggaggcggcaacagcttgggacttgggtaattcctccctcaaaagcttaagctccgccgccgactgcgtttgaagggaagcaagttgagcctcaagggaaacaagttcttcacaggccttattcttttcccccaaggctctatccttttcctccaaagctctatccttttcctccactgcaaccccgtacctgcgacacgaatacttagaaatatatacattgtacaagtagagataaaaggtcatgggtagaacacatacctttcccgaacaagggtaagcgcccgagccagagaagcactgcggaaggcatactcctcgatccgaactatttcggtcagttcttcccccaccggggcacccggtttaagcatgtatgcggggggcttggtcaaacggatcaactcttcagtaaccccctttttccataaattgtccgagcgtacccgcgtttgaagatgctcggagtcagaggtaggggtagtacgtgggcagccttccgccacagtaagatccacggtttcgaccaccgaaaccggggttagagttgttgaggagggaggctgtggagcaggcggtgcgtctaacgccgttccttgggtaccctcgtcaaaaaacgccctgtaagaagggggaccacgttttttagatggggcaccaagtttgtcagtggccgacctcttgcccttgcccctgacctcggttggtttggagaggtgggcgacatcagttttggccttaggaggaggtcgtgatcccattccggctacaatcagaaaacattacaattaatacaagtaagtacaattgtaaactaagaaaatgcagttatcaaagcagaccgtttcgacgaccactgccaatgtagtcggaagtcttaggctgaccatgagtgcctataaactcagatatcacgaaaacagaagaggcgtccgagtcggaaagctcctcctcgacaaaacgataattggaatgatcctgtttgtaatgatcatccgaccaatacaaaggaaaaactcattccacatcagatgactcggggccggacaaaaagaagggttgccgatgaggttccgcggcaaccttaaagtacttgtctttgaagccccggaaggagtctgaaaaaggatcgaagagttttcgtttactctgactacggaaggaaatccatcctttccgatcagaaggctccttacccattctaggggtatgaggagaatagtagtagaagaagaggggaactgtgcagggaattcctaagtctgaacaaaataattcaaaagtacggataaacccccaactatttggatggagttgggaaggggctacccggaggtgatttaaaacttcaatctcaaaggaggaaaagggaaaggtaatacctatttgagttatgacatcttgaaaaaagaagaagaagttgggattgttaccctcccgttgagcacaaattggctcaccgggtaggggagcctgaagggcgaacccatcctgcttccctactggggtcgacactatgctgggtaggtcgaggatggaagaaatgcgaaggatttcataagtgacccaagggaacttagacgctaatgctgggggcacatctgaatgggactctacagaagcagactcgtccatagtttccgaagtaacacccattatacctacgaaaatgaagtggggaaacaaaagttagcaaaacgtacctggaggtaacgcattaaaatcacaagaaaccgaggccgaaactccgtcgacgacagaacgagtatgcggtcccggttgcaaatccttggaagcaggacgcaaaatggggttatgacgacatgacctaaagattgaatcagcgacgtcgtcggaacctatttgaacataatgaatggcctcggacacacaatctatacatgcatcgtactcaacctccattacttcaaccgaggacgaggatgattcctcatcggaagaaggagagaggctaaccggagggttaggatgacgaccagagactactaaagaaagatcttgtgggttaccaatatcaatattgggcccaagaagagaagagtccaaagaagataaagtcctggaagaaattgggcctgatactgggcctaagggttttggcttagggtctacaggaaccggaagaggcgagagaaatgaagggaccgaaccgccaagaggggtggtgattttttgttttccggaggaggaggaacctccggtgtgacggcgaagggggtcgttttcactttccctcgcaggaagtggaaggccaaacaacaaccaagcggctctagggccaaattttttccttatctccgcctcttcttcaggagacattcttagggcaaattaaggaaaatcaggaaagactcgaaggggaagggaacgatatgagcacaaaacgcgaagaagaaaaacccagaaatcaagaaaaagccggaaagaaaatgcgatgcacccctaaaaaatcctgatattggcagaatcaagataatgcaggaacactaaatgatacagaaagaaaggagaaagaaggtacctgtggtattggggaactggagtctgaatggaagaagaacgaagggggaacttgaagaagatgcgagagaacactcgaaaagttgatgaaagagaagagaggatgtaatatcagggaataggcagaagtgacaagtaagggaaagagtaggcacgaataaactattttgaagataaaaatttgaaatatgagggtaacttgcagtaaccgccagacgaaaggaaacggttcagtcaccacaatgaaacgacacgcaggggtagcatggtaaaagcacgtccaattataagggcaggaaagtaaattcacgacaacagtaatcattaccagacgaatgaaggcatttattgccattaaggacggaaaaagtaaccgatttgaatcaggaagtccagcagccgtttcaaatacgccataaaccattccgggtacattactcgtccaaggcaaatccggccacatctattcggaagtttggctggcgacacatttgattatatttacatttagcagaatcggaatacatatgtccccaaaggtctagtcggaaatattcgtatacccagatattcacgcgatttcgaaaatagactgaataaagcagttgtaggagtatgtatccgaacgcgtggagaattgtatccggatgaacatggtcggatatgttgtccgggacactgtggatagatgagattctgtacaagggaagtcggccaatcgtagtctgatcaattgtagtcggtttgagtgtaaccccgaagtttgcaaatcaccttgtacatcccggctaccaagtatacttggcaaccgggctggggggcaactgttatggtttgggccagggcccaattgttatgaacgatcgtgccaataacttatctatggaacgtggaggctgacctggtccatgatggacgttgagaacgtgcaggacgaggccgagaatccagggagcagttccaatgcccgttatgaggtaatctgcctataaatacacattaattcctggtgaaaggtacatacacactctagctttctctctttcaattacacagagcacacaccccactcccattggtgtatctctgtgatcttctgcttcaaggtatcatcctccattgatatccttggacttgcagagttagagtgatcagacagtgaacacgtagcatcttcgtgctatacagttgtgttctggaaaatatacagaacataaaaataaagttatgataaaggcatttataattgtttgataaaaaaatcataaattaagaattgtgataaaaataacatatttaattacgatcttaattattgattctctaatcaaattttactataactacttggtgtgtttagataattttttttttaatcagctgtgtttagataagattaattgaagtgagtaattcaatttatgtgaaaatttagaatttgtggtgttaagatatattatttggatagtatatttaaaatgtgagtttaattgttatacattatggtataagtgtaaaaaaattatattatcattcaattaaaattttatgataattgtgatttttaaagtaattaaaataaaacttaaacttttttttaaagatataagattttataattgattgacgtgcatactaatgagatccttaaaaatatttcaaattctaataatttgttaaaatattttgagtacataaaattataacatcttaaatctcatgcaaaatataataatttgaattatttatgctcattttctttacctatctcctattttcactcctcacgtgcctttttctcttctatcttctctcttctctcactgatctctcctctctatacttctccttccctctttttcttctctctcccctctctttccctttctattcatactatcaatctattatacttaaattctgtttttaaaaggaaatgacctttgagacatttcatggctacctatagaaggtgtacttggttttttaatatgattgaaagcaacgtaaatttttaagaaaaaaaattgttagtttattttaaaaatttgtaatttattttaaaataatagtaacaataaaacaattttaataaacaagtataaaataaaataaaatattttttatacactgctaatataaatatttttatattattaaataattggaaagcactccaaaagtaataagacagtatttaaattctttataatatatttaaattaaatttaaaaaataatcatttccttagaaattgaaaatacttaatataattataatttccggatcccaacaaagaatctatttttcttttagttgttgaatctcatggtaagcacatttttttaattaataacaaactgtaaaaaaaattatttatgggtcgaatcgacttttgcggcattaagtggctattaaccgaggttgtgtgtacatctatataattagtaattataaattttcttatgcaattagtaattacaagtgaatgaaggaaatgtaaattttcagaaccaaatcattaagattgagcaaattataaagattttccaacattgataaaaaaaaaaaatcaaatggaattgtaatgaaatagaatgaaattattacgtgggcatgacaatgagacggtcctgagatgagtttgattttctccatttccactaaagttgcgacaagctcgggttcgagtttataatacgagggaaagaaaaattaaactccacctcatatttatcagatttttatcactatcaggttagagaaaatttaccaggcatctatttcacactttttaaaattttaatttattcaaatattttaattaaatcgtagttatcatttttgtgtgtggaataaatcattgtttacattttaactcaagtaatatatatatatatatatatatataataaatatttaacaattaaattatactcgatgcaataactattattagtgtctttttttttccatctagacatgatacaagactttaagtcaattaattttagatttttcattgatacaaactttataacatttgaataatgcccttgtagtatttctagagatgttgttttcctaggccgtttggtagtgaatttcttaaaaattttcataatcttaaagtataaattatgttttttatgtttgatatacaattaataaaaaattgtcacaattcttgaacatcaattttacatctcattctcattcttgcaaaaacattcttgaggaggggggggggggggtagaatccaattttttcaagtggagaaaaaattttagttacatattttatattaatattaattttcaggcattttatacatttatatgaatcatatttcttgggtatgaaaaaacttcttccttatcaaacatcctctaagaacaataggctctaagaacaataggttgaaaaacttactttctcatgtttttattattttgaaaaataacattcatagaaaatgatgtttctcaaaaatatttttaacaagttactaaaaaaaaattacattagggaagacgagaatcttattttttttcaagtttaatttttattattatgatagaaatatcatgttattttttatgaaattatataatatggtaaataattaaaatatacataactcttttgattcctaaaaaaattatctaaatttttttaatagccaacaaacataaaatgaaaaaactttcccctcctgtaaaggtagagatcactttcattcccccaaacatacaatttgggtgaatgtcattgacacctcttatttttaatctttacatcccaaacttttttcttacaaaaatatccttgattgaaattagtctccgtttgtcaagatatttaacgaaactagtttttatcaaatcaattacacgtaaaaaaaatttaagaaagggaacgttgttgaagaagtgacaaggtagcgaaacctcacatgaagaagagaatgaggaacaaggaagagaagtgtttgtagaagagaaagtgagaatatgctggaagaagataaggaggtggggttgagacttgatagggtgcttagagagtgagggaaatgtgaagaatggggtggaatgaaaaattcacaatagaaaaaaaagtgaggagtggaaagacgaaaaaaagggtggtggtgggggagggggtgtgaatactgaatacatgggccataatgtaactcacgtactggactatagattggaaaccaaatagcccaagatgtaacttcaccgtcaaagtcacagaacacggtttcaccgtattaccccaaaaaccgtaatgaaatgaaaaaaatttgcactcatcgtcattattcatttcatttcagtgtagtcgtaacgtaaccttattttctctttcgtcgtcgacaacgtaaattaccattatagtccgttcgtgcttcctctgttgttgcgttgttctgttgtctcttctttctctttctctcttctagttccatcactgccatgttcttcgaatcccgatccctcctcttcccgctccttttctctctcttcctttctcccgccttcgcttcagagtcagatcacaaggtaattcctcattccacaaaaccctttcccttctttcgattcgatctacactctctttgctgcattgggatttggatctgcctaccgcgtgcgtttttagctcttacttgcactcaatttcaatctcttagcttcggaattttttttttcttccggttttaagattgtaatgtaatggttgtgttttcctagtgttagatctcaactgggtttttggcttgtgctcacctaggtgtctttgcaatgtgggtgtttgctgttcattgtttggccttttctctgctaattagattcaatttgacttctttgtccccttttactagttcatgatcttggatcatctgtttttttttttttaaggttataataattaatgctgagctagttttggaggggatttgaaatgccgagaggctgtattgtgactagtgacgtgggaagtgggaagagcttacattgtgattaggctttggtacctagtttgttgttgttgtgtgcatccattgtcattgaatccatagaaggacccattaagagatgtgtgaaaagagggttgtctgaaattggacagaacagaaaagaaatttcggtgttgtttagaagtctttggttataattgtgatgtcaacatggaagctatataggtttttgttatctatctgtactattttcagtattgtgaagattgatgtggagaattatagccctatttgtgtaccccatttttaagattcaaagtttttaaaacaaatttaacagttgctagtcatatctgctgtctgatggattctttttagaactggaacggttctgatgaaaaaaaattgatctgtaactaattgaatgtatgtaatatgtaggattctctgggcaaggttgtaaatcaaattctaccctaacataagaagtttttaatggtggatcagtttgatttagagtacttaagtaatatttaagatcagcacatcatcttatgagttgcatgtttttttactctaataacattgttatctggttctctgaatacaactggcttcctagacaaagattctagattttaattttctaacataaatttgatatccaattgatgtggacacccattacatgtttgccagaaggtttaaaatatagagttttaagctttgccaatgtgtggtgtcttaatatttctcccagaagactatcatagattatataattgattatcattcagtgaactgaaatcaaattgttaatcatgtcaataacttagtatatgttgttcttctctttttctttctataatagtcagttgtgacgcttatccccacccctatactatatttgttatcctggaatttttccccactgagctggtgaaacagattaaatatgtatatttcatttgtagtatcaaatggtgaacagcttctgtttttaaaaggatgtattttattttgttgcagtatcaacatgatgaaccagttaacctttgggtgaacaaagttggtccttataacaatccacaagaaacatacaactattacagcctcccattttgtcatccatctagtagtgcaagtgctgcacacaaatggggtggtcttggtgaggtcctgggtggcaatgagctcatcgatagccaacttgaaattaagttccaaagtatgaaggtttctgtcgtactatgtatttcatagaagagcagtcggttggcaaactggctttaatggatgctattgtttttcaggaaatgtggataagactgtcttttgccagatagatctcgatgaagcaaaggtgaaacagttcaaggatgcaatagagaataattactggtttgaattcttcatgggtatgttttgctttgtgtgtttcacttattactatgacaattgacaacttgtagaatgattgtactttcaagaaatgttggaagcttgcagaaaattatttctttggtcagtacggtaacatgaagaataaaataaacacaacatcaaaatgtatagcagaagcaaccagaaaacacctaaagtatatggaaatttccaaaatatcttatgcttattctatataaaaattattgtaaaaattatattataaatattatgatatatatatatatatatagtatttttaaatatatgccatatatataaattatatattagtatcttgcaaaggggtaatattgtcatttacatttatattttatatcatttcctaattcacctcaaacatagcaaagggtagcataaatatcatataatagattatttggtgcacatcaaacattgaatagtatataagcttattatggtcttagcctatcctattcttatattttatcttgtctatcaagtaagcccttatagtttttcataagcattctagaatactttagtgagtgttaatttctataatatagtcactattacaactgaaagtattaaattaagaactctgtgtgaagtaatttcttaagtattttcaataacttagtgttaattaatcatcgatattattctgtcttgattgtcataatgttgtgaggattttttccaaaggatgatcttccttgtatgtttttaattaaataatttaataattattgaattctctttcttttttaactgaattacttactagcatctgttcttatttcttttggtctgctatgtgatgcactaaacacaagttcagatgatctacctttgtggggtatgtccagaactgcctcttctcctttctctttatttaatatgattttgtacttaacatgttagtcatttatctaagacacttcttttttcattttaaggatatgttggtgagttacatcctgataagaacagtgataatggcaagcatgtcatttatacacacaaaaacattattgttaaatacaaccatgatcaggttagaagttacttaaatatcttatgctatcttatgacatgttatggatcctttaagtttcatattaaggtctgtttccttgcagattattcatgttaatctcactcaggatatcccaaagcctttggaagtaggaaaacatttggacatgacatattctgtcaaatgggattctaccaatatcactttcgggcatcgctttgatgtctacctggatcatcctttctttgagcatcaggtacagctttgcttttaaaattgaaatggtgttgtttatggttttgtgaattgctatgcattcatccatgttggtcctaccatagctctgtcactgagaattttgctcctttgttttctttttccctagattcattggttctccatttttaactctttcatgatggtcatcttccttactggtttggtgtcaatgatattgatgcgaactctgagaaatgactatgcaaagtatgctcgggaagatgacgatttggaaagtctggtgatggtttcgtgacttttatcttaattatttgtggaatatgaatcctttcttcctagagaaagcattgtggttctaattgtcaaatatttggtcatttcttccatgcttacaggagagagatgttagtgaagaatctggctggaaacttgtgcatggtgatgtttttcggcctcctcgcaacttagttattctttcagctgttgttggcacaggtgctcagcttgcgttgctggttcttcttgtcgtcttgttggctattgttgggatgttgtatgttgggtatgtgcataaccttcaactgactgaagcataagttggctagatgtaataagcatgtggcagtgcttgcacagttggctatttctacttcatactagttggaatactttctgttgtttgctcctttctctttcgttgattatcatgtaagtttccttcgttgcttgtctcaggcgaggagccattgtcactactttcattgtgtgttatgctctcacatctttcatttctggttatgtgagtggggggatgtactcccgaaatggtggtaagaatcttctttaattttctgtatattcgctccaagtgtgtttgggtggctttgtctcggtcttctctttttggttttcaatgattatgtaactaatttttatctgtttgttaggtaaacactggattaaatccatgatccttacagcttctctgttcccattcatgtgctttggaattggatttatattgaacacaatcgctatattctatgggtctctagcagcaattccatttggcacaatggtggttgtttttgtcatttgggctttcatctccttccctctagcacttcttggcacagttgttggaagaaactggagtggtgctctgaataatccctgtcgcgtaaagactattcctcgtcccattcctgaaaagaagtggtaccttacaccctctgtggtttctctgatgggaggactgctaccctttggcagcatattcattgaaatgtattttgtattcacttccttctggaattacaaggtgaatcacggcactactatgacttgtttctgtgataaagtttcttttttacttattggtttggttataaaagttattcgcatgtcaaaagagcagagcattatcaaggaaaataatactagaaactggtctttttaagtaaaaaaaatgtgtaaattttagtggaagctgggtgaaccttcacattggcttatatattttttctttctttgtggcatacaggtgtactatgtgtatggctttatgctgctagtctttctgattcttatcatcgttaccgtttgtgtgacaattgtggggacatactttttgttaaatgctgagaactaccactggcaatggacttctttcttttcagctgcctcaacagctgtttatgtgtatttgtactcaatatactacttctatgtgaagacgaagatgtcaggcttcttccagaccagcttttattttggatacactttaatgttttctcttggactaggaattctatgtggtaagtcttcttcaatttgatttagattttcaccctgcttatgtgattggatatcgtatctagtgctgattaagccccacttgggttataatttatctttaaatgtgcaggagctgtgggttttctaggttcaaatttgttcgtgaggaggatctacagaaatatcaagtgcgattaaggttttctgagtcagacctgagcacttccataggtttgttgctgaagacaataaatttttggaggaagcctctggtcgtgtagggaacctaacaatgtttacaggtagaatccacagggtttttgagaatgaggatgtattatttttctatattggggaagccctgagattctttccccggctgtaattgattatcttcataattttagataagtagtacaatattcaactcttgtggttactgtttcatccccttataaaataggggtcccttgaaggactgatgtctaattccccaacatgggtttcaactattcaatatatgtaaagaggggatgaagtctcggaaatgaattttgtatgaacatctgaatatcattcttatctgcttccttaacttttaaatgataaataatgtttgtagtgtctttaccgtttagtttattattataaaattaacaatggttcgatcttgttgctgctgtgacaactatgagttgctttctgaactttgtggctctcatatgtacgtaattccctacctgttactgaagtggagttttgaaaaccattcaagtagatagacctcttgcatccaatggctataaacttgtttaagtcagaaccatacaaaaaacttgttccatttgaacattaatgatacgagggttgtgccaaccactatttgcgtggtgataaaggagataataaacccatgcatacaatgctgccacgtggcagatagggttggatgcaacttcaccttgttatgtgttgcaagcacactatttccacaagcccacacccttaataagttgtcacaaaacacaaaccaagtgcatagcatattccagtgtttttcatttcattgtgcattcaatggccaccacagcagctctatccggaaccatggtgagcacctccttcatgaggaggcaacctatgaccaccacaagcctaaagacattccccaacgttggtgaatctctttttggtctgaaaagtggacgaggtggtcgtgtcacttgcatggcctcgtacaaggtgaagctcataaccccagaaggaccagtggagtttgaatgcccagatgatgtttacattgttgacaaggcagaggacgaaggcattgaccttccctactcgtgcaggtctggttcttgcgtttcctgtgttggcaaaattgtggaaggtaacgtggatcagtcagatggtagcttccttgatgatgaccaaatagaaagtggctgggttctcacctgtgttgctcaacctaggtcagacgttgtcattgagacacacaaggagggagagatcgaatgatcaatatatatatgatgtaatcttatccattgctattctaattctatctatatgttcaatttttattttgttatagtgatttggcattggctagttagctagctgaaatcatgaagtgtgagtttattactttgtcatatttgcgataacaagtgaaattgttgcaccttaattcattagtttgatgatgcttttcttactgtttatgcacaatagtttttcttaatctttttctttcctctttaatgggtcggggtggaataagagtttaattttaattttggcgattcggaattttcttcatgcaccagttgaatctcaaatatattattcaaattttgtttaatttcaatattttttttttacttcttccttcctttcgttttccatttctttttacaccatttaatttcttcttactttgctgacattctccttgtgttggcttgtggtggtttgttacttgttccattgacttcatcgtcattgtcatggtgggtgttgcaatgacaacgacagacatacgctttttacatatgtgaaatactaatccgtgaaatattaatccgtattgtccatacaaattgacaatccataaagtccatacaagttgtcaatatgtaaagactatacggattaccaatatgtataagcattataaatttttaaaaaaaaattataatgaatttaaaaagaaatagttaaattacaaaaataggtcatattgtataagaaaaattttatttatttatatatgtgtataaatattattacactaataacattaaatgtttatataaatagtgttttcaagtctagaaaatttcaaaataaatttttatattgatttttaaatatataaaagtatcaaaatagttatttataatatatttaaaataataatgaaatatggaaatttagatataaatcattatatatatgtgtgtgtacgcactcttttataaatttcaatataatatattactatattagtatacatttgaatagtttttttttatattttttctagtaacaaaaaaaacaaattgtatgtacaaactaaaaaatttgatgtaccaaaaaaataataaaattgtgtcatactatatcttaaaatatatatttattgatatatctacatacatgttacattagtatctttcattgtttcattgatattttttctcaagtgtaaaagattttaaaataaatttctacattgaagtttttaaaatatatggatttttttaaaataattagaattaattaaaagtaataacaatggatatattttattaagagataaattattattatatgtatatacaagtatcaattattatatgtcaatccgtatgggctatagtatcgaatttcattagtatttcttaatttgtcattgaaatttttttctttttaatgttttgttaagatgaacaaagatgagtgaatatatgataacattatgtatgaagaaattaatatgaatgaagataggggagaggaacctgttgtggttgacaatattgattgttctaatgtctcaagtattgatatgattttctatttagttaaagtaagtaaataaatgtcctaacaagatgaaacatgtattgtccttgttgtaggtgttccctacccatgatgacatattgcaatgggctcgtactgttgcgtatgatattggttttgtggttgtgataatgaggtccgacacatcaactggaaagagaggaaagacctcatttgttttaattgattgtgagaggagtgaaaaatatagagcatacatgatagatttagtacggacgatgactagcactaaaaaatgtggttgtcaagctgtgagcgaaaccaatcctgggaggtgaagggtggatgatcaacttaatatgtgttactcataatcatgcattgactaagtcattgagtggacatctatatgttggtcgattaattgaggatgaaaagattattgttggtgatatgacaaagtctatggtcaaaacaaaaaatattcttttaactttgaaggaccacaatgccaacaattgtacagcaatgaagcaattctacaatgcaagatatgcatatcattcttctataagagacagtaatactaaaatgtaacaattaatgaagttacatgaactcgatatatatatattcattggcatagaatgaaggatgaagatgtatgtgatatattttggatacaaccggatgcaataaaattaagcaatgcatgtcatttggtatggaaggcacatataatgggtagaagtaacaactccaagcaactcaactaacaactccacagtctgctctgtctcatctacattgatgcgtctcatcttatgcttcttgtgtagtcactcctagcaactcaactaacaattctacaacctactctacatctattgcatcatagatatggaaggcacttataatgggcagatgtaacaacgatgccacatcatcaaggctaatactcatctcttctatgggcatatgaaaactattagtttccttgtgtcatctcttcgcaaaagcagacaaaagtcctctgtctcttgtctccaatgaacatgtaatcagagaacttaagctcgaaccaaccactaaatcttcaatttaggtgcaggtcttcctaatttctcaaccttcctcccatgagaggccaacttcaagtcaatatgttcttgcaaataattataattaattaggtaaattaaaatgacaaaaaaattaaatgttataattaaagaaataactacctctcatgtccacactttagctgctacatgatcaacatatgatgtcaacactgatgtatcttagggcccgcctgaaaaaccctatgaatcaacacctaaatcttccgtaactggatcgtgaggctctttggcagcatgatccacatgcctaatattctcaacaacagttacgtgtcgatgttgtcagccttcagtgttaagggcttcttcctcatcaccactaacctgtgtgcctaaagcctgacgtaatcctctcattctaatcataatctaaaaatttgccctactattagtctaatacttcaaatcaacccacaacttcaagaaaatactcttaaattgaaaataaaactatactagtatttattaaatgtagtatattttaagaaatgtagtaaaaaaagtttaaattaactttaaataattaatcaagcagagtaaaatacagtttgatatttgacgagttttaggttaatttcttaaaatatttaatagatattttttcaatttgaaaactttttctatcattaattaaatattattctctcgctctaaaattgcatcaaaaatagcaaaggaaaattatttattaagcatgttggcaagataattgtctttagtatttagtctttttcattcttgagatttttttcctagatctataatctttaattaatggaactaataattgatatcatgtaccaacaaaactaaaagattaatatgaaattatagttgtatctttgataagatcacatagttgtacatttcaaatctcttatttaaagtctgtttaaaagaatttatttgaacttattttttgacaaacacttgtgtaaatatctgaaagtttttatgaaaatagattataatatgttaagctatgtcaaatttatttcaataaattctctacaatagcttttgaaaagatcttacaacttatatgaaacaattaatttaaattattttcatgagtactcattcaataagtctttaattaaattgtttatccaaatgaatcataattatatttgaaaatttaagtgttaatacaatacaaattcattaactataattttttttgttttgaacctatacagattgacaatctgtatgacccgtatagatcaatatttcgcaaatgtattgacaatctgtatgacccgtatagatcaatatttcgcaaatgtaaaaaacttacctccgatgttgccaccgcaacacccaccaccaccacgacgaagtgaatgcaacatgtaacaaaccaccacaacaatgtaactaacaaacctccaagagccaatggaaggaggaggtcagcaaaataagaagaggaaactgaatggtgtaagaagaaatggaaaacgaaaggaaggaagaagaagtacaaaaggacaatgttgaaattagacaaaatttgaatggtgcatttgagattcaaatggtaaagtaagaaaatccctaacaattggcaagtaacatgactagcccaattgtaatgttttgtgtataggttttgatagtaattgaacaaaatatgggtgaaccatatctgataattattaacaagagaagtgataggaacaatgttaatatatattttcaattaattcacatcttctcaccatattattatttcttttgtcaacaatactctttcaagtaattcatactctttataaaaaaaatagttaatttagttattgatataaaatttgtccacaattttgaatatatgaggacatacaaacataattttttttaaataaacttgtatgactatttgtcataacatgacaagttaataaattatcaacgtcgttgttaagtcatcatttaaaattgttattacttgagagcaaagacaaaaaaaaaattaaggatttaaaatcaaaacataggaaaaagactgaaaattatgatggtcaaaataaaagagatgtgaatggaagagtaagagagagatggaaagaaagaaactaagttaataaatatgataaattacttaaaataataataaaatagataaaaattactaaaaatataatggaagaaaagttgaaaaatgttaagtgtccttataaagtttaaggagaaaaaacataaatgtgaaaaatgttcatgatgttaaaaatagattaatcttttttccttttattaaacatttccacgtgtatcggagagagaggggtaactagaagagagcacgaagttccttggttccatgcaaaatgtctccaatctctcggtctctccatcagcttccacctcaccaatctctttctttatatatttgtttataattttgtcctcccatgcatggatttcgtttggaatatgccaattcaggaaatgaaaaaccaagagagagatgggttccaaacttcttccacgagatttgccaccattttaggcctaaaaacctctctcctgcttcttctggacgtggtgttggaccatgctctgaactgcaacattgttacatgaatccatatacacacaaatttcctttcttttcttttcttttccctttttttacttttatttcttatcattggcttctgctcctctctttgtcaaagatgctgacctctgagaatttgttgaagaggcatggtttccttacaaccaaaagatgatgatgtgaaataactgaaaggatcataaggtgatcaacatgcatgttatatatttttgaaaccattttccataatgctttttgcatctagaatttggattttagcacctgaaaacaaagtgttctaatttagaaaacatgcatcttttttgagttctcaggttgaaatggattgtcatggtggtatttcccaaagctttccaaacagggagcatgaaggccttaatggaccggttttcttacatggtgacttggatctgttgataatagaagccaagtctcttccaaatttagatttatccacggaaacagttagaaaatgcatcactatgggcaacatgtgccaccctccatttataaaaggactaaagacacactctggaaaagacaagatgataactagtgacccttatgtttctgtatgcattgctggggctaccattgctcagactagagtgattgctaactgtgagaaccctttgtgggatgagcaatttattgtgcctgttgctcaccctgctcaaaaacttgagttccttgtgaaggacaatgatattcttggggctgaactcattggagtggtggagatacctgttcagaagataattgcaggaaatactgttaatgattggtttcctatcattggtcagtatggaaactgcttaaaaccttatcctgaattgcatatttctgttcagtataggcaaattggagtgaaccgttcagaaagtattagtagtggggatggaaaagcattaggagttcctaaaacatatttccctctcaggaaaggagggagtgtgactctatatcaagatgcacatttacctgatggtatgctacctgaaattcgacttgagggtggaaaagtgtttcagcataataaatgttgggaggacatatgccatgcaattttggaagctcatcacctgatatacattataggatggtcagtttaccacccagtgaggcttgtcagagaggcaacaaaaccattgccttctgggggagagctttcacttggagagctgttgaagtacaagtcacaagaagggctccgagtggttatgctgatttgggatgacagaacttcacatgacaagtttcttttgaaaacagtaattctcattaccctaatcagaaaaataaacatgatgtcaattgattccctcatcaaattctagggaagttagttttttatttgtcctgaattattgcactgctttccaaataaattcattatattactttcataccataaagtaatacaaagtaaaagtcctatttagcataaaattgggtgggttctgaagtaaaagatagtggtgatgtatcttctttatgggggtggatttgcttagactatcttgtatatgcaccattaacattcagtaatgagatgctaggctttcaagattcctaaaatataagttttagcagatatttccttcatggattattgtaatgtagatatggttgcataaaaactttgtacttactcctgttcactaagatttaatattaatgtacattataatatttgattttcttgattgcaggatggtgtcatgcagactcatgatgaagaaactaagaagtttttcaaacattctactgttcattgtgtgctatctccacgctatgcaagcaataagctcagtattttcaagcaacaggcacggagttcttgcatttgagtttagaattgtgttggataaagatactagctatttcatgtcaccatcaatgtcattatttcttccctggaagacttgcatttagtagtagtcatagatataatgaggtcacgttgtgtactttagctataactaaaaacaatactaatttgattgaatcatctggtccaggttgtgggaaccctctttacgcatcaccagaaatgtgttcttgtagacagtctaggttctgggaataatcggaaaataacagctttcattggtggtttggatctatgtgatggtagatatgatacacctgagcatcggctttttcgtgatctagatacagtctttcataatgattttcataatcctacatttcaagtaagtgtttattgtaaacattgaagaattcacaagaatatagcatgccttctcttttattatactactagggaattttataaaacatatctttatgtgcatacagtggaataaagatactaataccaacttctggctttttctgtgttctgatttttgtcaacaataatgacaacaagaagcgagagccttgcaactggggtgggcttggtaaatagattaaagaatgatgctgtgctctaaacaaaaccaaatatttatttctgattttgcttgagttttcccaaatcttcttctttgtctgttaattttgataaacttcatttgctagtttatctgttggtcctcaatgttgccttatatggtgattttgccttatgagagtgttcatatgtcattataaaatcaattatgtcaatgtttatatacacatagtatatgctatggtttgatattcacggtttttatgggtgaaagtgagaaggaaaacaaatgcacacatcagcaccaaataaaggagaaaaaaataacataagggaatttgctgaaattgtgtgctatatgaaacagttacattcaaattcgtgtgcaccaaggcagccatggcatgacttacattgcaaaattgaaggtccagcagcatatgatatattgaccaattttgaacaaagatggaggaaggccaaaaaatggcgcgacttcaggctcaaaaaggtgacaaattggcatgatgatgctttgctaaggctagaccggatttcatggattgtcaaaccttctccttgttccaacggcgataaatctgttcatgtaaccgatgaaaatgatccagagagttggaatgtgcaggtatggaaatatgttgatagaatctgtgatgtacacgtgcccctgataaaatcaagtaaagattatgaactagaatttacatttaatacagatatttaggtccatagattcaggatccgtgaagggatttcctaaggatgttgacaaagctaaggctcaggtgagaacaaagttatacgtgatgcccctttatattatgagttcttgttattttcattaccttcacattggggtgtggtttcaagtcatattgagataaattagtccttaacttttaatattaatttgtttcagaatcttttttgtggaaaaaatttgaaagtagatcaaagcatccatactgcttatgtgagagcaataagatccgctgagcactttgtatatattgagaatcagtattttttgggctcctcctatcattggccttcatataaaaacaatgcaggtagataaacttaatttttctatatcttcaactttataaggcatttgctagtttttgcgttgttacaaaatcaaaattctggcgtttaggtaatgtacctatatatatgtctcagacccagaacatataattgtgtatctatgaaggaacaaccatgacaggttagtgggaggcacatgaatatacaacaaatcatttgtatattaatcctgttaagtgtcactatccaagataaagacttggcattagagggagttttggatgttaagagaggaagttgaaaattgaaagaaggatacacttgtttttttcagtaaaagtcaataaagtctatggttcatgtgcgagaaaaaaggaggagataaagacataagtctgcaaccttgcattcatttccatgttagatttcttatcttagagtttattaggtaaatatggtgtgcaccaaaaggtgtttgaagggcttattattgctttattttttctctttttgtaatattgttttcaaatgcctgcatacattatacaaattcatatttcttgctaacatttaagggaactatatcactctcctgatcctaagtttcagtagcatttgaatattaagtcaatttgtgagatacacattgctgtagtttttacaaatacactgcaagtgtaaggtttttatttcttatcttaacaggtgcaaaccacttggttcccatggagttggctttgaaaattgccggtaagattggtgcaaatgaacgtttttgtgtatatatagttataccaatgtggccagagggtgttccaacaagtgctgctgttcaagaaatattgttctggcaggtcagaccaatttctattctgtatattcccttgttaaaatttgcagatgaacattttcagtacttttcatgtgagtctgtctaaattaggaagtcagtttggtagaacgtgtttcttccacaaacttatatattattacctggtaatggattttttttgagggaaacgagtgcaatgtggttaatgataatccacaatcactgcaaacttgtccaatgcaacagacttattgtcattaaaattctactatgtaccaaaaaaaaaaacaacaaaaaaattccttcaaactgttctactgccatcctaaatcattttttcgttcaatttatatattggcatagacttatttttttctttcaccttcaattggttgaagaaaatgaactcacaaaccataaggggaaggatgaatctggggtttgatattcgcaatatttaatagatgtacataacataagtgacacaaatttatgaatatcgttgaggcctggaattttgttaacgagttgtcctgaattatgaggccagttttttatgtacttccttagaatgtaaatggatttatcgacttgcatgttagagtaaaaatagggatgttcattgtttcaatgtttgagactcaattgtctgtgatgtaggtcacattagctgaaccacaataatatatgtattcttttctttttatctctgcgtttttcgtttattctttggcataacaaatatgattgaagtgtacttatcacaacccatgtatttgaaatttggatgactatagggacagacaatgtctatgatgtaccagattgtagctgatgcccttgaaaaagcaggtctctctcatcagtatcatccacaagattatctcaatttttactgccttggaaagagagaaccacaatccacaaatatttcaccaacaccaaatccatctgaaaatcgcgctttggtatgctaaacttaactaccatttgtgtttccatatccaaattaggcattgcatgcagtttgaaatacttattgaacagcacttagaattcttgacgtgctcattatgaaaacacaagaatttaattcttgtcacaataatgccttcatcattcatcagaatagttatagcaacatttgaattctacaaattgataacaacttcgacaataggttgtgcctgctttaccttgtgtactaaggcttaggatcataatgcagaaaaaatcctgcaacaacttataatttattagttattacagcgtaagaaatttactaaaagggtacaactcaaaaatagacttaatgatctattaaatttaaaatttttcatttttatcttttatgtttttaaaatatatcattttatactttttcagtttttcatttaaaacatttaatccaattagtattttaaattttaaaataattaatttaatacagtaacaatttttaataattactatctttattttattttaaaaataaaaaaatcctaatctctgacctttttcctttcctaaacaccaacaaccatccttacccaccgtcgcgggcacgcaccacagccaccttcaccaattccgctcgcaaccctaaccccctatacccaccaacagctatgaacacaagaacaacaatgaacacaaaacagagtcacgaaggttgcgaaagtatgagcggttgaagttcaaatggcaatgtgcgtgggagaaaagcttagatcaaaaacaaagaaactcagatctgaacaaataaacttagatcctgcgcgtttggttgcgttgttgcttcatccggcagccgagggtgtgctgcagctcttcacggtcgcgctcgtccttggtgacgaagaagctgcggaggatggatcgaacgacgtgacaatcgtcgtaggtgaagcagacggcgcggagggggagtagtaggcgaaggcgatggcgcggtcgaagtccgtcggtggctagacaacggaggtggcgacgctggttcagattggaggatgatttggatgtaatggattgggatcgctttggacgcaccattgcctgtctcttctgtttataattttttggcttaatgttgcattatcaaaaatatatttattaattaaaaggatcgaacatgtaaataaaaattaaaagtatactaataatattttgaaatgaatgaaaaagatttgtattggtaattataggattaaaaaaagaaaaaagaaaatattgacagtatattgttgaaaaagtgtgttcattcacattatataatctgtaatttcattcaaccaatcccaaggattgagtatatccctaatttgtaattggattgtgtattagtgaatggagctatgagtatccctagggttttctcttgagctaattcaaactaatcaattgtaagcattacagtggtcatggtgtctcatgtctggctacatgtaagtattaaaatctccccatagtgcatgattgaataatgggtggtctgtcttacccattcattacccacctatgattggacaaggcactaaatagaaattacaacgtagttgaagtttgaattccaagcacctaatcttgatgaatccttaataagtcctggaaatcacatgtctgggaggttaagtgtatataaacatagcagtgaagaaaattgccatataataatgtgagattcttacttataaatggtttttatgttgccaaagcaagtttcatacatgtgtgatgagtaatgagcaaggtggctccttctcgtctagcaagaatgaagttggtggagattaaagtcccgaccttcatatctatatctgtgtgacttattagtataaaaattaacttaaacataatcaagattgcaagcttagattaagttaaatttataaaatgtttattggtcttctggatcaaattccttggatggaaaatacaacttcaaaaaggaagaaatagaagaaaatatttccttctgattttatcattttcaacatttcacacagatattccataagtttgtattagttttctcaatgaaatatatgcctagtgccaaatgatcatggattatctaccaaatgaatatttacttagttttgaataaattataaaagtgtcagcattatataatggccattacatatttacatttgagaagtaatcagttggtgcatgcagatccatttgcagactttttctatttatgtggtgatagtttatgatcttattgttattttttccctttctataatcaggtatcagttaaaaaattcagacgttttatgatttatgtccatgccaaaggaatggtagttgatgacgaatacgtaattattggatcagcaaatattaaccagagatccttagatggttcaagggacacagaaatagctatgggtgcctatcaaccaaaatatacatggacagaaaagaatgctcatccacgtggccaggtttgaagctccagctacgtttgttaatgagctagaatagttgtactagataggaattgggcatattaatctaagataaaagtatgtatgtatatatatatatatatatatatatatatatatatatatatatatatatatatagcacatattgcaaacacacgaaataattagacactaccaaaaaaaaagttaattaactaaatatttatgtgtgtgtgaaagtataatcttgaggttccaatctttgtatcagcccaaagtgttatagagccaacccaccattaaatagtttatatcttttggataaatcatgtatactattttatcagaataaatcattgtaagcataattgatgacaccctctcatactagtggactcgtagcataaactcagatctgtgaatagatcttggttatgtaatttcatcttttcttttctcagtaattggcaattccctcaaagattgtgttggtgtaggtgtatggatacagaatgtcactgtgggctgagcaccttggtagtcttgatcattgttttgctgaacctcataacctggaatgtgtcagacatgtcaataaaattgccaaacgaaactgggacatatatgtgtctgaggaagagaatcggatgaggggacacttgatgcaatatccagttaagatcagcagggatggaaaagtcagtgcacttgatgattatgaatcctttcctgatgttggtggcaaaattcttggatcaccaaattcacttccggatgcactaaccacctgattaaccaaaggaagtcttagaatattcgcctactgatatagctgctaagaattgcagctcaaaaaattggtaatgatggtaaagccaatttatagacttaaaattaccttttgtatgtaaatttctgtatttgatagtgagtgcatagatctcttttaatatatatatatatatgcgggtgtgggatgaactgggtactagactaatagtactcgttcctgcatccatcccattaaattttgctgtaaatacccagaccttgatccattcccattgagcgggtacccatagagtctgggtataattaatatctatccctaattgtcatataaaaatctttagactgacaatgtatcaaaattaagctctaaatgaaagtagtataatttaaatttgtagctagtatgaactagatgtatcgagtgcttttgctattcataatcgacttgtctgtacattaaggacatgtaagtttttgtctcacgcaactgattagaaatggattccaaccttcctgcacagttatatttaccattgcgggaataatagatacattatggtcagagaacaatcaagaggaattaagatggagcttggaaaatatagatgatgtggtcacattctgcatgagtgctctaatttcctaattgagtctgcttttgatgtacttggttggctggtgcattgagagtaacatttataatgtgttagcatatgcgcatatataatgccaagggtaagcagagtagtagattcagttgatgcatgaaatgtattttttggatcatggattttcctttcacgtgtggcaattaattttaatttagttgctactttggtggctttttaatatacgggatcaacatgagtaatggaaaaagagttgggaacttaagatattcttgctgcatacatgacatcattgattatgcataacatgcggttcttgtatttctgtcccctatactgtaacctagatatgatcttcattcaatttgaagaatttgaagctgttaagttaggatttaaatcttggtcgcgattcctatctaatgttcagaattcaatgttattttacatgaatgagaaatttttcaacatgtttcttttaaccaaggaattatcttataagaggagtgtgttgctaacatttttctcttaaataaatttgagttaattttttatatttggttcctttagtttggattatctatggttttgtttctttaaggtttttcaagtcaaataaagtttttcactttttaaaattaagcaaagttggtctgttcattttatttaaaacccttattatattttttatttaaaatatttaaatcaattaaattgtttgatttttcctaaattcaacaagttttacttaaaataaataactcaattctccttctttaatcctaattttacaataatttttttttcaagttttctcatgtttctactaaattttaattattaaatgtttaatcatttgtaaattcctagatagtaggtgttttaggtggaagtaaaatagaatgtatcaaaaaaaggtggaagaataatagataggtttaaatttacttaattttaaaaatagaacgtagttcaacaagagggaaatgtgaaatgcgtcaataaatgattaaatctttacacacaaactcaacaaaaggattttgcaagatttatttcaaatttcttgatttcttttattcttaatatgtatccaaaaaaatactatgacgttaataggcaaaagaacccaaataatacatttttaataaaaaattacgcatttggggtatttctgaaacatattacaaatctggggcagttgaacacgtccagcctggactggagtggtcacgcccagattaggcatgaccggtcacgcctaatctgggcgtgaccactccagcccaggctggacgtgttcagctgcctataaatgcctcccggaagttactttttaccatttgttatctttcaccttctctctaaagctttctctagtccatctctctaggatttgtgagagattttcctctgcagcgaagctctgtcagttttcgagtgatatacgtgtgtttaagctctgcgaacaagtaagtaaatttactattcatgcatattatttaaaatgttatattattaaataatagaattgttagggctatacgaaattgttagcaactgttaggtattattgtagttgtagaaaactattaagtatatttagtgttgttgatgatttaggcttagggtattgatgtgcatgatttagggtagagggtgtaggatctatggattagggatcaggggtaatggtttagggtttacaaaacctagggtttagttgtaatgggttagggttagggttgacaaaacctaggtttagtgtttagggtttacaggtaatggtgtagtgtttacaaatgttaggggttagggctgactgaatgtatggtttagggtttacgggtaatggtgtagtgtttacaaatgttaggggttaaggctgactgaatgtatggtttagggtttagaaaatgtattgtttagggtttagggttgggggtccaaggattagttgttaaattaaaatgatatgataatgttttgttagttcaattttagggttttggttttacaaagttaggggtttacggtttacaaaatgtagggtttagggttgacataattgttggtttagggttcacaagttttaggtttagggttgacataaatgggggttcagtttcacaaaatttagggtttagggttgacataattgttggtttagggttcacaagttttaggtttagggtttagggtttaggttatttagggttttgggtttacataaatgggggtttagggttcacaaaatttaggatttagtgttgacataattgttggtttagggttcacaagttttaggtttagggttttgggttttgggtgttgggttgatataagtgttggtttagtgttcacaaatcttagggttgaggttttacaaaattgggggtttagggttcacaaattttagggtttcgtgttgacataaatgggggtttagggttcacaaaatttagtgtttagggttgatataagtgttggtttaatgttcacaaatcttaggattgaggttctacaaaattgggggtttaaggttcacaaatttagtgtttatgttttacaaaattgggggtttatgttaatttaataattttaagctattaatttgtcaattattatattgtttcattaatattaacattgtcatagatggctgattcatctcctgattcgtcacggtccggttccgatgatgaggaccagggtatggatccgacgacgcatgttttgcccaccccatataagtggggggttctgcggaggcgtacccagcggacccacgtttcacaggccgtgtggaacgaggacagatgtcgggtgctaaagacacgacgtggcaaaattggaggggggccaaagtgtgacgatatacctgacatggttgggtggatgttaggacaggctgggttcctgcatgttgcacgcatgcaacatatccaggtatccaattatgaatttaagaattgtacatatgaattgactgatatgaatgttttcatttataagtataaatgcaaattgattaatttcgaacttgtgttcagatcgatgctgcactgatcagtgctttggtggagaggtggagaccagagacacatacattccatatgccgcaaggagagatgacgatcacgttggaggacgtggctgccatcttaggtttaagcagtcacggccatgtcgtgactggatccacgtcagacgagtgggacaccattatcgaggaggtgttcggtcatcgtcctctagatgctgagctaaaaggaggatttttgcgccttagttactttgataggatttatgaacattgggccgacgtggatgatgatgatgttgtccaggtgatgcggttttcgaaggcgcacattgcgcgtatcattggagcatggctaatatgcgaccgatccgggggaagcacaatcgcctgtcgctatatccctttgcttgcaggggacatgggggatataggtaggtatagctggggttcggcggttctagcacatttgttaagacaaatgtgtgagtgtacagatgtagacagaagtgacattggtgggtgtgtcactcttctgcagatatgggcatggatcagattcccactcattgctccagctattcctgatcatactcagccggcgtggcattacggccacaggtatgtgttgttattttgttttctttactgagtatgatatttattattaactgttactagttgtgtaatgtaacttattttgaaaataggtttaacgctttagcgaagttccaactacatgagcttcattggcatcgagagagattagactcccttactcgggatgaggtacataatgttctttgtattactttggttgcttagattggatcatttaataattgtgtgtttcattgttttgtttaggtggtttggcaaccatatgcaggctaccactttcttgatgcatctgacgatgacagactgttgtggatggctactagtccaattatatgcttccacacagttgaatattctcatcctgacagatgtatgcgacagtttgggagggatcagccaatcccccgaaggcccaggaagttgaaaggtgtgcatgatctctccctccgaggcaaacaacaagataattggttgcgtaagctcagacccttcatacagcgatgggagcagagggcccagcacatagagctgccccccttactgactggcttactctcaccaaaccatgagtacatggtttggtatagggagaatgggaagcgatacgtgacgaagatggctgcgaagttgggtcgtggtgtaagtgttgaaaaataaataataaaattggtttgatgatcatgctgttatgtagtgaactaattattttgttttctaatttgcagattgacgggctagagatgatatattattccagttccggggagtggccggagttcacgatgggttacttgcacgaggaggtgggccgcattatttccatgttccgagagagctgtcgattggaggagctaggcccagatgcaccagcatcgcagcttcagcgtcagccacaggtgtctttgaatgttccccgcgggagacaggaggggcatgggttagagcgtcggcggaaagtcatgcaccatgtccctgaacccattggagttcccaggcctcgcactgctggtgtttttaggcctcctgtgataggatccacatacagtagccagcctttgtattatgaaggcacccaccagggagacatgggccatcaagggttcactaccgaggattacgttccaccaccatctcacccccagccacaagatgtcttctgtgctactgctatggacatgacatcagaagcttgtgggaccagtactttcgaccgtagtccggagtggaccgatgctgattatgcgcgcctggctgatcagcttgattgtactccagcaagtcttgaggtctaccctccacttccagactatggcaccccacctccttcttatccccagccagcatcaccatatgagggagctccatacgcacctaccgatgttgtccctcctcaggctacctcttttgaggctggtccttcacagccccaccctagtgagtcaggcccgtctcaggtcaggcctcctctgcgccgtagcagacgcaggctgccggatcgtcaagctcgtcatcagccatggccacctccgtcttagttttgtattttgtttgtgtatatattagttgagtttgtaactgactttattttatatttatgtcatgtaatagactttattttgaagtgtacgtttgttgtgaatgaatgaatacaaaataggtcgttagtaaacacgataacatgtacgccgtaagtttacaacactaaataatgcggttttagggcaaatttgtaatacatgcaatcaaatacattaacatgtgacaaaagaaacatttctacaaaatcaggaaatagcatggcgatcgggacaagctctccgattatgtccgactagcttgcaaatggagcatcttgggcgtccttgagtagtttcaacttcgtccatctcgttacgtattctggtagactttggacgaccctttccacgtaacattagcctatcaggtatgatgattggaccttcgcttggtggaattgcacgttcattaccaattggttgccatggcaatgaataagcctgaaccaagttgcttacaaggaacacatcatccacaaactgaagaggattctgtcgaacatgtaaagcagcagctgtggcatgactacatgggtatttgaaggccttaaacttaccacactgacaataacgctcgactaagtttaccgaataagacctttcacaaccgtcttccacctcaaatgatgtttgatcaacattatacgtgcgtacatggtggcctgtagcaactgtctgattatgcctcatagcatcaaccacatttttgcaatgtcgtactgaaggatcaacttgtgaaatagccgttgtacccctcttcacaaaatattcaactaatctgctgtatgtgtgcttcaccagagctgtgataggcatgtttcttgctcccttaagcactcgattaactgattcagacaagtttgttgtcatatgaccaaatctcctcccttcaacgtcatatgcacgtgtccacttttccttggggatggcatcaatccatgcggcaacctcaggactgctatcacgaaatcgtgcaaagtctgcctcaaaatgaatcaaacaaggattgtaacctgcaaaacagtcatactattaacacttttctgttgaataatttatgtatttaatagattgaaaatacttgttaaccatacctaaattcataagggccttcttcaactgttgatttctgaacttttgattaaaattactggcaatatgacgaaggcaaaacacgtgatgagcaaaaggtggttgccaaccacgatgattcgccacagcagatagtatgctccgatgcctatctgaaatcagacatatgtctcgtctttgtgtgacgtggagacgaatgttagcaaggaaatattcccaggcttccaaagtctccccctcaactattgcaaatgccagtgggagacattcattattgccatcctgagttgtggcaatcaacattttacctgtatacttgccatacaaatgtgttccatcaatctgaatcatgggtttgcagaagttgaatgcttcacaacactgtctaaaagtccagaacatgcgatgaaacacacgctttgtccgtaccaggcgatgtgccacgaaataatcgttggtttggatatcataaaaagaacctggggaaaaacgaagcatgtggctacaccacctgggcaaaaatgcgtaagattcttcccaatccccataaatcattgccattgctttctgctttgcataccaggccttccgatatgaaactttgaatccaaatgaatggctgatcctctcccgaaccaatgaaattgacacagacgggtcctccttaatcattcctaacaaagaaatagcaacactcacatttacgttatcaaccttaaagaaccattattgaagacatatacacgaaattaaatggtgataaaaacatacctgttatatgtgaagcaataacatcagcatcaagctgtctatgaccctgtgtaatatggtcattcaagcaattgtggttgccaccccaccttgaaacaacccacttctcaccgtacgttggtttaatgaccctaaccctccatggacaaccatcattatgagcaatacacttgtagctaaacttgttaggcttgctctcaacaacatatgcctcttgatgctccttcatcaagttccgcttaattgcaatttgtgcgtcctttttagagggaaactcctgtttaacaaacaatggatcccctaattgccatggaccctgcactgaacctgaagccgaacccgaaccggaaccagaatcgcgaaaagagtcttcttcgcttggatgactccaatcaatatatgtgtaatgcggaattccatcccaaaaaggaatgacctcaccaccttcaaatataaatcaattcaataaccatatgatggaaaacaaaatacctatacacacatatgatagaacttcatcatttactacaatcatgtaacataccttcaacaggtgcttctgatcgcgtacgtccaacatccgcatgatcatggatttgagacgaccctacatcagcgtcttcttggaatccagtcgcatgcacaccagcagcatcatcattatctgacccactaccatcctcctgaataagacgatcttccattgcgaaaatctcatcatcgtcatcatcttcttcttcatccatgacccaagttgggtcatgtgagtcttcctcagacacgtgtaaaaatggagcaccatgtgatgatgcattacgcacacggtttgaaggaactctcctcactggtataacatcctctgctccagtataatccacgtacaactctataaaatctgggttagcctgattgaaatattcttccattaaaaattcaatgtcttcatcatccgcaagctgaaaacccatgtattgttcacgttgccatgatcttcctgtaagcatagtgatatgttggttgtccttcaaacctaatttttgtcgtatcttctgatgcaattcaatcagtgttgaccttctattgatacgtgtccgcctcttgtccccttcaaaaacaataccgcgtggcccttcaactttccttccattaaaaaacaagacaaaacaagcaaactcctgaccacctgaactcatctcttccagtaaacaaaagccaaacttttcgattgacctgcctttgttcacataaataaaaaaaatattgtgttataatacgttcttataattactaataaataaattaattcataaaacaacataaatacatattcatacacctaatttaacaaaccctaaaccctaaaccactaaccccttcatgctaaacccctaaaccattcatgctataaaccattaccctaaaccctacgtcatacctaaaccctaaattttgtaaaataaattacatttcaaacctaaaccctaaaccctaaaccccttaaaccaaaaccctaaattttgtaacataaatttcatttcaaacctaaaccctaaccatcaaccctaaaccctaactgttattcttcatccctaagccctaaccttaaccgaaactaaaccatacactgtaatacctaactgttttgatacaaacctacttaaacctaacagtcgctaacagacgctaacaatcgctaatagtcgctaacagtttaaattacaataatataatatattaaataacatgcatcaaataaattacttacctgttagtagagcttcaacactatttgaaaaccactaccaaacgcgcagagcttcgctgcagggataaaaccttaaactctaacacaaatacactacaggagcttttacaaataaactgaatcagcacaagtgatggaactgaagcgcggaaggctatttaaggcagatgaacacgtccagcatgggctggagtggtcacgcccagattaggcgtgaccagtcatgcctaatctgggcgtgaccactccagtccaggctggacgtgttcaactgccccagatttgtaatatgtttcagaaatgccccaaatgcgtaattttttattaaaaatgtattatttgggttcttttgccgacgttaatacgtaaggattcgtaccaaaagtttttctatcaagtagctatgttgatttttagttgatcattttatataacaacagtaacaataaaatgatgattgaggtatttaattaatactagaaggatatatattttaagttatttttttattttgaactctatataaatttcttaggacgttatattttaatactaaaactctgacattccttttggaactttgatccctttttaacccataattacaccacagttctacatcaccacgcatgtcatataatggtcaaatcgagtaattccttttcttgactaaaatcttaatcagattgtgaactaaaagcatattgcatatttgaaattactacatgtcaattcaactaaaaatgtgatcaagactttaaagaaagataaaagaagaaaatagaaacgtcggagattaattgtctaagattgattaaggagtttaacaacccattaaagtaagtgaaaactttgaaaatattaaagaaaacttgagaaattttcttaaggtagaaaaagttgttcaaaaataaatttttttgtgtcccgtaaatgtaaaaaacaatcctatttttctcgaagaaaaaaactatcctatttaaactaagaaaatttgtgtttttagttcttgtataatttttagtcaaaaaatatcttaatttctatgcttttaaactaatgaatttaattcttgaactcttagaaaatataactttactagttcttatttattaatttcattagtgagtatgaccaagataacatgacaaacaattattatttgtgacagtcataaaaatctaattctcctaaagaattattatttgtgaccgtcataaagatttaattctcctaaagaaaaataatactcataatatatttttaaattttttgttaaaaacatttttagtctttttattattgttatttttaaaatttatttttttattataaatttagtccatccaccattttaattgtataactttaattcatttattagtttaatatttaattaaaatacagacgtggcactaaaatactaacatagatgtagtattataatgattttttattgtaattattcttagttgcgaataattctcgacattttctgttttcaattatctaataaattatttaatagaaatagactctttttcatttatttcaaaatgtctagatttcttatatttctattcatttggttctcacactcaattatttatgaaaaatattccaattttttatgtaatgaacctattctctctttgctatatttttattttattttaaaatattaaaaataattaccaagaccaaaatattctgaggatagataataaaaaaaacaattattttgttttgtcatcatacaattatttttgtatcaaagataaatcattattaatattatttttaagataaatattataaaatttaataaataaatcatacatgataacttaataactttatgtttaaagtcacttttaattcatatgtttcataattattttatttttgtatattaagttttaaaagtttaattatgatcttttatttttttttaaatatatcattttgattctttttcaattttcccttaaaaaaattattattttgttaacttttaaatttgaaattgtttaatgtaattagtaaaaaataaaaataaaaaatgatatatttcaaaaatataaaagaataaaagaaaatatttaaaatttaatataacaaaataaaatatctgtaaaatataataaataaaaagtgatattaaacgataagttttttaagaaatttaatataaaaatggttgttttctaatgtataaaaaaatacaaataacgataatcgagtgatggagatgcagttactaataagtaataacaaacttttttatttccacacccattgactttggatttgctttggtcggtgggtcaataattaaagccgtcccaaacataaaaacaaatagggagtgtgcggcagaggaggagtgtcgtctcctttatggaggatcaaagcagagaaggtgaaggtgaaggagaagaagaacaacaacaatcttcactcttctattattattattattattattcaatttaatcatttaacaacaataataattttgtttaccaattattattctcaatcacaatgggaaagggtcccttcttccgccgctccacctctcgccgccgacccaagaagaacgccgccccgcctcctcctccgtctccgccgcagcctccctacgcggccggaatcgcaacctcacccgacgacaacaacaaccgtcctatcgccgccgccgccggcagctgcgccttgacgaaggcgaagaagaagaccggcggcgcccgcttgtggatgaggtttgaccgatcgggccggtcagaacttgttgagttggagaagaacgccatcatccgccacgcagcgattcccgctagagacttgagaatcttgggccccgtcttctcccactcctccaacatcctcggtattataattttcccctttatttttgttaaaactcaatccagagaactattcattcatttccttcatatctgctacctcttaaaaggtgtatttatacaaatattaataacaacctaaacagaataatttgtaacagaataacaactttcctctaatctaaacagaataacaactcacaaaataataggtaactgaataataacagtatttcaatcttcaacactctcactcgttcatggatatctatcatgtccaacttgcaatgatttcttcaaacactttttctgagacagcttttgttaatacatcagcaagttgctcctgggaccgaacatgggaaatctgaaaatcaccagccaagtctgagtctgtgtatccttcaatgcacgctatattattttaagacctttccatggagaacctttgagatatctcaaaatatgatacactgccttcatactctcttcatcggagagtgcatgaatctacttacaatgcttacagaatatgtgatatcaggtctagtatgtgataaataaattaattttcctaccaacctttggtatctgcttttatctacctcaacctgatccggataaatacccaaagaatgattcacttccatcgggtatcagcaggcttgcaagccatcaatccagtctcggacagaaaatctaaaatgtatttcctttgagacagaaatataccctgttcagatcttgcactttctatcccaagaaaatatttagaggacccagatccttcatttcaaattcagcagctaatttcttctcaagtaatttcattccttctatatcatcccctgttagcaccatatcatctacataaacaatgagtattgttaccttccctttgttatgctttatgaacatggtatgattcgagttgctttgcttttaaccaaacttcttcattgctaaagagagccttccaaaccatgccctgggtgattgtttaaggccatagagagccttttccagtttgcaaactacattctccgttgaaggagttagcttcactccaggtggaacctccatgtagactttctcttctaaatcaccattcaaaaaaccgttctttacatcaaactgtttcaatggccaatctctatttgcagcaatggatattaggattctgattgtattaagtttagccactggagcaaacgtgtcttgatagtctacttcatacctttgtgtgtatccctttgctacaagccttgctttgtatctatcaatactcccatctgcttttagcttcacggtgtatacccatttgcatccaattgtcttcttcccactcggtagagaagttaatctccaagttttattgtgctgaagtgcttccatctcaatgttcattgcttgcttccttctaggatcttccaaactgcacactcttaggaatatatacagtagataattgatcaactgttagagcatatgatccagatagcctatgagatgacgcataattactaataggatactttactttcactttagggtctggttcataaacagttttgggtttgcctttattcggtctctctgattttctgatttgaatactattaggagcagcacaaattgaatgatctgtactagggacaggaatcgactcagttctgggttcagaatgtatttcagaattatgtacaataggtgattcagttaggcatggtgtctcatgggataaaggatgacttgcatcgttgagatctgcttctggaggttcacaggttacttcaggtgaagagttttgaggagaattagtgtttgtgagctgatcatttgtggtggaaggtattggagtaggaactgtagaagtagatagccagaattcttcttctctattgttctggatctccccctgagaagaagaaactccccttgaataaagaacttcagtttccctaaaggatacttcaagggcaacatgcattttttgggttgtaggatcaaaacaacgatatcccttttgaaggtcagagtatctgacaaagatgcatttcttagcacaaggatcaagcttgtttcgtagagttttgggaacatggacataggcagtacaaccaaagactctaggttcaagattcattacatgagggatagaaaagaaagtttcaagtttttgctgtggagtaagaaaatttagagaactagagggagtacgatttattaaataagctgctgaaaggactgcctccccctagtaattggaaggcacattcatgtcaaataaagatgccatcgttacttctcacaagtgcctgtttttcctctcagctaacccattttgctgaggtgtgttgcatgaagtctgatgtttgatacctttagagtccaggaattcagaaaaaaaaaaaaaaaaattatattcaagtccattatctgattgaaggatttggattgaactttgaaattgggtttgaaccatattatgaaatttctgaaaaacagagaagacttcattttatgtttgagtaagaatatccattgtagaagtagaggaagcacgaggagtatgag

SEQ ID NO: 35 - DNA, 1000000 bp, Glycine tomentella
acatatatttttatcaaatcttaattattaatcaaaaatagaatatacttatattttttaattaatcattgttaatggtaatggtcttatcattttctatttctagtcaagttccatgcaaatttgatttttctttgattgaatgaactaagcctgtcctagaaaacgttcacgaataataataataataataataataataataataataacatgcacatcttttaaccaaaaaatctgtagtaatattgggggcatctcctgaatctgatagtgttcaaaattcaaagtttttaatccatgcatgtgaagtgaagttatgagttatccatctaagaataaataaattttataccaactgttatatgttcttacattgggaggttgtaaagatttctcttaacaacgtgacaaacttgtccccttatattattgtataccatgtgatgatgttaaatgaaatagtaaaacgatgtaatattttaatggttcaacagttttactgttataaaaaaaggggtactctttaaatttttagaacaacgagaattcaaaaaatatgcttgtataataaaaacatattaaaatataaataaaatgcttttaaaaaaagacacacgcgcacacacacgtctcaaattggctggtttgagttagcaatttaaaaaagaaaaccacaattttgaatgtaaatttataaagtgattatatattttaagggaattttaatgcgtgctgtaaagaaaaaatattttataaacacggaactgtaggcgaaaaggcacctaatttgtttttttttttttattcttattaaagtcttccaagtgcaattaaatattaaagaatactttgcaaaagcagcatttttaactgaaaaaaaaatgttcatccaaacgaaaaaaacactttttcagttaaaaatgctgaaagtcattctttatatatatatatatatatatatatatatatatatatatatatatatatatattccttaattaatactttttaatgcaaatcaataacccccagcttgttatatatgaggccagatgataggccctcgtggctctatctcgaggcatgagggaaaggaaaaaggaaaaagacaagagattctataatttggttagctagagaaaatattttataattttttttttatttcatgctattctttaatttcactcgcatataaagcaaataataaaaataatttttttattattttatattttcatttttcatttttttcttaaataaagctgatagtttcatacttattgattatttgaaacaataatcaaaacaaaatattgatattcgaatttgctaacactttgtgttttttaacttctacatctgcattaaactctttacctaaaaaataacaacaaagtttggcagtaaatataaatagacacttaataacgatttgagtattacgagagtttagaataattatcaatgaaaaggtagaaaaagatagatataataattatcaaagtctttggcacaactttgaactgaaattaaaatgttaagatcatacgtcatcaaataaaaaaatcaaagtagtttttctaagacttggacaaactttcctttttaaactaatttttagagttagttgagttaaactcaatttatttttaatgtatgcaatattacgatttatccaatgattatactataccactcacatatattcatgcaaattttacagttcagattttaaatcgttaatcttttttgtctgaattttcagtcgttaatctaagaattgaactaatgataattgttttagtttgaatttaccttcaactaaatcagctattcaaattaattaaatggggttaatttgaattattagatttattagcttgtattgattaaataaatagctctatactagattaggagaacaaaaatagtctgtataacttttatcaacctgtagttatttacatgctttttttaagtataattattatatagtgtgaatttaaaatttcaaccaatcactattagaataatttctaaaataattaatataaaagtaaacaaatttattctacataacaatttataattaaataataatataaaattattttacacggtcaataaataatttttttaattattaacaactctgatgataataaataatgataccagtgataatctctttacttttccttttttatataatattccatcttttttgcctccctcttttttacactgataactaaaccttagataattggattattaactgagtcctacttggtaaaatcaaatattaactaacatatatatccttgattttaatgaaactatatttcttttctttaagtaagatattggatttgagttataacaaagattaattatcaacaaaactaataaataaaaaatcatatattacatttacaaacaaaaaattaaatttataacgtcttcttgttctaagttttaattaaaccactaaaaaaacagtaaccatggaaatgatattttttttagtcaattggaataaattaccatttccatagttactaaaataaagagaaactcaaataactcatagagagggaaaccattataaggaatttttttaaagataactcatttaaagaagacaaatctatcttaaaatctcttcatattagatttttttaaaaaaaaaaatcagcttaatttcacgctttatatgtggagacaacgatcgtactgctacgtttggcaataaaatatacctaaataccacgcgcacagtaaattttatcagactgccacacagcataattcgcttgtcagtccagcgaactaagtgatgggcatgtggcagttagggggtaattcgctgaactggggagtccaacaaattaggtggacacgtgacagacaggtagtaattcgctgggcagcccagcgaattagatggacatgtgtcaaataggtagtaattcgctgggtaattattggggagcccagcgaattaggtggacacgtggcagataggtagtaattcgctagggagcccagcgaattacgtggcaatggaaaaaaaatgtcaaaaatttcgaacggtcataacttttgataagaatgtccgattgaggcgtatgatatgtcaaaacgctcgaaattcagagcggaagccctgggcaactatccaaaggggagttggtctgccattttttccaaaaaaacttctctaagtgcctcaaaattatgatttaagattacaatgtatcctttaaatggtctaacttttgatagaaaatgtccgattgaggtgtacgatatgtcaaaaagttcaaaattcagaggggaagccctggggttggtccgccattttttccaaaaaaacgcctctaagtgcctcaaaattaagatttaagattatgatgtgtcctttaaatggtctaacttttgatagaaatgtccgattgaggcgtacgatatgtcaaaatactcaaaattcagaggcgagcattttgacatatcgtacgcatcaatcggacatttctatcaaaagttagaccatttaaaggacacatcataatcttaaatcttaattttgaggcacttagaggcattttttggaaaaaaaatggtagaccaactcccttttgggtagttgcccaaggcttcccctctaaattttgagcgttttgacatatcctacacttaaatcggacattcttatcaaaagttataaccgttcgaagtttttgacatttttttccattgccacgtaattcgctgggttccccagcgaattactacctgtctgccacgtgtccacttaattcgctagacttcccagcgaattgctacctatctgacacgtgtctatcacctagttcgttggactgacaaacaaattatgccgtgtgacaatttggtaaaatttactgtgcgagtaacatttaggtatatttttttgccaaatgtgacagtacgattgtctcttatatgtgtgtggggtggggtggggtggggggttcaaagagtgatgataaattttaaaatattattaataataaaaactcataaaaaataaaggtgtaaataatttgaatatttgaataaagtttttagcattgttacaaaatatttatcaatgataatttcaaatgaaaaaaaatgattaatcatttttagtataattcttctcttccaatcacatttattgaattgaatcaagtttaaattattttataacttaattcaattaaatataattaaattgggttaattttactctcttttttctaagcaatcgaaaccatttcaactcaaccttaattgagttggttgggattgatcgaataaataacattctgaccatttaaatttaaacgaacccattctctatcactttaatttgaggtcggatattccattgtatcagttttagtagtaaaaaagaaaaagtttgttacgtactagaatttgtgttgttaatatcgttatcaatttaaacgaacattttgttgattatggccattggttggcatttaatagtatcggcgcattactaatatgttgttctatgaagaagaagagatggggataggggtccagtcaaatttcttgtttctttctcaaacattgtggaatgcaagctcttgaaatggacgcccaaagttacgctaattacaactttactaccactctcactcctccccaaccctacttcttctattttcctttttttctactctcaattaagtcaaatataggtaaaggctaccgctatttaggatattagttaaaaattaaaagaaaaattatttttattcaaatacatcaaataatattattcatattttttaaaatatttttataattttattttaaatattttataatttttaattaatgtcttgaaaacactgataagtaaaaaaaaattaaaaatatctcaatactagaaaaaaaaatgctggtatctttttctcttgtggcgcacgaagaacgtgtcaaacaggcacctctagtttttgtaatttttttcttttcgtgttgacttttttgccctcaacttgtggtcccacaccacggcgccgtgtaccgccgccgctccgccagcagcccctgccggaacactaccgagcactcaggcagctctccgaggtcggcgaagagcgactcgtcctcctccctcatcggaatcagcgccacgtcagcatggtacgtcgtggccataatcgggctttctagaaccgtggacgacgtcgcttccatctcccccagccaccccaattcctccgcggttgttaccatggactcgtccgcgaacttctcgtccggttcgaccggatccgaaaccggttcgggtcccggttcaggttttttggtgggcctggcgtggtttctagaaggtggccagggatggttgtggtcggaggagtaagtgacgactagcattgtggggtccacgccgctcctttccacctgtttccgtgccggacaccccttcgaactgctacacctgtagtaccctctgagtcataaacaacaaccactttcactaatcaaattaacgaaccagcaaatagtttcttgtcgtcggttatatatgttcacaaattaaccttaaaataaccaaacgtgttgttgcaatgcaatggaattatataattacctgggataaggggaacccttgatgggtttctggccatactttctccatgcccatgaatccgagggtggggcgttgctctctccttttagcctacacccttctgtctccttcattgggatttgcaccacccttttctgtattgccctcctgcttatttcaacataaccaattcccatcaatattaccctttcaaaattccatagctatatatacacactaactagcgaggtgttgttagaagtatagaattgctcatatcaagaattgtcattttacactagagaaatctaagagtttttgatccaatagttgaataagtttacaaactaataaaagaaagaagaagagagaatttctcaatatcaataccaaaatcttaaattttggagagtatatgcaatttctcatatcgttgttgttcctttgtgaattcgttcctagaattaatttccttatatgtaatgtttcgattttaaacggaaggtaattaggtatatatgtagatagcaagaaagactaaggagtactaaccttctctttgatgaagaagtgggggaggggactaagccatcgatgttgaacacagtggaagaaggaggggactcggcaatgttttcttgagctatatcagtgtcttgatcttgttcactggtatatgagttaacgttgtggttgttttttctgaacttgctatccatttcttgagatttggagctggtaactgtgttgagtgtgatattatatattgacccctggatcccacctagaaggtggcgatggtgatgactatggctaatgggaaaaaaaagggttagctagattaccagaatacaaggaaattaagacaattaagaaggaaaaggaaattaaagggggaaggaggagagagaaggtggggtgcccctttaaaaacgggggcttcgtgtgttgacagattggcttggtcttttgtttattaggggacgggagagcaaatacttcatcatatccgaacaaacgctaatttatatatgaatatgtcatttgaaagcaaccccatgatttctttagtcgttattttatgtgaaatttccttgaggataagcccattcattagtttaatggaactaagtctacccttttttgtcatatctggggcaccctttcaaacacaacttagtcgatctacttttgcttacatatatagtgtacgcagtattaactcctcaattttaattaattaactgggttgttatggatggaatggttcatcttcttcatattattatataatatataacgaagatgataattgaagcgttttatgtcgtgctagttaaaaacggatccagattttttctgtcggaagaacacacattcacgtacgcagtgagacgactaaaattgtttgatggaaatctaacaattcttaaattattttaataaatttcattttaaaaacacttttaaaatactaatcgtctgattaaatcagacggtctatattcatgaatgcctgaatacaagtaatccatttccgtcaaaaacagggtgaaaaaccaaaaaggtacaagttccatactccaagtgcgaaggctatacatcaaaaataagtttttttttttaaaaaaaaattaccaaaagaaatatttgttttaaaatattatatttaacaaaatgttaaaaatactggtttctcattggagattaaaatcatatatttttttatataatttttagggatttttttatcagcaatttttagggagttaaatataaagaattatttatataaagatttaaattaaaaaaagtattccatcgattcatctaaaataagtgtcatttaagattaattattttacaaaattaatcttattaaatagatgaaataaaataatattaatatttaaattcaaaaactaaaataacatatatattagatatgagtgaaaaagaataattaatattatattaaaaatccatgagacttttattttaagataattttttttccattcgtggcatttattttgggacgaatgtaatatcattgttttatgaataaaacttatacttaaactatatagaaattaataaaggtgccaaacttttcaccaaacataaaagggctggagaggaaagaggcagaggggaggaacaaaactggctttcttttccaatgaaatatcctactttgaaattgttctcgcgttaagcttcctttagccaaaccaacgagaaccttttctgtggtaaatgtaataataattaaattaattatattatgtattgcattatcattagttaaccagtacttggtcatgtaccatacatgtctaatttcttttaaagatagttttgaattcaaattttaagtatgaaaaaaaaaaaaaaaaactctcactaactctgtttggcacaacacagaaaaataagattagtgaaaataagaaagagaagaatggaaaagagataaataaataaaaagttgaattttgagttgaggaatacaggagtggaattgggaagagaaaatattaaaacttcttttcaccttgagaattatagggtgaaccagcttaataggtgattcattatgtatcattatttacgacctttggattaatttaagtaacaaaagttattatacacaatagtctagcatcgggaacgacgttgcaacctcaaatcttggttggaaccaccgcaagtcggaatcctcagttgttcacgaaatccaccagattgaaacgcacaacctactcgtagaactcctggcctctctcgcatccttcactttcggccccttcgtcatcctcacatagtcacattcacgaacaaacacagaaacctccccatctccctgcatccctccatggacacctcctccacttggccttcttcaacaatatcatatacctcttcggtcatttaatcataaacccaaacaacccatatttttttattaccatatttgaaacccaattgataaattttgctatcatttccatttcatgatggttgcttcaatcagaaattagaaaccggaaattcaaaagctgtgtaatctatttggtaaaagtttactactttacatcgatatgttccaacccactgtgctacacatgttcatgatttgtcttctcttttttctcttgctttgtgggattctgttcaggtgaaattatattatctatagtttttggagattcctgttcccctcagattttgtatgatgttttcaagtgaagcattctattttggatttttttgaacatttgaatgatttatttaacacactatgcatgcggtgttttctaggaggcaaaggcagtggactgcgacaatggcagaggcgcgcggtgcggctgatggtggaggaggagtttctgtttctaagaaatacacaacgataatggagtcttcagcggtggagagtttctaattagggagagaataattccgtgtgaaaggtgcatgctatattagtgaggattagatgaatctagccatgaataaaaattgtgcactttagaccacttataaaggtggtctacggtagcattgtccttggtttactatgaaaaaagaggagagtaatgagatcaaagataataagataatagctctaacaataaacaatcaagtatgcataccacactttagaattgattgtctaacctggaaaatcaattctcaataatgaaaaaattctctctaaaaacctcaattgattatgttggatgccaatgagcaaatcataaatagggaaaaataattgattaaaatatactcacaaatgactaaaggttataattttattataagactcaataaaacataaaaatattgatttctcacacatgagaattgattatgagcatacaacatatagataagttagagacgtatacataaaatcttaaagagaaaatagatcatgaaagaagaataaagatatcaaggacgattttttttcatatgtgtggacttttagatcagtgcgaataaacgaaaaagaataaggggatcaaggatgatttttttttttctgacatatgtgtggagttttacatcaatgcgaataaacgacaataaaaacaaaataaaatgttctttaacaattgacaaacaaaaatttgtttccaacttagtgttacaatgagaagatcattttggacactcgcttgataatctactatctctccttaagtctcacaattttcaccacattaattggtacattttttatatctattggtgtattttaatacagtctttctctccatcttgttaaaaaatgcataaagaaaaaattactatatataaagagctcattagctaaagctattatgaatgggttgtatataagattacatattattctctctggacttatatatttaaataaaaataattatttttatataaattaagaagattagttgaaataatttcattttataaatgttaagtaggaaataagattatttctaaaacatcctttattaaaatttgatatcaataataaaataaagtccttgaaaataaagttataattaaatgaaagatgtttaaggaatattaataatatcattaaatatgaatgaaattaattagatttaattatattaaagaattatgagaaaatacataaaagggatattcttagttcagatccacttttcagttttcatattgcaactatataactaattaatcatttgttaattagtaggatagggggaaaaggaagaaaaacaacaaaactgagctaaacaacggtcaccacccccaaaattgtttaatatacctttaattatttattgatgattatatgatcacatttattttgtatctaaattctagagaatgggtagctatcgaaaagtttaaataacattttcatttttgtcatgacgtatcatttaatattcagatcccattagttttgagttttgaccgagtcacttatggctggatctgtcgctctgtaatgtgaaagggaatggaagtacctattggccaatatgttacataaaaaatatcaaagaccagaaaacaaatcaattttctaaggtgcctaaaagcgtgaagcaatgcaacaactggttttatattattgatcatttattatctccagcaacccaaattttatattgtgaaactcgttcaatccatttttattttctacattttgtcagaaaaataataactatatcaatctacaaatgagtcgggggaaaaaataatgtatttgataggtttcttgttccccaaattttgacttcctttccttacggcattagtgatgcacattattctccaccataaatttctttcttattatatactaccttctctggatatcttatatattttcgcttttgtttattttacaaaagatcgtgagataatctaaatcttctttccaaaataatcgaaggcctacttatgactcataatatagacatttaatggagtagtttatatttatacaacaattatccttaagttcatgtgaatttctaacttttatttttgttgttgatgtgatcgtttagcattactactacagtatattattttgccctgtaaaatggctcatcatgatgtcaccgccaccttccaagaaacagaaatttctccatttattcgtttcatttttcaaaccccttaattaattatatgacagatttataagtttcatttctcacttgaataaatagtaaatctattgatagtataaaaacttgttacattatcatctgattgcacttgtaagtaagtttattgatttttatcataattaacttaaaaatataatcacacttatcataattagtagatgatgtaaaaagtttatgctaacatttcataaaattaaaatctctatatatgtatacaaaaaaatgtattaaattcaaaattttaactacattttttttattgaatttaaccctctctttgtacggggtaatcttttataaatatgtaaacaatgaaaattctaaaattaactggatataatttcccacttaattctaccgcatttttatgcatcaattacaacattttgattaacacctttatttcttcatttatcaaattaataatttaaatatggatgggtaagtatttgctacctttaaataaattactggctgaactagacgaggcatcaaaacatctcacttccacacgctgaacatttttcatttttgtccttttcctaagctaaactttgacaaaggttgcttgattgttttgcttccttgggaaaattatttcctttttttctttttattgaagccatgtagtataaattaattaatagtaaatgatatcctcaatcctccaagtgtgtattgttcgagttttcaaagaataatgccaatttgatgatccccatgctcattgactttgtaccaaaccaattgaatgtaactcacatgccctgtagaatcatgattcgtgtaacctgtaagtcgcattaaatttgaagatttttccaccggtattattaattcgtttgatttcagtttttccataaatacgataacgtgaacattactattttttttaatctaagctctcaaccctgtcaaagataattcaaataaaaaatttaaaattgaaatgttcttcaatgttaaattacaataattttttactcatttatcaataatactataagaaacatgtcttttaagtgacagaaatttaatgataatatattttatatgtttatcatcattaaattcttgtcccttaaaaatatatgttatatactcataaattagataggaatataaaatcaatttttcatgctattttttgttttaaattagtttcttaatttttaaaatttttaattttttaattatttaattaatgataaattagtcttttcataaaatttatcattttaaatttttgaatataattttatatctttttatttatttacttaatacatgaaatttattccattatattcaactacataaatattatgagaatcaactaatattcaaaatataaaaagtcataaatatattaaaaatcacgtgacaaattagtctcataaataataaaaaaatataatatttgatttttagattttcaattaatcataagatttaatttttatgtatttgtatttttcattttgtttatgtctgtttttgtccaaacattagttgattttcataataatttttatgtagataaatataatgaacaaatttcatgtattgattaataaaaaagtttaaaattgtgttcaaaaattaaaaactaacaattttttgaaatgattaacttattataaattaaataagtaagagaactatttcaaaaaaaattaacgttaaaggatcaatttagaactaaaaaaataaattaaagagtcatttgtatattttagcccataagaagttatatcttatattgtaaatttagtgatgataaatataaaatttataatataagtatatagttattatcagcagctgtaataataatgagtatatactcttcaaaaaataatgagtatataattttataatatcatccattcccgtcatcaacggatatatgcagtcgtaaaagatgtcttgctcagtgcgcgctctctctctctttttgttaagacttgagacaaataattatgggaaattaaaggcaaaattggaacaaaagacttatacaaaaagatgtcgaagcttggccgtcccaacatgtacatgcattatgcataggtagttaaataaaaaaagttggcacccctacaagacttatacctctcggcccaacccaaagtacaacaagagaacatacgaagtatgagcagtgctcacagaccttaacaaaataaataagaaataaagataacagtgtataggaaatggaaatgggcggagaagataataagtttaaattttcttctatttcacttttattccatttttcttttttatctctcttagcataaacattttccttgcagttaactttcccacggttgagtgagttcactatgcagttacgatacaaggattacaattttttctttttgattaactttgtaagggttgaataataagattaactgattaagtgtagagattgagcttcctttttaattccgactgcagctaatccacacccgtctataactgagaaatggctgaaagctacagtccatgaatgagggtagggatgctcatgattgattatcaactaacgataaccataactaataaataattagattataagaacatataatgagagatgtttggtggatttctaaaaataaaaaattatttcttagaaaaaatttgggtttttaataaaaaaaatcatttatcccatttcttattttttaaacatcactgatcaatgagattttttaaagttacaattttttgtattagagcaaaattttgtaaaaaatcttatgaatgacatgacactatagaaatcacaaaaaaaataagtaagagactctaaaaaatccatataactacttttcattgaagatgctctaagttctcattataattataatcataattaattttatatataatttattataatttggtataaccagttatgaatatataattagttaatttgagtaccccaacatgagtgtaacatgaggaataaaaggacaattataaatgtgtagaatgtatttggattagattcaattttctagtaatcactttcaattctaccttgtaagtcaaaataataaacgcagttacatttattaaaaagagaagatggttcatgttaaggatgtagagacttattttcaagagaaaaaacaaccaataaaagagggggaaaaaagggaaaagaaaactctcataagcacccaatagtcaccataaaattgattcttttgtcattgaatttggttaaaatttgagcaatagattcaagacaagttattcttgtttttcagaatttagactggggattgaggtaactatgtttgcagattcaagagcttgaattgcataataactgttttttgggtaatttctcatttgtaagcattgacatatatttagccgattataaacgtacaatttgtaaccctttttgagacttattggtatttttatttgaacattgtagaattatttttggtttgaatggcttttgatttttacctttgtattgttaatttttcttgtatatttgtgttcttttgtctctagctatttgtttgttgttgttatttccaaattcttataaattgggagggatttatttttctcttgcatattgtgctattgtatttatgctgttgtcttgttattttccctataaaacatctctcctacatcactccactctatttcgttcatcccaaaaatcaatttaactaaacactgttgtttctctaattccctcgcactttatatatgaaggaaaattttagtctaaagtctggtttcaaaggaattttaatgaaaaaaaaattgacacagaaagagctttatctcctctaaatggatctctactcacttcacctcagattaggcgagatacaaagcaaattctagatatttattgcttaagatcagcaaaaaaataaaaacacagaaattcacaacagaagttaacaaattgatatctaattctcctacaagttagtatatgaaaaatgtgaattatgaacacgaattcatgatccgtttgttaagaaatattttgtgtgcattggcaaaaggcacgataggtaaatcaataagtcaatctctcatactcaaccactctatttggttaggaatcaacattttaaagtaggaaaatgatcatgtgtttagatacggcggcgcataatcaattttcgaacaaaaaaatggtgtcaccgtgaattttgagaagcaactatgtgttgctgtggctccaccgtcgaattggccactatttctttttccactgtgctgccaccccaaacacactatataatcttgataatggaaagccttactcaacctttttcccctcccatgtcaccaatatgatttatataaaagatgaacttgacattggtattaactagtttgagatacacaagatgttgaacaaattgaagtacttaaaaaaagttacaaatcacagcctttgtcaaacttctgcgagtccttttcaccactctgctttccaatagcttttagaagcgcttcagtaatgtctcttacatccagcgtttggttctcagccacagcaatggcttccagacaaaaaccattttcacatgacactctcgcttgttgaacattcagacacatctcatcaaatgcctctaaaatagacaccagattgtcacctcgtttctcgcatgtgatcctcaccataaaagttcctgcccctacattctctattttcacatcctgtttcatttaattggaacattaaatatataaaaaatattcaatatcatgttagctatcataagcataaagatgttctgttaactactgatatgatcaaaataatgcaatataaataaggacaactcttactctattagttaacttttagaattgaattcatcaagctcaaactaaaattttaaaatagctcgaatccagttaactggtgatataatcaaaataatgatgcatataaatagagacaattttcaccttataagttaattattgaaattaaatcagattcaaacctaaattctaagatagctaatggtgggctttcacttgtatgtactattttcatcatatcactagtcaacctctaatctctaacatgttattcatgataggatattttcatttctatatataggccttgtttttaatgtgtgcctttgaggaaaggttaggagaataagcataccttgttctctttgacatggttcaataggctaatgcactctcttctggtggctaataggttttcatactgtcttttgacagtttccagtgcgagctttagcttgtataagcgtagaacggtactcttggcaagggagattctcttggccttcaaaacaaaacagaaacaattacttcattgcatgaaaaatagttattatcaatttgagaccatgggaaagaaattgaggttgcaatagacggtgttagatagcattacagagtttgagtaggtaaggactcgcacaatgtgaagttttctgcgcagtgaaatccttttctgcaccctgcaagccatctcctctgtatagcagtattttttatataactttatcttcctctctagtgaatgtgaatgttatattgtgatttgtgagtacttaactttggcagggtatttatagctggtgaatggagtgatgtgtcttggattcttgccattttcgaattcataaaaatagtccatttctactttgataagaacccaaattaaaatttggataaagactagctgacacctccacacctattacacgtagtgacatgggaaaaagaaagccactgacgagcctgtgaatgataaaaaagtggagagacaaagagacataagtcacataacataggtgtaaaaactaaattttgttttgagtaaaatcaattttaataaaattatttttaaattattaaacgtaattgaaatgcctacttaaattattttttataaatttatattggaatgtatagtttttattgaaaaatattaaaaaaagaagagccaagaacataaaaaattaaggttgataaaaattattcaaggtttataatgatttatagttttatacgtacacttctactctttgaaatgatgggattttcattagcacagaatcagtagtcataaatttctcatttacaagcaatgagtgataatctttaataaaagaaaatccataaaatataacacaagtgactaataccttaaattgagttgagtatgttaatagtatttttattctgttttaatttctttatttcgcttatctcattttattttatcatactcccgatcgagattaactgattattgaaagtatatgtttcattttattttgaaccaccaaattcatggcatagtaaaatagattttcatgatttaagtgacatcccttctcgagatatatgtacctgcattgtaaatgaaaaaagctaagccaagtaaacactactttatttctcatttctcaatgtgctagatacaaagcccttatcaccacacagcacagttggtgaaagggattggtacgaatcacagaaactgaacaagggggagcataaaaaggtggatgatatagttgtcatattcttgattaggagactgttaaaatttgcatgggaagggatgtgggaactgaaccaatggacaataagagaggatggtctttctcagtcagaaataatatcagtgactgccaatgaggcatacatgcatgcatatcactcacacccttcacgggcctctgtttcattttcatttgcctttgtctctctctactctacctcttccattgcaatttgcatcccttcccatgccaaaccttcactagctagtggccacagttgtatcacatgtactgacacaatttctgttttattctttatatcgttcccttttccgacttctgcacagccagattcgctggctagtaccccacttcaattaattcctaaagtataaattaggttcttcaacctaccaaataataataatattaaaactttatattctttgttttaatgtatcttttatatatcttcataatatcactataaaatatctattaattttattaatgactgatcatgtctttactgtttaatctcacattatatatgtaattttttacgtttagtaagaagttagtagttatgatcgactttcacttatatcgatttttaacttttgaatgaatttaacaagcacgcactttaaaatgaaaaaaatctacatacatgtttgtacttggttttattcaaatctttttttttttttttatagataacaatattctactctttcaagtttcaaatattaacttttaaactgaccttgtatttttctttatttgtctcctctcttttttattatgttatcattatatttattatttccctcttcctttattattattttaaggactaatgatatatggacatttattcggtacatacacctagttgatatatcctttaattttttttctctcatcatatcatattgtggtatattttatctacatttttctgtttcattcctttatatttctgggtttagatttatatacaggtgtctatgaattatttttgcacttaaaaaaatgtgaaaagaaataatttatcacattcgcaaatgcatcctctatttttaattggtgcaaacttatctaagaaaatcatttaccaagtaggaacttagtaattaagtatttggcattataatttaattttttttattttaaattgaatttattaaatcaattagggttagctacttgttatatcacaattcacaacataaatgtcatgtagttgacatgattggtttgtgacagccagatcacaagtagtttgtaacaccaaaataattattgtggtgatttagatttataattaatttgtgggtatcctatatatataattaaggactcgcacggctataattatttaattttctgtaaccatgcctgtatgtagctaaactaaaccagagatagatcactgatcaatggataaaggaaggagtttaaggaattagtaattaattattaaatattatttaatagaccgacacatatataaaatgcaggatgtgtgcatgtgtgctatagctatataatattaatccaagttgaaggaaaccgtttggaataaaccatgggatcggctggtcattctctagagctagaaatgacaaacacatagcacataaccagcataaaaggcaatggaaagaacttgtccactactgaatcatctcattcttgcactagcaagcactagcactacaaggcaaaaagaaagtttggattttagtagttgcatgcctccttaaattgctcttattagccttgttttgttgtacgcactaattttctcttttttgaaggctgcgagctagtatgtgaaagaggactagctactttagtgtctcctcatatatcctctcatgtaccgatgacaaaaagttcatccttccattggtttcagttgtccatttgtgctcgacatgtctctctctgaatgggaaaaaggaagttagatttgtatttattcattggcttctagctaaaagctctatgcttttcatttgcttatatccctcatggaatctagactcacatgctcaaaataagggagcaatattttgtataccaccaaacctttccacgggctaacatgctcatgtctttggtttgtgcttcgagaggtaaggaaataaaagcacaaaaaaaaaaaaaaccggcaataatatagaagtaatgaaaacttagaatgctgatatatgaaatgactgatcagacttcagagagctggcgttagagtggtttgaatgatagaattaattggtaagatttatataaatattaggatttagtagtaaattgtgtaccccttaaaagatattcttttaggaattcgattatttcattgatttgaacgggtacacatttatatataacgggaagaaaagttaaactatttagcgttgaattcaccaacgatcataactaataactaataaccttattggcttgattacaataagaagtatgcaagtgtaaaatatacatcacaacataatatgtgatcctcttcatgctactgtttttgaatcttaccttgcgtcttctaaaaactctccaaaggagacaacaaacatgtttcacatgaataaccaacattttccataaaaaaatattaccaatctcccataaagaggtcatataacattcttcttacgaaacataatgtcctaaaatagtgattaatcgtccttttattgaaaaatcgatgttttgcatatattattataacattcaactttgttcatattaaatacatttttcgatcgtctagatagtgaatattgtgtatttgttaaatattgcacatatccttattgtaactatatatttacttactaattaattattgcagaatttagtatacttgcaaaaggtgtgataatgatgagaaaagagaaaacttccaagattttgataaatcgttatttgactatgtttgaatcccatttttttccctctttattctattttgactttattttgttataagaacttatagataagtgtgaacaattgagaatgaaagatgataaattgagaaaaaaattcaaaagaaatagttatgatcttctttaaagagcacgacccgtgttgtatctacatatcatgctattccagcatgattatgttgatttttcaagaaaatttctcattagcaacccacatttgagcacgacccatgttccagagcaaaaaatcagaatcaacttcacatatccaagaatgaccatactactaatagcatgacacatgatgtttcagaaccaaaaatcaaaatcaatgtcacacatttgaccacaaccatgttgtccttaggacaactcatgttgacttagcacgacccttgtcgacctcggcgctgttatttaattgtcaatagtataaatagaaaaaaagggagacatttttaggttatatttttattacttttaaacaacaaagattttctgaattctagagctgcaccaggaacaattagagttctaatctgtaagagttttcgatctcttttattcttaatgctattttgtttgatgtttggctatattgtgaacatgattggctaaacccctagagcttgaattatgatgtacttgtacccatgtactttgatttcatatttaattgagttctctaatgtaattcagttaatcgtattttttattgtttctcttttacattgaaattgatcactctaattcatagttaactacatgttagtgaccatttactcatgattaactgacttgtaaaatcataaggtttataaaacttacatgatcaaactggtggcatgaatatctttttttcaaatatttctatagttcatttctgatcataaattaaattccaaatgactaattgtgaattaatttagggggaagagtattttcaaatcttgaccataggttattgattaacttaaagtgataaatcattaacttagggttaattaaaattggaataaggaaaaaaaattagtacatgcaaattcataattcggacttatctttattcatacatttttcttaaaaactattgcttagcttgatttatatttctttgacacaattgatgaaacactttcaacacaagataaaacgcccaaaattattttgttcttgtaatttgaattatttaggaaaacaactagtctttagagtattatattcaaactttcgaatccacgataatattgcgtatgatatatttatccttatgcaacattattttacacataaggtttctatcttttcaatcgtgtcatttgggaaatagaaagtattgaagtgaacaaccaacattttctactccccaatttaagtttctcttcgaagaggtgtttaattatgcaagggtcctatatgttggtgtttaatttaggggtctctagttgcgaccacccaccttccttgggcaaaagagagttgagcttcttcatcttgtacttcaagacttcttacatctttatcattttcatgtccatcattgcatcatgtgagttttaccatttaaaccatccacacaactcaaatcctccgtaccaactggaatctttgtttgtgttcaccattatagatacgtcacttttgaaagtaaaagtcgtgaaggtaaatagtatagtcatggtctatatataaaagtgaagaaaagaataaagtaataaacatttgtggcaattttgattttgttgactatcagtaaacataaatccccataaatacttgctaaaacaatgtgttagagctatgttttagtcactctgggtatcaagtaggtaaaagaaaccttgccaaccataacgataaaaacccctcatgctccgtatgcctcttaatcttcatgaaatgttttttatccatggagtaaaatatgctcttctagccaaatatttgaaaaataatctaaacactacaattagttcttgttctatttcttttttcttagaataatttttacttcaattaagcaatcgtgtcaatacaaaattccacagtttgtttgttcccatatattctaatttatcaaattccataattaattctacttgcctttcgaatatctaatctattttaataaatatttatcctatgcaatactaaaatacgaatttaacctaaattaggaattaggaacaaacagaaaattctagcataaaatgaaatcttaagatttttttttgaataaaattagttactgaaactaaaagccaaaaggatgaaaaaaacttcactccccaaaactgaggcattcttgtgtaagttatttatagggcaagttaagtttctggttatcctaatcgcgaattaaaattttaattttccacttgcactctctaattgcggtctctaatctccattgctattttagtctgtttgtttgttgaccgaacacgttgggctcaaacacaggcccaaacttgttttttcttcataagattgaggttgagcttaataggcataaattatttttttaatgttaaaaagagaagcaaaattagaaaggaaaactcatgggctcatattggcccaatatcatgacaaaagtgtatgtattttccagggatcgtacttcctgcaattttgatttctgaaaagttcctttccgaaatgtaatttgcattccggaatgaaatagaggtacaaacaagagcctattttcaattaacaactgatgggcttacgtttgcccaaatttactttcgttggtgttatttacttgttaattaactatgcaacttttttgtggtgttatttacaaacaaaagaatcaataactaaagttaaataagaacaaaataaaaatgaaaatcaaataacaactcatttatcttttcccctccggactgcgttattatatatatatatatatgtcagattaaacaaaaagataaagcaagaaaggcaccaataagatggaatcgggacaaataaaccaactcaatgagccggatccatcaaagttgggagggcatgtggcagtggtagcagaaaacgtagcaaggaaaggggtccatcgtccgtatcccacactgtacaaaagtaaaaaatgtggttctcgtattaaaatgatgaaccttcttttatattttgactttaactatgtatgcattttttgttgttgaataaactatgtatgcatttaataatacagacctgcaaacaaagaaaccagctgatcgggattcagcacgtgcggatacacggaatcattaatataatatagattaaatagtcatttttatttctaatgtgtagagtgttgacaaatttgtcatcaaaatatgaaaattaaaatttttgtcttcaaaagttaaaaaagtgtaacaaattcatcaattcgttaacttttgtctattaccgtcattgaaagaacatacgccaaagatgaatttgtaagcactatacacattcaagaacgaatttgtcagttcaaaaatttaatatgcatcttctccctttttaatcattgcaagtataaaaatacaataaacacttaaaaaattaggaaaacaaatataagatagaacaaatataataataagttcaatattgattcataagtataatatgtctgttgttttgttgtaacaacattaggtagtgacaaaatcaaattaagtcttattttttttaaggattaacttaatgattttacatttttgtttgagtatcatattttggataaagtactgtcacattaaaatttttaaagcaaaaatatgagacaataccttatccaaaatatgagactcaagcaaattaaaatacataatcattaaattaagccttacaacaaaatgagactcaacttaattttgtcactatctaatattgtcataataaaaattttagagcaataaaaaaattataaatattaatcaatattatgcttattattatatttattctaacttttgtttgctttcatttttttagtatttattataatgttatgcttgaaatgattaaaaaaaaggagatgaagattgaattatattttgtgtaaaacgctcacaaattcatccttaaatgtgtaaagcacggacaaattcgtccttaaatatattatgtaaactctttcattaacagacaaaagctaacgaattgatgaatttattgtatttttttcttttaaagacaaaaatttaaatttctatctttcaaagataaatttgtcaatattttacatagttttcatatagtagagtacggctgtgtaaaataattaactagaggaaactaaaataatttaccataacctgtaatcattgttttcagaatgcaaatgataatgtttgttaaataaaaaataagttagagcatcacaattattacatgttatggggtagcctcctcccaaaacgggaattgcccggtaatgtagctgcctcgaaatgttaaaatgatgtatgatgataaaaaaaaaaaagatgatatatataaacatttttttttattttaaatgtttaatcaatatacttttatagtaaaataagtatttatcaactatttttctaaaaaagattaaaataaattaagtgtgttgatgaggtgtttgatatttaaaaatgtctaaatattattattctttcaccaagaaataggccttaatattgctatatccaatccatagagaaaaatgaaaaaatgatgtactaaaaagagataaagaaaaaaaaaatgagagatattaaatgctgatgtaaatgtaaaaaattatgagtgtgccctactctttcacaagtagacatgacattcaccacgcgcgctctctccctctcattaattttccacaataataaatacccacgattaggggttccatgcattcatcactcacattcaatctcacgtcaccctcacagtcatagcactcccgttttctctcccccgtgaatttaatcccaattcaattctcaacaaccctttctcaccagtaaccaagcgaggtctctcgctactcccatctttttctttcatttttcatggatattcaagaaatgaagaaggatatatgaccagtaaagtgcatgaacatccttcttcatctctttgattatccatgagaaattaaagaaattcttcgccttggcccagaggaggagcagcaaaaccataaacacctttataaagagatgaagaagattagagttgctataaaattggagttgaggaaatgtttatatatatatagtcccctgaagaagattagaaactatttatttacataactagattaggagctggatgatggagttcagttcgcaaactagatggtaacaaaggctacacaaattgtcattccattccactcttgtatcatcataacaaaaacaaaaattgttttattgcatattgactacgataactcgttgagttaatattaattgatccactacttgcaatgttatagtctttaatacaaaaacaaaaagtttcccatttccatttgcagggcttcctctctcatcctctctgaacgacgtttgatgaagttactctggctaggtaatagtaaatccttttagggttgttggcaatgggcatgcttttcaggcaggcctatatatcttctgagtttaacattttaaccgttattaatttcagggggatagttgcaagaaaatagtatatatatatatatatatatatatatatatatatatatatgtttgccatgaatgcaatttcaatatttcacctttaattttagttgtttttctctggccagtctttaggatttgcatttatttggtttgttaaggaagagtttgcacaataatgtgcaagagatgaaaggaaatgtggatgagtatttatgagagttttcaactatataagagatatcctatatatccatattaattaaaatgttatatcctatccatactacaaaatttaactatacgagcagttcccaagaaacaaaggaaagactattctagcaatttcaaagttcatcaaaacttcccacaatttcaatacaccggactctaacatattgtggtaattggcaacttctacaatcttttccacgaagaaagaaccagaaagttaacctggtccaagacctcacaaaataccttcataatggctcccctttagaatttgttttcatgtaatgtctattctgtttggaataatggtaatataattaaagtgtatgtatgatctctttcaacttccaagtaagtaaaacaaagggttgaaatgttgaatagtacgagaataaaaactttcccttctggtcaaagctgttcaacacctacactccattatcaattacctatatttccttcaacatactaaaatctaagggatctaattaaaactatagaaatagaggccatgtgagagatgcaactgaaactgcaattgtatgtactcttctaggtgaggctcaataaatactccctagcctccaccacccacctcctctcagtatgcaaattcgtatttcattcactgtccaaagaccatgtgattgatcgatcacgtgaagcttttgacataagtagtactagtaatcttttggtacgtaaacattagatgcttaaacaaggagcagtacgttgcttctgctcgtaataaattctgtgcgtaattgagttaactcatcttaaataattaaatacttaattctattaatttgtttgagagaattttggaaagtaagtttatttctccaacataacgtatttgttttttttttatcctgttgaaccaactgaatttgttccatggaaataagtctttttatactaaaagatatttatgtatctatgtataattttggatgtatgacttcacaatccaatgaaacatattccccattcgaaaacagtagccacttttactttccacatgcaagtttctagatgaatataatgatgtcactcctacaaattattatgcaaattgaacagcatgtagttccaaacaaattattttagatgctagcattaaagtccatattgttcacaattcaatgtgtgctaaggagaattaaaatgatatcaatatgtaaggattaactccggtaaaaaatatccgtggtttagataaaaaataaaatcacaactactgtctatcaataattaattgttgtgacaatttgactcccaatagtcgtggacaagtaaacatcttaaaccaacaaaaaaaaaaaaagctgaggaagaatattaattaactcaatctctttcatttgagtgtgccacttagttaactacaaaaaattgtaattaagaaactgagtgactaaacatgaagaatgaaattatcagataacagaaagagatctagcagacactcctagctgtgtatcatggtcatggggtttaaatttaattattgaaattatgaaaataattacccttatgatcatttggcaattataaaatcaaagagatcccatgaaatgaaagaagtcattaatattttcatgtcagttgtaaagtaatagtttctatagtctttttgtattttcttatttaaaaggatgcctctgatgctttttctctttccaatcttcctataaatttgttagaaaggcaaaagattgcaacaatggaatactaattttttaaactctgtttaagagctataaaaggaaagttctttataggtgctttgtttttcaaaataaattaatcaaagattctattttaatcccatataacaagtttaacaaccaaacatagaaagataaactgttgtgttggtgtaatgggaatatcatatttggaaaggggatttcgacttttgcagctttgaatggccaccaacgcataatataacctatatatgtaccacacacaaaaattggagaaacaaagttacattttcccttttcacttttgttgccggttagcacttcaatgtaaaaattaattcaccataaaggatgtggttcgcatacaaaagaataaaaccttataaaaggacacatgcaacgcaaaataaaggcatcgttccataggatatgccgatcctagcgagccataaataacgtttccaaaggcattcctctatgtgtgtgtgtggatcttcccagttgcagctgcattacagggcaagttctccattggcaggtagccactatgatatgcatctcatatatatttgcaactttcttagtgtgcaatctgccaaaggagatttgcccagcgattctcctgcaacatctgcttcatgaaaacagtattcgttagtttcttcaaccattcattagaaacatttcttgtactggttgaaatgttgcatgtagaaccattcatgcatatgccatatttcccttgttttgtattttggtaaaaaccatttttcccagcatctttttcggtgaagtcgatattatgattttataatttattttacattttggttagtatagaccagcaggagaataacccacaagccacaggattagtaaagtggtataggccccattgtatttaaacgtggaaaaacaatttattcagtgagaaaactaatatttgatttgttttgtgtataaaattcttttgaatcagcgattaactcataatgaaaacaggattagtttctaatttagtgaattggaagataaatgtaatctttcacataacacaaaaaaaagactagtaagtgcataatttatatataggagacctctaatggttagaatgctttttgtttataatttgtatgaatccatcttataacacattaattgcataagtttttacttttttgtcatttaagtaactttttttctccctttagtaatgtaattctaaaatatttaattaaaaagtttatgaattgaaccagacaaattatcttgcatctttgtatctctcctttgaaaactacgtttacactatcatattattcacatgatcatataaatagaaatatgatcatgtttttattcacatggtcactactatgtgcctcctctcattttattttttgtttcagttcgtcaatttttattgggacccaaaaatggcaagcaattttgatttatgacctgcctttcaaaaaaaaattgatttatgccttgaataaactcccattgcttacatgttgtaagtctcccacactgcaataggaagtgtgaccgtttcttattaataaaagtaagttaagtaacttctgaatattctggggttagagttgctctaaccatattgtttaagaacccctgtttaatttctaatttcttttaaacattatcaaacaatatttaaaaaattaattttcccttatatattaggaatgaacaaatgtcaggatgggatcgagaagatagttgccaaagctacttattattattttttgggtgtgtgtaatcaagatttaggtaaatatatggggtaagtcaaatcaatcttttgtaataaggaattcttagttaattagtatcttaatcagggctttaaagtactgcttagcttcatgcacttagtgagcataagttttgtaatataaaaattggttaaagtggctctctttctccaatacgaatataacaagcatacaatcaaatttttgagctgcttctagtttcaacataaacaacttttgggtcaattaatatataatagtgtttgctagtcaccgatatcaaatatcgcgtgtagaagccaaagagaatgtgctgtagtatcttctttcagcataatcgtgctattcttttttctacctataacagtaagtcttttctttccaacaaaattagattccttatgaatgcataaacacaaaatctgaaaacatatattcttatttatcactctccgttgaaaggtactatattctgacctaacaggttcatgttcatatataaaaggacgtatatatgaatatttttctgcgatacttggttggttctttgattattctattctatctgatgttcgccacatatcgttaaatacgttacagggttacacagcaagggaaatgtaagaccagatttgactcgatcggcttgtatatgtaagtaaacaagtgggcataattctataagttgggtccattaaaaatgcttccagtgtgcctaggtttttctttgcctccaagtttgttttggtggaaatagagaagaaggaaattcaaaaagaaaaatatatagaacgaaaatgtcaaatttttattgtttatttgagaggagaaataaaaaccaaagaaggatgcactcgaacaataataacggcgacactaatatttaccctatatatatatataatatatatatacacacacttttgcatagccaaattcttaatgtaacatgcaacatgtacatatattactttctaattaataactacatatatgtcgagttagataagattgtaagtttggaacgttgataatcataataaaaataaaaaatgagttcatgtcttgtacaatatataatatcagggtgtttctttgttttatcacttttaatttattcaaacaaaattagtaagaattttcttgtttgtgggtattaattaaatgcattatatttaatgatatgattcagttgacaatacatattaaatttgtagggaaaaatttaattcttttttttaaaaggtaaaaaaaatattattaattggcatttgattccaaaggtgtgtgtaaataacattttcaaaacacaattgtacatatgcaatgtgccccacccaatatatacttcaaaagaaataatatcactcataatccgttgagagtgaatgctaaaattgttccataacaatttttgcaaaacacatctttaaatagggatgagatacacttcaaatcaacaattagtctcataatcaattttaattaaggaccaaaacttataaagatattccagagtttcactaagaaggaaaaacggtaattacaatggttataaaaaaaattaaatgtatcctacaatagtatttaaaagacatatttgtaattaatatctaactttgcacttatgaaaaaagacaacgcaaattaatctcctaagaatattgattgtaaaattaatttaatagaaaattcttattgaaaaatatttatcatatcaaatatattaaaataattcaatatttttatttttaaacaattaaaattatttaatagaatatagtaaatactcgttaattaatatctttaaagcattcgttaatgtaaccatttaaagaatgaattcacaactatatgtaataaactactcaaaattcatagaatagtaacatgcatcacattacccaaaaaaaaaaaaaacaatgatcactagatcaaattaaaggttgcttaaaggtatatcatcgtgctcttattaagcaaacaatattgatatatatatatatatatatatatatatatatatattagaagactgcaaagattactccccacatcaatgtctctaacagcactaattccttacatacgtatatagttgtttagttgaataaatcatcaatgtttctttgtttgtttgagattctacacaacttacagacggtgttcagtttcactctggaaataaaattgccttatgttaaaagtgcaccatagaattaattaagcataattgaaacatttgtggtagaaaaaaaattcacacaagcaggatgttataaactatcaacacccttaatttaattggttccattgtgcaaaaaattgcttgatttttttttaatataaaacatattacaattaaaatatttgatcgttaattcatatcagtatatttatttatattaatctatttattggcatgaattcttgaagaatttttattatttttttaaaataaggctacacttaattaattagagaaatattaatataatgaaaaaaactaacctcattgttgaaaaggatatataaatttaaataataggtaacaaataggtcttatctcaacaaagggtatacaataaagagtctccatgtgtttctaattatcttatttaagtccttttctgagcttatatgtaaacaaattaagaaccaaaattctcatccttctctgtaccaatctttccaatcaaataatttatataaaaaaaaatctataagaatcaaactaaggataaaaaaattataacaatatattcacatatattgtttaaccaactatggttaataatgaaacaaaatttgttaaattctacatatagaaaagcaaattaagatattttttttcttcataatataataattgttaatcatctatatatttaccaacctgaattcgaaaaaaaaaaagaagataaattattgtgcaagctgatttaggactttcgtagctggaaagaagggtttcaactttttacagctagctagcttggatggttaccaacacataatgcaatcaatatgtaccatacaatcacaaacgttacagaaacctacttttatttcactttaagaagttggttcgctatggattaaataaccatacgaaaagcccagaataattccataggatatgctgactctagcaagccataaataacagtcccagaagccattccgcttcgtataccttcccagttgcagatgcattatagggcaagttctactttggcactttactatactatgctatattatatatgcaattatgcatgcatacttgcatagtgtgcaacctgccaaagaagatttgcccagcgattctcctgcgactctaatatcaattgtgtcttctctgagaataatttttgcttatatttttcagtgaagtttatgttaatttactcattacttaatttctgctttgacttgatgaaagtatgtggagcaggaatgatactattttcatcaagtggttaaaaaaatattttaatgatattttggtggtggcttttccaccaaaatgagatatcgaaacacattttgtttaataagatatttggtggaagtaatgtgtttactatctcattttgaagaaatgtgtttaatataatttgtacattacaatgaagagcatgcatgtgaaacttctctcctacgattaaattggtcaaatgcgaaaatttgtcgtctatggttgatttaataattagcttaatatttttaatttgtctcttttgtttcacatttttgctactacaaaccttttatttaaattatattcattgattcatctatgttaaaacttagtttaaaagcataagtgaaagttttgtgatcataaaaatttgtccaagagatttataataataataattgttggagtacaagtatgaggtgaaatttcatatgatataagaataagaaagttgaatattatataagtgaaaagaagacttgtaaacttgaattttaagatttttgttataaaatgtaatattagatttgtggttgctcatgtatcctaagtcattggattaaaaatttctataaattgatcatatatttatatacaaattattaatataaaattatttaatatcttatttatataaattaaaattaatgtaattaatatatttattacaaaaaatactacaatattaataatttaatttttattatttaatattaataatttaatttttattatttaattttgataaaatttgatacagtaataaaataagataaagttataatggattcaaaccatatataaagttattatcaaattgtaataattagtactaaaaaaagtgtgataattggtgtaagttactttgccaaatatttctttttgctgtcaacgaattcaatactataatttgaagtacaaaaagttcattgtttgtgctgaataagcatttatttgaactgctagctgtgtttttgttaattacttcaattcaaaattatctttaatatatatgtaaaagataaaagaaaatgaaagaaaaagaagaatgcttcaacaataaggaaatcctatgaaaggccacaatcacaagaatattatgaaggcattgtcccataggatatgccgattcttaccagtcgtaaaaaaacgttaattagcagtagaaattacacttccaggctgcagctgcattactgaggaaagcatagtaggatatggtttcttcaattacagtaaagctcttgtagacttgtacgtagttcaattaattcttaaagtacatgttatcattaagaaaagtttttctttttttaatcattaataatagtttttaataatttttgatttggtgcagaagtaagggaatgtcaattattagtgacgagaaatgaagaacataaccaatacagggaacaagggaataccggaccatatctgcttttgcgccatgacaatctcactcgaattaggaggacctacacatattagtacagtataccggggtgaaaatgaaatgaacgaacccattagtgattggttgcataacgaaaacgaactgtaatgcagacaaattttatttacaaggatttgaatcatgaagttgtcatcaggtgatagattttatctaactatacataactctcctagttggtcgtggattagtcacataattaacttcgtctacaaaaatacctaatcaaagacgacaaaaaggaagaaaaaaaaaagattaggataaattacagtatctttcctaataaatgtttttgcagtgttttattcttttaaaaaaataaaattatcttctcctaagtagttattggactagtttgtttaatcttattttttaaaataaaattaaataaatagtcttatgattttctaatgtatttatttaaattattttatttaaaataaacagtttttttttataaaaaaaatttatctactttttttaaaagattagttaaataaaaattgtatatttttaaaatgtaaactatatatatatatacacacataatgtattataaaaatctatatattataaacaatcttttctgtttttattaacataagctaattatttttaacataaacaatccttcctaatgggagtccaattacattaattgacatagtgcgtgatttattataatttctaatatatatctttaattcttattataaaaaaaatcctagaaatagttattgtagttaattagaaactcattcggttaactttgaggcgatgatcattacaagatgacttaatgattttgggtgtgaattttcacattcaattgatcctttaaaaacctataactaatactgtcttcatccccaatctttagttattttagtattttgtatttgtttcaaaactttaattattttaaaattccattatgtaactgacattttcttctagaataaattatactaattatctctgaaattacacaaaactcatattttgttaacatttacaaaaaatatttcttatttgtaatgtatttttcaaataattaaaggagttggtgtaggaattaaaaaacaggaagaatttatgtaattctataaaacttcaagattgattaatataatttactctttcctcttctaactatgcccttatatatggtggagcattaattaagattattttagtgaaatattaataacttttatttttacgagatactgtgatgaagcattaatattatgtcgtagtaaaatttgcattgaaaaaataagtcgttgaaaataatatagaaatttgaaaaataataaatgagggattttagatataaagttgtataaattaaatatatttttaatcatgtataaaaatcttaagcaactaaagattaaaaatgaagatagtaacaatattaatgtgttaattataagtatcactgagttttttttttttataaaaaaaaaaaaaaccctcggacaaaggcttattcatttcatgattgctcagatatataataattgcaatataagagaacacatttagtttttccacttcaatggattcattttttcgtatatgacatttacagatttggatcatcaaagcaggagcagtaccaaattaaagtgagcttcatgcaatttaggaatagagagcatacgtttcacatacaactcattaaaatctctttcattctttccaacataagctaagaatccaaatccatgctgcttctagtttcttcataaacaacttttatgttccattatttatttgatagcaccgatggctaaccttgtgcttgagaacttcgcctatagtatcttcttttctcgcagcagcataattcatcgcttattctctttctatttgctcttcttttcctttccatcaatattcagattccttaattctttaaaccaaaaataaatcaagttcctttttatgaatgtataagcagaaaatctaaaaccatatattctggttggtcaccctaagcttgaaacgtgaaaaggtacattgcttaagccggcctccaggagccaaagtgcttatgatggctttctctttctttttcaaaggaaaaaagaggtcaagattcttctttgattccttgtgatttgattaggtgctgcagctgcgagaaaaatgaaggtagcacacgttaaatgatatgtaatattaacttcatattaattattaaataatttaaattaaacataacttttacttactcagtaattactttagattttttcaagttcttccaatatgtttggtttaatttttaaaaaatattctggttaacaataataaataaatattaacattttaacatcctatacaaatataaattctccggcaagcatgtgttaaccttcagagatagaaaaaagagaaagcctttcgagtttggagaggtcgccaatgcaacatgtatgtaccatgccatcatgaatttaattttcgtagtcaatttatttacttctgtttttacttttaatatataaaattgtcaccttattttttatatattttctgttttaaaatatttatataggaaatacagaaaaaaatgatgggttttttttttccaatttctatacaaatatttgaaaataggaatcaaattaacatatatataagaggtacgtgacagttttgtcaattaaaagctaaaacaaaaaatgaaaatagaaataaaattgctagctctaaatttttttaacctattgattttccttttgtactgccaaaagggatatatggttcctagacaaaggaataaaacagtatgaaacacaaaatggaaggcattgttctataggatatacccgttctagcaagcgataaataatcttcccagtagccatccttaatgtgtgccatctttagtttactagttgttttgtgggtgcattacaggacaagttctctttggcaggcaccaacaagctatgcaatactataagtgtgtgcaacctgccaaaggagatttgcccagcaattctcctgcaactctttttcaattaattcatgtgcgggattcatctgattatccagtaaaacattcactgtagtggttgaaactagaaggtgatgcatgtgctacgttcattttttaggacttgcatgaggtcctcttttttttttttcttcccataattgctttttgcttatagtaaggtgaatagtcgtttagatttaaagtatgtgtactttacattaatatactgtttttaaatttacttcgtcactgtttaagctatcaaaagtgaacaagtatcttaaacgagaaaaaggtacttgcaccttttttttgtgttcgacaaggtttagactaatgcactagtttagtattaaatttgcatgcattactaggttttatgcattagacaattttttttaacaatgacaacagtaaatattaaatttatgaattcatgcatatcattctaattaaatccctataattaagccgatcttagtgtatcgtatctgctattaatattttttttattataaaatagattataatatctatatcaacagttcgttaaacaaaaactatactagtcaaagaaataatccaaatcagtgtatttttaatgcttcattgtcatcggtttcgattttaattatgtcattcaaatctcatttgatggataaccctatatccatgtactaatttctaataactccatctaattggggtatacatatttcatggattacaattagcttagagtagaggattatgcaagatttatgcatgttcttttgaattcataatgttgcaaatttcatatcaactaaagatatatctaaagaagagtatataaatagggggtaaaaatcatattacaagtcagttttgtaaaattcaatcatatgcacaaactcaaaattttaagatgatattaaagttgatcgtaggaattgttgttggaacatccacaaatattaagacttgcaaattaacttcatgcttaagatgttcaaaccttgatgtaaggtaatgttggagatctcacatcgactaaagatatatattttttctttagttagcatcatgttattttgtaagtgttggtatacatttttaattaactataatttggaccaaaaaaatagcacaaaattatttttgtctttatctaattggaaattttgactatttacttagatatgatcaaaatttaatcctccaaccttatattagtccaagtggaatggcttagacatcttaggcaatgtttcaaatttgagttttgtgagaaaaaatgtgattgaaaagaaagatccactaagatgtcttatcatgattttcaatgaaaattattcatcaacaaaattaattaatactttacacttataacatgataacaaaaaaatcaataacatctcactaaattcaaattcgatccaataataatatataaaataagattgaatcaatttaatttatttatataagatattaattttaacattatatataactgatcgaattataaaattaatgtaactttttttgttaccacattaattaatgccattaactctctgggtagaaccattttgattgatagttttcttcaaaatatgttgttgggtctaaattttaattaaaaatgaattcatcaaaattaactttagaaaaataatacttatattgataggacaggatggatcaaaatttttaatttaaaacacttttcatgttggatccggattctctggagtcggagaaaacatatattcacgcagtcagataataagaaccgtctgataaagatttaacggttcatattctcgactgtgacaggaatccaaatcctttcatgttgtagttggtcaacctctaaaacctagtagtattaatgataaaagtgcccgtaaaaattaaaggaaaactcaatcataagttgtacatttcaacttatattataatttagaacaaccaatgctgtctaattaagaaggcttgtagttgtgaagcaacgtatgatgctgagtggccgggcgattcttgtttggcagaaaatatcatatctcaagcaagagtgtggcagtaatctgccaaaattaaagtatatttgcactgttattaattgttctctacctgtgaagtataccaattaaccattttgattgtactggtatatgctacggattatccttcgggaactcctttgtgttgtgtctgctgttgctgtcatggtcccccttgctgtgataaagctcctcattcaacaaaccttaataaaaggtcgttacagttggaacttaatttgaagcattttatgatttttcattagttagtttggtatttttctttaaattaaacatgcacaactaaatgccagtctgactagaaaataatgcatcttccataattaattgcatcatttttgtatcacatattttggttccatgattaccactgaaggactacagtgtagtttgaaccactacaatatttttcttgaaggcatgcaggctggcccctggtctcatatattatatatcctatatatcaactgttgcgtagcggcaagtatattggcaaatacacctatagttacaaataataaagtgtaaatagagtatcgtctccacaataattgagacactaattttatcgcaacttgttatcttaaaattggaatgacaaataatatgtttttaaagagaatatgattgtattttggaattaagaaaatttaataattaaattaaaaattaataaaaattcaaaagcaatattaattaagagttatgcagtgatgaggaagaattgtggttagagcatatttacctttgatctctaccttctgtattgaaattagttactactttcaattattctaattgctcagatgatgtatttttaaataaattagttaaatcctaattccttagtaatttaaccctttaattcaattagaaatcctaatttcttagtaattccctattaagttaagcattaagctaatacatgtattgctctgtaatcatacatctctatccttaggtaatgtaaaaattgttattttaatgctttcagaaattagagctccaacattcctattataaaccctaaaccttagaagctcactagaatgatcaagtctaataaggaataatttattcaagaacaaaataaaataaaacaattatcacaatttatattaacacgaatccaattacagaggagttcacattggttttagctctaaccatagtaaagggaattagccagacatgctcataactaaccttaaacacatgaataacatgtacctaaacaaacaatctcaagacaataggagaaataattgcttccaatcttgattcaatcctttcctattagctttgattcttcctccaccttctctttgcatttctatgtgttgttttttgtcaaaaagtcactcctttgttttctgcacatccatatttatatttagggtaattaaactcctatgttgttctatttttatgacaaatctttcttggttatgcttcttttcttcttttcttgattcctattaaacaaaatatgtataaaataagtaatggaccaagaattgatgaaacttaaacttatcctaacttttattgataaattatgattgaattattgattattttaacctaaaattattatatgctagcagcatatcatcaaccctcattgatttattagataaacgaaatatattatataagactcgtttagataaatttttcataaacattattggagaggaggctaaaataaattaagaagataaaatgaatgatttaataagttaaaatcaacctacacaactcagttgtaagaaaaattaagtttttcgagaaacagatgtataaatttattttaacttgtaaaagtgtttcttacgagatttatcaaataaattgactcttattaattggtcaatttcatattatttgaagtcacaagttgaacaacctaagtaatgaattgattcttttagattcctctttctcaaattcattgtttttaaaggtctgcttgataaagttttcttttttcttttttctccactattttaccttaaacagtgcatatcattcgcgtatggatcacagaaaaggaattggcaacctacggtttacaaatttagcgtgttcctgggattcctttgctgatagtggaaaatgtcaccattcgaccacattatgatgttctagtatacaataattgtggaaaataaagtataaaggacttcttcagtcatgcaatattgtaaaatcccaaagaacaaggattttttttggatatactgaaatggcaacagcacctactaagttaaatcttgtgaactgtaatctttacaaccaaaagttctggagaatgattttcatggaaatcaagaataatttgtcaattatattaaagatttaaaaattcacatgttcatctgaccacaaaagaaggattaattgtcaacaaactgacacgacagaggagagaaagtaaggcatagcacaaacatatggatcttcctcctcagcaagcttattctctttttctttcacctttcacgattgatattctaaagtactgaaaagttaaatacctatattatatatgatacaattttctgctcttggtcagtttttaaagttttattctgctactagtgattggccctttaaagtgtgaggggctgcattaatggaagggcaagattaaatagtaatgcattagatcaatacaaactcgcaggtctgaagttatagttatttaaaaagttgtcatctatatgcatgatacctacagaaacaatgagatgaagtaaggcgtaaaaagttggatttaactcctctgaaataagaattttcagtttaaacaataaagtatagttatagccattgattagaacaccaactgttgagattgtgatcaaatacacatgcacatgtatgataaacaataaggctagtatctcaatagttgattttctaatcaatgactgatgactataatataactaattttaatcatctaaggtgtattccctcacttaccttctaaagttaacaagtattaagcataaaatcatataaagggagaagttcgtaattcataagagactaattaatctacattacttttctgattgtatcctagcctgaaagtacaagtttggtagatttctttccggaactgagttttccagaatccaactcttaatttcgcatgacaaaccaatgctcagccccaactctgtttattggatagaaatcataatgcatggatgcaatacttgcgacaatgtgctctggcaatgatcacactaatattatgaagacaaagtataagtgcacaccagtagtatggcttctttatcctttaccaacaagaaaattagtctctgcttattatcttcagaatgtctttcccaatgtactaatgcttttcttctatgattttcatgtgaggatgttcactatactagcaagttataagttcaagagatgcaacgcttcataccagatgatgaaagcctttttttagaaaataatagaagaaatttttttgaataataattaaataattccaaagataggagacagactttttctgtcttctactcataatttaacagaaacaaatgtaaaatatatgcaaaattttttacctcttaacaagttgcataaggtcgatcagaatttcttattagatagtcaaaaaattaaaaagcttgaatttcttttagtggttatatttaagacattgtgagttggcgggaagtgctgtttaactattgatgaatgctactataatggtctaatatctttaccatcaaataaataaggaaaaataatcattgaaaaaattattcatcgccttccatgttctcaagctcaaacttgcaaaattctagtttgtagttttgtactagcaaaacttctccttgagaagggaatatgaacttaggctccattaataatgttgagctagatggacctaaaagggataaatgagaaaaaaagacagtatagaagaaactaaaacgagttggcatgcagcaaacgccgtctaagtccaatcaatgcttgaaaagtgcttgtttggattacaagcaaaaatgaatttacacaccaggcacatgtttaattaaggcacacatactaatcactttcaaaggtgtaaaatcaattataccaaaaatctaaaacaaataggctcttagatgctgcttgggcatcatgtctgaatcagtctgatggattttctgcattatcaaaaagttttatcacaatgataccttcagatataatcgctcataaagttatactcgacatcagtctgtttattctttcaatatacatttgaattttagagtacgaaccttttagttttattatcataatgaataactaaacgttaaacaaacgaaaccctcatattggcagtgtgatttggggtgttattgtagtaaatgcaaaacatttgaacgtgaaataacacatggaatttatttaaactgaaatggtgacggatagattttgacatttgaagatttctcgagatgaataagaagtaagatatgtgcatcaaatatcaatgcagcaaacgaagttgctaactgaaacttctctttttgttaacttcacagtatagtgcttaagcatcttcatttgctccatgacactagatgaaactggaaatgctggcaattgtcttggaaaatctctgattgttggctatctttctatccttttgatctccatgtctcataaaagtgaaacttctccatgtccatctaccacatattgaaaggaaaaccgttagtaaacaggaaagaaattaattaaatacagtcatagaagaagatagaaaatagccaacacattgcatttagtcagaaactgttaaaaaatggcagggcaaatctcctttggcaaaccagaagcatgcatgttcaagccctctacttctctctgccaatggagatttgctctatcattcctcaacagcacttttatgtatcacagttccaacaccaaatttgtgtctgaggccatcatcataaaatggaaggctatttataggtagctatgagcacctaacttggatatgccactgataagcattaggagcagacagcatatgccggtacaattccattgtaaggttcttgttatttactggtccaaattctttcaccatcaatccctttcaaaaacaaggttttgtttatatcatgatttactatcagatgcttttcctatgtaggaattggtcataaacagtttatgtatatacatgcacgaaatgaactatcagtacttatgtatatgtagtttatgcatgcagaagtggacttccttttcatgccgattataagtccatattatgatgtgttaatcaatccaaaacaaaatttcaggtgaataaaattaaaggtgtaaagagtctagcagccacttactttggattatagactgttggataggacgataaagcttaatgagattactctggggattacaaggcattacaagtttttctaatctttgaccaagttgatgttcaaggccacacttcattactctggtatataaatcatttcttagaggtgtccacgtccactatgaagaattcaacgctgaattgctattttgctagttgaacctgtcttaagcatgactacacaatggaagagaatttgctttactattcacgaatttattgtaaaaatttaaatgaagatttgcttacataacttgattaatttctacctacttccagaggttctttgacattcgttcacttctcctatgaaattttatgtcagactgtcaccatagacagaagaaaagaaaagattctcaatttacaactggtatgagtatgtactatgtacataagaataaaccggtagcaaaaagataccaaaatatcttcattctcataataatttagctaaaaatatctctttgtttcgaagaccatcctgattaaacgaggaaagagagatagacaagtgagggaaaacaaaacaaatcctctagataaccttggtcattcaacatacaaattgcctcaggctgttgcactttcattgcttgaatcagggcaataaatcgctaagccagagcataatttaacacaagatcaactggttttctctaatagctcaaatttgcctagaaattttcatatgactacatgcatatgtacataggtacataagaagatccatatgcatacatacatgtgtatatttatgttatgtataattttattgagaaactgtttccaaatggaatttcaaagtgtcggctgcattggttactcagtatactacacaagccgtatgatatcagcaatcaataataaatttagtcacttgaatggaaagatcgcattgatttttgaaagcagatcacaatatcattagacttgttatttcagaatttggtaatgcatcgcttgtgagaaaaagaaggggggttgatttttcaaccatgacattgagaattggacatagttctggaataggtatttactaccagcatattcttaacttaaagtgaacagaaaacactagaaaaggaatagagaagaattatgcctttcagatggatggaattttcttcgtcacggactcccatttcattgcttgttctgtttgtgtagagacatgtttgttgattaaaaattaaatgcatggaattttagaagaaaaacctgtggtaccaatctcacagtaaaagtgcagtagctgtgagactaaaggcacaggatggaccactttcttttttgtaaccagttgttgagcagaggatgtgctgggaatatccttagtcttgtgcgatgcatgtcctagttttatcaccccctacactatatatagacatggataaccagaaattagttatcgaaaagcaaactcatgtgcagatgcattactgggcaatgacttctttggcagttgaattgaacattcagctgcttgacattcaggcaatgaagcgaaaaagctatgttcaccgccaaagaagatttgcccggcaattcatcctgcgcacatttatcactttcatatattgtctgtctatctatctatttatttatatatatatatatatatatatatatatatatatatattatgtacgtgcttattgcgtgctcagtgtgaagcatttgtttttttttttctttctatttggcaactttttttttttttggtctaggtgcttccactggaggcttgattgagtttggtaaaatcattaaggatggtataactctttttctaagtatttaacatgactacatactcatgacttcaaatctttggttaagttaaaataatttcatcaaaacaacccacgctagagtgaactcagatcctacacaggatcgacgagtttttaagttataatatttgcaccaaatctaatatttttaagagtaatgatccataaatatcttattattttcaatatcttattgttaactccttaacaggtatacaaatttgttaaagtaatattaaaatgataagacctcataaggactttggttgtactcagaatttgtatacattgagttttaagtggatgaatgactaaaactaaatatttttcaaagtgatagtgtagaaatataaacttccaccataataaaggatagaaaagcatagtatgatgtaagagacaagaaaacaaagacttagaggtgaaaattgatatttggtgcatattcttttagatgtgttgggtgtttggccaaccaaaattacttttgatgcaatattaaggatttttcaccttttaaaattatttcaattattatcttcatcaactaaactactgataattgctaagtatacataaagttacatatacattactttgcaattatctattttttcctcttttaatgctttttttggtgatttaaatgtaggaactagcttcttcttagcttctatccagtggatgctttaactagtggatttatgaagtattggttgtattttttttgtagaatttattgcaagggcatgaaagatggatttcatgtttcgagctgctcgcttagcgaggaacaggcgcgctcagtgcgagagcagtgactcactcagtgcgaccaggcttgcccagcgctaccagctcattcaacgcgtggtcactaatccaactggactatttgaggcacgctgagcgtgaaaaggacgcacttagcaagtaccacgacatagggcagcgtttaaggcaaaaataggagggaaagaagtattgtagagacccaaaaaggaaaaacacacacttagagaagcttggagctttgctaggtcaagacggagacatcattttgcaccattggagctacctctccatctctttcccttccatcccattatcttccattgccctaacctccattgttgtaagctcctcatggaaatgaggagctaaaacccccattgttgagagttcaccaatcgaacactttgatgtaaagttctaactatctatttaatattatttgcgcattattgttgtttctctgagctttattcatgcttgtggtttgatcacccatttgtatgcttgttttaggttttaacacgttgggaaatgattattgctttaagaactgagaaatgcttctaaataatatcatgtccagggatagaatggtcttgtttagcctatgttacattgtcattcctaatcttaatgcaaatcgtttaatataactcttgagggatcaagggtgaaattaagtagtttaggtctagcacttggggaatcaaggttagattatactagtggatgaaggtaatcgtatttaacgttgaatagagaaaaatcttttatatcgcatcaaagttagtttcggttaatgaactcttaacaccaatggcatcatatttccatcgttcactttccgagtgtttgtgtttctctccttgtatttattaagctttcaatttacatttaagtacagtttaatataatgcaactcattttacaaatcaattttattcattgatcacttgaaaacaaacgtgtattagtcttgagtataagcaaagtccctgtggaattcaacatctggacttaccggattttattacttgacaaatcggtgcgcttgttggccgtttagcaactactctaaccatgattcctcatgcaaaaaagcttaaaccatctaatttcacttataatcccttaagagctaaactaagtaatttgatttaagactaacgatgcaaataagactaaataacatcattctatccctagacatggattacatagaagctccttcaagttcttagagtaaaaatatttcccgatgattaaaatcctataacatacatgttaatgagtgatcaaaccataaacaagacaataaacttaaaaaggaaggaataatgttgaaataacattaaatgaatagtaaggatcattacatcaaagagtatttggtatccaagccctcaacaatggataatttagtctctcataatcatgagaggttcaaaaacaaaagataaaacaaacgaaatggaaaaaaaatggaagaagaactcccaagtgaatggtttgctctcgttttgcccttgccaaccaatcccctccaaaagcatagtgtcacccttttataatctttaaaactctgcacaatcatgttttttggaaatgactatgttcttagcatgcatgtgcgcaataagcccacatgcaaagtacatttgttttaagtgaccatgtgctaagcgtccaaacgtgcacttagcgcccatgctcaatatagctaacttctaatttgtcttcacacattgagcgtgcattgatgcactgctctaatttttcaacatctatctgacctttattgttgtgtcaaaactctataaaaaaatagaatcaaaacactttttctatttatacattcataatatgtccacgctcgaagataggcgccaagcaatcattgagaatggagggtaccaattggtgtagcaaagtgtataaattgttgtaaatttttatttgttttgaattcctaaaaataaaaaaatatattaagtaagtaattttataagtaaattaaattatatatatttgtttttcataattaagaaaggacattataatgctcagtttaatcattaaaatattcagtcatgcaaacaacaacttttatgaatgattgacaaatctttttatgtttttcatcagtaagtaaaatttacacacaaattttatatcaaataatgatacataattattcaaaattgtatatcttttattaaaaaaatatttgttatattttttattatatcatgaattctatcatatttattttatttttcttatttcattctctctaaatattaaataacatattggatactggatagcatgaaacatttgcctttcgcttctagctacaaagctatgtcttagtagagacaaattttttttaatgcaacagagacgcaagtagcacgtggacaattggccttcttaattattgatttcccattcaagttcaactttggatacttgaatccgaattccgagtaaccaatcacagtttattacaagaatattcttcataggaaattatatatgttgtcctagtccgtttgtttcatttcaatatttgtgataatatatcaaatatttattatttttttcccacaaatatatctaaattctaaataatattaataatatagactatagagagagggaaagaggatgcattaagtgagaactcttgaatatcatgagaaataaaaactataaatttgagtcatataaacacatgactacttaaataaatcatatacatttatcttttattttgataatttaaatatgatctaatagtttatatttataatttttatttgtcaaaataataataataataataataataataagagttctcagttgatatgttttgcatatatacaaaattaattaatgtaactattaaattgaatgtttttataaagtaaattaagtttaaaaagttcttataaataaaaggaagttgatattgcattgtactacgttattttagttgatattgtcatctgttagaatataattcaatgaataatcatgtgaaattcgatatacaatcatataaaatactttgtaattttcactaatcgtgaatagttgaattatgttttgttttggataaagattatatatgttcgttcaaataatgtatatcactttcattagtttttggttttaaccctttgacttgtaagaagaaattgattttgattaatttaaagttcaagtagagaagtgagtaaaatatgatcgaaaattatttttgttaagaatcaatcttgaatactgattgaacgatttaatcttaatttcagtattttaatcatttatatctaatcatttggttatatcaatttcattgttatgttataaatataaagtatttattgattttattaataataaacttattttatcactttcagagggatcccttactatgtacaatcagtttgacattgttgtgaaatgtatttattttcagattgtctcgacgttttaaaagaaattctgctgcctaatttttactatttagtatttactaaaggaccctttcgaacttagttttggaatacaataaatattttgaatttgactaccaataatgcgtgtctgaatgaatattttatttgtatagatgcacacgtgactgggcaaaaaatagtcaacacctgataaatattttatttattttcagattcacacagagttaacaagggagataaaaagagaaattgatccagttgttaacaaagactcatattttattaggagatgcatttgattttcaccttgttgttctggaaacatttatttaagattgaggtttgtccggttttaacaaatttctaaaattcaattcatttaaacttctttatatataataaagaaattaaaacataaatcagtactatcttatacaagtaggtacaccatacacgacatcagtattcccataccattacgtgttataaagcaatgcaggcgtgtagcgaattttttttaggaaaattcatatctttatattaattattccctgttctccccttgtatctaaaaataatatcgattattccctgattccccctttctctatatgacattgattttactaacagtccccaagtgtgctgttgttgttcacacgtgatctgagttaaagctataatataatttggttgatgcctaatttatcataatgtaaagcttttttatattgatctcgtgtaggttatgtatcaaaaagtaaaaaccacgtgtaccttaatttaattcaaattattaactactttgaagcgattcccgtgtgtggtccttctaaacctattaattatacaaaacattaattacactaaagaggaatgccagaggtgggaatagacattattacatataaaaactcattttcaaacatcagtctatcatcacaagagtcaaatgttttggcaacaaaggttaaaaactgtaataaaaaaataaagtatgagaaaaacaaacaagaaaaacactaaaacatgcaagagatcttaaattctagagttttatatttgaaaatcttaagaagcaaatgccaaccacagtgacatgcgcaattcaagtttgtgtaatttggaagcaaccaacaataattgctgtagttagagccattaattttacatcaaaacggtttggtgtaatcatcaaacaaacacgaagaaatgaaaaccagtaaaatgtcagaatccaagagataataagataaacattagtggttgataagtaacttgatgtcaaattgttaacaaaatcccctaccttatatctagctttatctagtagcatccataattcactattccacctcaatcaattaacccttccttttacctattcataaacccacctaattccaaacagtatttccctttcgacggagtcaataatcttcactcggcaaaatagaaaataatattcccacaaagttataccacacatgaattgaaaaagatgtttcaaaattacttaattcaaaacgtgtaaacaaataaacaattgggttagaattttgtaattatagggtaaaatgaagggcaatatggtcatgaaacatgcatatatattctagttatctacatggactaagtaattcacttccgctaacacgcaattcacaaaacacgggttttttcttttctgctgattttcctcttcggccgccatggaaccggaggctgtcttgaacctctttgattcttgctggtttgaggttaacattttgaagacaaattcaagtcctcacacatcaattataagttacacagaaagtttagattatgagataaaagaagaacaagaacaagaaccaaaactacccttgatccgaaccagtcacaccagatccatgagtgaccaattatccatgataacaacaagcttcaaccatgattctctgtcaccagactcagtgcttcttctccatccaaagctccaaaccattctctcaggaaaagaagccactgactcagaacctgatgaggtgttgtgtcctaagaagaacaaaaaaatctcaagcaatggaactaggaagagaagggagagcaagagtttgtcagaccttgaatttgaggagctaaaagggttcatggatctgggttttgttttctcagaggaggataaagactcaagcttggcttcaattattcctgggttgcaacggctagggaaaaaggaagaggaaaaagaagaaggtgatgattgtgatgagataagtgttccaaggccttacctttctgaagcatgggaggttcaggaatgtgataggagaaaaaaagagaaccctttggtgaattggaaaatgccggctatcaacaatgaaactgacatgaaagaaagtctcagatggtgggctcacactgttgcttccactgtcagatgatgatgcactttttcataatccaaaaattttcttctttttctttcgtttcatatatacattttccttgttctttttttaatttagaaatgtatttattcccttttctaaatttttttctggaatctggcattccactaaatttgttacatgtaattttagacaaaaagagaggaaatttcattatgcatttcagatttattggctgaatgtgtacttatgtaggtcctgggacaaattttgtgatggtgctcatggtaggtctgaatacttctgcttcttagatgttaggttgatggtgaacaaactttgttttttttttttttttgtcttgcttgtttggctaaggaatttacaatgaaattcataggtaattagataataaactcagaaaatatagttttacagaattagatgatgatttcagttcataagaacatactaataattggctgaaacataatggggaattaaagagactagcagcactttaaatatcagaagcatttaattgtttctcctccgttgcatttatctgtaaattctgtgaatatcgcaatttttgtgcagctgatactctcttgatccttttttccctcaagtcccaaccatagtaaaacctcatttcataagaaatcttaaagtgactttatttcattatttacatttacatactaattacatttgtttaatattcctaattttggtgtcattgagataagagatgtaatttttagtctatctatttttataaataaaaaattttaaaaaataaaaaattgaaaaatcgttatataataatccaaaaattaaaatagaaaaaaagaaaggcttgagatgatttttgaatcttttatacaagataatctaatattcttatgcatgaagataattaattcgttgtgataggattctattatgaatttttgatcacattttctataggactctcttatctcttctttctttgagctaggcttgtggaagaaggaatcaagaagaaaatatcagcaacaacttattagtggacagttaataatgttcatatttattcaatatgtgtttttacatttagtattaagtagaccctatataataactatcatagcggaagatataaggatgatttattagtgaagaaaaaggagatcatgaattcgaatctccttttataaaaaaaaaaatactaacaactaatatttgtttggtgaaaaagttttcacaaaaccagttgtactgtagagaacgtgcgtagaccgaatctaaagaataactaaaaaaaacattttaattttttatatatattacttttatcaactaaggcttttgtttctttttttcatgaatgaattggatgattcattctagcaaagtaggcaaagcatggacatcggaatcaatcttttgatccaacatcagaatcaatctaggctgtgatcaaacaaactttattgttaatattttacaaatatatatattatatatcacattaattttaagggtaaaatatatttttaagtctttttattttcaatcatacttgatcttaattcctatttattaaaaattatgattttgatctctgtattttttataattgatgaatttcttctcttatcctattttcctgagttcttgaaagactgatgaaattcatcaatttaaaaaaaaaatacgaaatccaaaattacatactagtaatcttaaaatataagaatctatatcaaatttgacaaaaaataattgagatacttaaaatatattttatcctaaatgtgatatagattaataaaatattaataattttaatataaaattaataagtattaaatttatgtgataaaaagttaatataataataaatatatttaataatatagaacgaatttaatatatgcatgtgtaatttcaaattctcacgtagccaatggcatgacatttatatgtgtggacctacgagtacgagagatgcacatggaaaatgttgagtgatcagtaaagatgcaaaatttgcgagtattattagctttgtgtggttttctctgttttccccccttataataacctgtcctctggtctactttatcatattctggtatgtctggtttattttcttatcacgtgcccttttttatatttaatcatagagaagagtgacatgtatctaacggtataaatctaacacgtgaaccctttcaaaaaaaaaaaaaaaaaaacaaatctaacacgtgaacatcccttgtcttttgttatttgttttttccaactacaatatctgaaaaccgtagctagaattatacaaatatagtatttatttataaaaaaagatatcctctttaaaatcgtagctagaattatgcaaataaaccgtagtaattatcttttatgcctctaaagatttcctctttaaaaccgagcgataaaggaaagctgaagataaatctctccaagtacatggggtagaacataagcataatttggttgtcttttaaaagaccgcgtactcacctttgtcagttacctatttaagttaaagtttctttaagccttcatttttaaattaaaattacagaaaacaatattaaactcctttaaatatgttttgaaattaaaatgcaaaaaaagtttaataaaaaaaggatgacaataattaaatatgcaaatcactacaactttttctgattttgcagatcgggactagcttagaaagagcctgacaatagatattttgacaaacaatgctaaatatctccattggaaagaagcctttttttgaagaagaagggtaaacaatgcctcaacctacagaattcatggatgtttcagactctaattttgtcagtaacaaagatcttgatgatgaagtctcaccgcatatgaaaaacattcaacaatgtttgaaattcttgtcttgaaccaccttgaacaagttaaagaagacaagagcaagtagacaatttccggccctcacaaaacaaacaaatgtcacataatagacaattcaatgtaagaataatgtcattcataggcaggaaaagactatggtcaatgttagaataaacagctgtcaattatgattagttggcttttctattttattgttgtaaaattaattttgtatcagccatataaataagattgtacactcattctgattaagcaaaaataaaaaaggtaggtagtttttcttcttctttactctgttaaatcatagagtttcatcttaacagacaacactccaaaaacaagtaatagtaaacttctatttgatcttatcaattaatctcccccttctacaaaagagatgctaaaacaaatagaaacctctactataccttgggttgacatcatgcatgcatgttgtccccataaactgccataatcagtgaacttatttgtggctaggactacaatatagctaagcaacaatatttggcggttaagagcagaaattgcagggtcaaaaatatgtgcagaagccagtacaatctcacacgtatcagaatcatcaccagcaattttggcatcatagttagcatatataggttcatctttcaactcacccagggcacttctgaactatccaaccaccccaccataaagaatgtttgcacattcatcaatggctggagaatattttttttgtcttcaccaatcccttaagaaagttctgcccttctattgctttgtccaaggacagcctttgaaaattcaacgatttttttttcaaacaggattcttggatctgctctgagaatgtttgtgcagttgatcatctggtcttgtttgatttcattgcaaatttggccaatcaggtcaggaccatcaccaagcagcccatgatcatgatggccataagctctagaatttgttggcgaggaagaccggcaaatggggatcaagcaagggatgagcaataaggaatatagtactgaataattcattttgtggagagttttagtcaagaacacattgtgtagtgttcttcacattacataattatatttcgggtttaaatactttttgaccttgataatttaacctttttatttaaatttttctcttgtaatttttttttttaatttttgatcacttatgtttattttttaatttttaaaacactttaaataacactttaaataataaaaatattatttaaagtgtgataaaaacaaaaaaaaacataatttataacaatgaaaataaaaaaatattaaattataaaaaacaaaaagatatttaagtcttatatttccaaccaaaattaaaagatatcatcattataaacatgtaaataaatattaaaaaaaatacaaatttgattctttagaaaataatatataattgaatcgtaacacttaatattaattatctgtaaaaaaatattaatgataatatttaatgcattataatatggaggtaattacataggcctgaggttccatgtaattacagttttggcactcctctttttttacccaacataaaacctcctaaaaatttgttgcctctcgtaacagcaactacccctcaccccaaaatgttcttgactccgttaatagatgcccaaacgtgactagcacatgaaatgaaagccaccatccaaaaatggctctgtgctttcttaaaccattggatttgcagttcacttaatgactattaacgaaaaatttagataataaatttcaaaaacaaatcaagataggcaatgaagaacatgaacaaaaaatttccgccaacattcgcttcccaatctaagctcaatgacaagttcaataccatacaaattcttcaaagcttgaaagagataaaaaaagaatgcttaatgtaaatttcttcagtcaaattacaagaacaaacgaagctaacgtgacagtagtttctccatgtactagatgattttatatatacctcatattccatagataaaccaataaaagaggacaaccgagtaggtacagcaacaacccagaaaaaaagttattcaagaatattaaaattgggaggacttcaaatttaagaacccattgaagaatttaatttttttttttttaaaaaaaaacagatcttgggcgtgttgggcgctgattttatgccattgaagttgagacaatcttcaattgagtggggtgtggcgtcagatctggattcatgttaccacgaagtgcttcttggcttcaccttcgttggttttcacgctacccttcaaatcgaacgctggaacctttgcgccgctaacctacttcatgtgagatcttcgtccaagcaaccaaatccctaaacaaagtcactctctcgcgattttcccccaagcaaccgttagttgccgtcaccctaacttcagattctaaaacgtaagaaacccttcccaaacaatgaacagtactcgcttaatgcaggggcaattaaggaatactatatttccaacttcttatttgttatttttttttaaacaactaacgaaaccaaaacgcagttagatcctaggcggctaaaagtaacgttgtaaaaaggagaggacggatagcgggtgtcattactcgaaaccgccatgagacaatgtaattaactctatattatgtttccaatattttcaagacccgaatgatatcccgtttagaaaaaaaaatacaaatttaattttttataaattattataaaatcaaatctttgtgaatacataatattaatgatattatatccacaaatttaataaagacatattgatgctatatataatttatacaattaacatataccacaaataaaacattggtaatatcatttaataaggatatgatcttaagatatgatactcggacaacacttattatggttagtttcacttactctttcttttatttattagttcctctgagtctgtataaaaataaaataaaataaatctaagactacatttgttatggaacgaagagggtattatttttctttttttctttttttttaactacgggggtattatatttcataaatatattaaataataatatttaatatttatatgaatactttattaataaagtgtgtgtgtgtaatatcaattgtatattatatttaataaataatagtatctaatatttatataaatattagactaataaagtgtgtgtaatattaatttaaatagtactaatgtatgatcatggatctaatacatttggaaagaagcattccaacggcatacttttaggcgtagctagaactagaacaatgctccatggatctatattcaataacatccatcatccatgccatgtatgatcacggatccaagagctcttggtaggcgcttgacaatgtcagaacatcaaaaacccattaaggtcaggacttctacacataacgatacagcactctgagcaaatcctacacatgaacttcataattgttacaactgcatcttctctttcaaatttccaagcgggccaaagcttttctcttgtacttcctccttgctacaattgcaattgccagtgttaaagttttgaccacatttcaggcacatgcctttgcacccaggaccacatactgaattcatggtaatctcaagatgcaccctgtcccttatgttctttgaaatgtcaatttgtctctgttctggaggaaaatatagttgatcatccatgtcaacaagtgcatcatcgtcatagtcatcctcaccactgtttccagaggttgtaagtttgtcttccccaaaaataacacccatatcaatagtctctggttcttcaatgggtttgtcagtgagtaaaagtgagaactcggagaatatgctctcagcagatggggcacaacaccttcaaaagaaaatcacattgaaacaagttattctatgttgtggaaataataaattatagaatatggcaggggcatacttcctataatttttttttttcacatggagtcaacaaataataaattcttttcaggcctgccttttggtttcttcaatataagtacttgactgaaactgctatatttgcactattggctacctcataaaaagatgaaacattaaaacaattatccaggaagatattcgataactcagtcaggtgaataagtatacaatggtacttgcgatgcttagcatccagatacctgaagggaattaacctgttagcagctattgtaaacttacaagatatcatgttatttcaactaccccaagaatcttccatgttataaagcctaaatcctaatggagcattggtgtgaaatttaataaattgagatgaataacgtaatacaattatgcaacaagcaattgttgttcaaaaaacaaaccgatcatagtagatcagttcataattaggtgacacaggtcaaccaaaagtgcaaggaatatcaacaactattataagtttactacttttggggtgcaggactaagcatataaatctagttacaccagatcctggaggcagatgtgccagaacttcattgtaaataatagtaaagttcaataaagagaatagaaggtagaataaaaagttctaagccaagttcaatcacaggaaggtggaagtgtaattttctgtggagttctaagccaagtgcagttataattcaatggagtgtaattttctgtgaaatcatttgtattaatcctaggaaggtggaagtgataaggaagttggagaccaatcattttcaggatttaaagcttccatgcttttgctaattatatctaaaaagtttgcagatgatgtacaatgtatggccatccgaattaaaataatgcagaaatgagcaagaacaatttagaacagagcattttgttgaagagtgagttgatgactgatatccacaccagcaaattgtgtaacatcaatttttatcaaagtgatttaaatctattagttcaatgaaacttccgcatctgcctctgtaaggtctatgcaccttcattccacctcagtccacacaaaaaaaataggggcaaattacactcacactccctgaaatttaacaaagtttcacttgataaccctccctttttttacactacacaaaccttccttaacttatataacaaacaacacaatacatccttcctgttaacacagtgtacagaccatccctcatttcttatgtagttatattagattaagggaggtcaaagtaatgtcaaaagaaaaggagagttattgggtataatttcattcatcatcatcaacatcaacagcacctttaacccaaattaattggggtcggtggattgggtataatttcattattttggtgaattgtaaattgtatcatgttttatgctgtgagaccctggtggaatagagcttacaggtcatttatttagctatgttcgcataattagttagtagggttagttagtcaaagaaatacaaaggggtaatgttagaaagaaggggaatgggcctgcaactgattaagcccattgaggatgggattatgttagcaaattagtagctcctataaataggaaaaggtgttgcaaagaagagtttgtcatttggtgaaatacaattgagactaggaagagacctgtctcttaaatatcaaaggcattctttgtagagatacactgaatcaacaaaggaattctgcttttcttccatttctgatctagttccgatcagaatgttggcactgcaatcgaaattggaagaaaaaaatatgttctcatatcatataaaccctcacgccttcaacagttcagcaatcatggaaattggatggtacataataaatactatggtacacaagcaaccagagagaataataaccaaattacaagttgataatcttgtgtaataatgcaagcaatttcacacttttaaattcttagaggttaaacttcatattgaataaaaaatgaaagatgttcatgccaccattgtaatagcaatttgttacttactttaagagaagctattaatgtggatagaaagaaacagtgtagtctatgctaatgttttatttttatagaggaacacctaccattcaatgtcactgctcacataaagtttatgctgttatcatcaaacttgtcttaaatcaagcataactagtagatatcaattaagaaaattgcatattctgaaacgtgtttcctgctagtagacagggttctgttcccattgctgcttataactaagcaggctcttccagctagaattcatgaataaatatttttctcatcattaaaaacctagtgagctatcttgagacacaacgaaatatacccattcctgttaagcaaagttcctatgtagttttgggcttaacaaatctaaagagaagggaagggagagtagaggaaaccaacaccatcctatcctaagactagtatcaggcatcaaggagttatctactcctagcttattatcattaatatggtatattagatggagtcacatgcaaaacaaatttgaaaataatgcataaatgagcatctagacaataattacagtaatgcaaaatatattccaccatagagattttagtttttaacttttgaggcctgaagtattaaaccatatcaaaataaatataaagcagagtaaaatcgagaaagaaaaatgcaaaactaagagatgataaagaaatttagaaaaagcacttaaaagtaggcaatgtaaattcatgaattgaaggcaatacctattgcaaagaagagtgatgacagtttttatgatcccatcaagcctcaattttttcttcttcctggtcacatctatagatatctgaacaggagtgccatttggaaagtccttcacggctttcgtaacacgtaatcccattgcagcagccctagtttttgagacatcacttgaaagctttgctagacctaacctctccaaggtagtgcagtactccagatgtaaaattgttgcatttcttttgtatataactgcaccttcccaaggagatcccatatcttcgacttcttcatcatcatcccaacccaaggattcatcattaattgactcaaaatcatgccccttagacctaactgcatacttatgaagaacatttagttcatttctcaagtgagtccttatatgcctcgttttacaactcaaaggcactttatgttgaaaaggggtgatggaataataagaggcaaatttttggtgggaactcaaattgctaatctcccgttgagaaaaatgcaagggggctgcacaggatgaggggattacaagtgacatttttaaggttccaatgatgatgggtagacctaaagcatcaaaatttaatttggaattctagttatggtacaaaaagcaatataatttttttctttctatggcaattatgaattgaaaaatgtgactaaatcagcagctatgactataaaagtatgcagtatggtcagacagtgtgaagcagttgacattgacaacaggcactggattctgaaaggaaggcgaaaacaattcagtatgaaaaatgctaatgaataaaggaaacagcatattcccagtgaaagccaatatttaattagaataatgcaacgcgtgattaaacagagatagagatggaaacaaaatgaaaatgaagttgggtagccaagtttgtattaaaagaaaataacggtagcaaaaaaaaaaaaaaaaaaaaggagcgagaggggacttacagtcttacagagagtgaaggagatgagaagaggatggagggaagtgtggcaaaaagagataagtcggcacacaagcagattcatttgtatagctcaggtcccagtttcagaggaggcgaataaaataaatcactaattcagtgatttatttattactattaaaaatattttaaaaaatttaaactaatgatcattttttttaatatttaaaatttatgtgacaagatttgtaatacttttactattaattaaaaaccactttaaaatgaggacaattcacgtatctatttttttatttttttaaatataattttgacctcctattttgtttaatttattaattttaccttttattttaaaataaagatattttatcttcttattcttttttaaattcacaatttttattccactatttcaaaatagagatttttcatcttatattttagaaaatttataatttttattcttatattttaaagaatccgtagttttagtataatcttcaattttgtcatccttttatttcttaaaattgtacttaattaaataattcattgatagtgccttgtatatgttatgtctaaagtttaattggaataaaataaaataaaaatgtaatcaaaatcaagaatttgatcaaaattgtaatttttaaaatataggagatcaaatgtctttattttgaaataggagacttaaattgtatttttttttaattatgggaaccaaatatgtttatttttaaataaaaggattaaatttgcaaattaaataaaataggagaaccaaaattaaatttaaacattcatttttctagtagaatatcaaatttggagggataggtcaaaataatccgctagtcagcaaaaaaaaaaaaaaaaatctttcttaattttcttactttcaaaatagtttcaaaaacttcaaaataactttgttttaatattttaaccaacaaatggattaatttgttcatttcttcctttcaaccaatgtagatttttttttcaatcaccataacattagtattgagtatcaactaattttgatgatgattaatgtatgctggaaaaatctaattaatcatctatttttaactatatttaatattttttcattcataagattcaaaactgaagcattaattaaggaagataaattttatatcactcgaactaacaacttattaatcaatcaatataaatttctaattaaatgataacgctaaactattttagattaaactaaatgactcagtttaagtgttgagtcatgtgttagaaaatttatcttatctcaaacccttacaaatacagtcaatatcattgtgatgaaatttttttattacatattatcactctagtgaaatcggtgttaagttagatgctgaattgtattttgtaagtattcatcccctaatggtgtttatagtcttggcaaagggttatactatcatttagtgacctcaatccatttgaagtgtacttcaatcaacacttttgctaagttcaatcaaaattagcagtcttatctcaaaatacatcattggcattgtatgtggaagtctagtaaatctaattcccaccttaatatagtaaacaccaaacatcaaatgacacaagcagatactatcataaatactcatttgagggaggtcaattcacctcacaatctccattcagcccttttccatctcaaccacttccatgttacgctagcttatgaagccatattgacaattgggaagagttcatacatcaattatgagcaaattgttgcatatttgtttttctagtatctttattttatctttatttgtatattttatcttcttaatattgcttattactttcaatctaccatcttttatttttacttttaaattaaatttcaatatttttttgaaaaataattaataaataaaataacttcatatccctatctaaattatttattgtaaatcttaaataaaatatcatgaattttaattatataaagaagtatttattctttgtatatagttaaaatactagtttaagacaaactaaaatactcaaacaataattaaaaaaaaaaaactcaaacaaaatataatatgatacgaagggaataatcactgtacaacaatgactcaataacatattcactctcccgaacctgtaagccaattgactaaaaccttgatatcataataactagaataaaatatatagagtaatacaaacataatactaaagttgagttacatgaggtgcgtttatatcaacactaatgtattcaatgcgtgattgggaacttgtgttgcacctcttttaaagaatttaccggaaaaaatggaagatttaggtcttgaaacacagcagaagcacacaggcatcgtatattcatatttaattgggctaagctcaatttcgataattatctgttttgatatggaaagtgcagatgctgttacaatggttcattgaacatgttaaagtaacgccccggtgcacactgtgttaccgctggtttcctaatgagactaaactgtccccgtgaattatacccaaattcagctcagactcgagggcattttggtactccgaagaaacacacagcgagagttttgttttgcccttctcatgcttttggcattttcgaatagcgtacgtccaaattgaaactctgcaaaagaatataaagttcccgcatttactacacaagcttcctcgtttgttgtataaactagttcacatgttacatggtcttggtcctgttcactgttcacatttctggtcatagaatcattcatggatgggtcacgggttgcacaaagcctagactctctctggttccacaccaacatcttgacctgcagagatgagcctgaagcctctttggttgatcaatctgcacctttaatccatgccaaagagtgtcccaacagagatttgcataaacccattaccccactgcaacatgaatctcagaatgtggagaatttgagtccaaggtgtcacaaatttgaagaagtgaaggccatggtaccaagtagggaaacaaagaagagagagacgagaaaaagaaggaagtggcacaaattggggctatatgaaccaatgtggttcatggaggggttgatttgaggtttgattttgatgtgtttgatgtggagtcatgggaatatcagattcagatgcttaacattcagcggcaaattaagatgcctccgtttgataatgatgtggcaatgaaacaacatctcaagtcatgggcttatgcagttgcctgcactgtcagataaaaactttgtaaggtgaaagctttagctagctatctagtttaacttgttcaccatatgcattgtgaaaaattctcacttggcctcggtgataacggttggttcctgggtgggtttgagagtctatgagggataacagataacggttacataattaatgtatttctctctgttccgtatctgtggtggtgcctcatctgtagtagtaaatgttttcttctgtgagatgcatgaatttcagctgtgtcattaatactatttgtgctgttcctgtttctgtaatataaagtactcatgtttttagattgtacaggttttttttttttttttttcttaacggctcttttcattttttaaccaaatcttgctggactcgagccagagtgattcacagctgtgtttttaaaagtaaaagctgtagcttcacacactggatgataagaaaccggctctgttgtctacgtactcttactagtccttggcaattaaatatgttattaatcgtttaatcctacatgagagactaacaaaaatggtttagacttaacgaaggtactaatatacagcaaatgtatctggtaagacaatttttttgcgggagagtaaaaaaataaatattgattattatatctcattataaattattaaaattaaaacatactcataactttaagaagttagattattttatttaactttacattaatgtcctgataatccaaaaatattatttgattaattggtaatccatctcgcatgtctaggaataacatttgaatgtttttctttatagaccaatgttaattattaattttttattagtagaaatttgaatcaacaatctcttctcctcgtttatccctttttattaaaccaaatttgtaactccgaatatatattatgatttcacaaaatttatgtaagtgttatcttagctcaaaacatgatactttcatagcagttggagattatctccaaatagttgaagcttttatagatagataatatatatggcaattcaagaggtaaatgaattgaagtatgatttttgtggaagacatcatgttaatggtgaatgtgaacctgagcaaaagaatcaagacagtgtgaagtatgtttagaacacacataattgaaaacacacactaaattacataacagaacacatatagaggtctaacacaacaatcacaaagagcatttgaacagattatgatgacaatgaaagtactatgtaacagagcatgaaagaacaaactaacaacaaaatgtgaaatagagaatacagtaacatataataataataataataataataataggagaataaactaaccacattatgtaaaatgaaagtcaatctagattgatttctcttttaatcgatgtagaaagtaatttttaaattaattctttattaatttatcaaaaatgttcatctcaataattcaaaaatatcattgtctcatattttatcaatttctagagaactaatgtagaatataaacatgaaaaacatcttttttatatactaataaccaatgtgatgagataattatgccaagacctgatccacttatcaacacaatgcttaagtgaggctcacatggggcaacactaccttaggtcaagggaacatctgagactttattctatgagtgaacctaaattacataatacttatatgctcaaacgcattaaaagaaaaatatgcagacagatagtagtgatatgcgttaatcttgaaaatttgaatcacacttactacatttaatctttaaacaatatactattaaatgcattactgattgagaaagagaaactatacaggtggataataattttatgaagtgcattgcaatggaggtgatatcacttaattggaaccacattctttgagaagccaaccaagtgctgacaaagaaggcttgggaggcctctcctattactgtttgtgtatataaaaaattttaaaaatattaataaaaatacatgaaaaatacgtggcaacatgaccattgagaagaagatggaagagagagaaattggagaaagagagagagtgaaaatgagagtgacaataatttggtgaacatttttagtcatttcttaccaaatctttactatggcatcaacttgtgtttaatgtgacaaacaatgttttttttttcttttttaaatttttttattaaaatgatgtggaatttttttttttaaatgttataaaaatgttttttcaaacacattgaacctaactttcaatagtttcatctctgtcttggtttccatcttcattcttcaatagttcgtgatgttacacatctattcttgtgtcttcttatgattttgtttatttactgaaattagttttcggatcgagatgagccccctttagagttcacatagaatcagtgtgcataagcaacaaagaaagagtgaagtttctttgttttttgattctcttttaatataaaaaaacttttgtgcttgttaaacatagtcaacatcatatgtgaggaaggactaaaaacatgtttttaataaagtataaggactaaattggatgataaaaaatttcaggaactaaaaacaagaaaagtgagaatatagaaactaaaaatatattttcccaaaaaataaaaactgaaaaaaaaaagtggaagtaaggacatttgtttcatagaatgatatgatattcttaggaatcatattttaaggataattaggaatattatttctagatatatttaaaaatatttttgattacatttcaataattttaggattattttttaaaattaaaagaaataaaaaaggtaaaaataaaaattacatgaaaagagaatttatttagtagacagataaagtgtaaaatgtaaatacaaggttacttataaaactaactgaaagttagaaagttaaaagttagtcatggttgaaaattaaaaaaaaaatagtttatttaattataagtgtttaataaaattaacttttaaaataacttaaaagtctaaaatgatagatcaatcataaaatcatgatttatttaaataaaatatctaggaagttagataaatataaaagataaaaattgaaaaaaatataaaaaattaaaaactaaaagatactaaaaactttacttcaagtaatatttaaaaacactaaaagatatatgttcaaataagttttttaactgataaaaaaaattagcttgaaataatttggtgaacattacttaaccacaacagccaaaataatctaactttttttttgggaaggccttgttcgtagcatttatatgtgtaaacaacactaacttattcattcattcttcccttatgatatatttctatttaggttagtttgagaatggcaatctcaatctggagaagcaggagtttcattgctgccgatactttttttcggcttccgctccaagtaatcatcactctctaggacgtgccatagctactacatctccttgtaagcaaggaaagataaacttttttggattggaacaacaacgccttcaagttccgataggtatgaggtggctgtcgctgttggggtggaagcgaaaccacatgaacaggaggagcggggattgtcgctagcggcggtgatgaaacgacgtacagcaaagccgttgaagcgggaactgtagttgaggcttttaaaagtgttgtattctagctgtaattgctgttgcacagtgaaataatgtttgttctttaattgttaattgctttatgcagagcggaattcgtgtcgacgctgcagcagtattggttgctgtggtttgatgtgaggatcagttccaggttgttgttgattgcccattgaccattgtaaggtatttggttgactcggtacgttgcttaatgtgtaggaaacattgaaaaggagactgatcgatcaagccaaggttccttctggatacagtcaaagaacatggcaaacaaagttcccaacttctgtagtggaggagtactaaagaaaagagctgaagatcttgatgaatttttaaacatggttaaaacttcagttcaaataagtgtttatcaatctttctttcccaatgttttgtttttccttagtgccatttgtacgctttctgcagattattagaagaggtgcaagtgtctctaattaatgaggaaattttggcctttgcttagttttttaatgataatataagcaagttgatctcttaacccggtttgacttcaatatgttgcttttctcagttgtgaggtggtatgatgatttctattgtcttggatccagtggtaaaaattctcttttttttaaggtataaagtttggaatattggaaatgaaaaaaaatgtaattagaaagagatatctcattaaagatgataagttaaatttttcaactaaaattaatcattattgaaactagccgataaatattttacatcaatattatgatgttctaaaaatatgatttgaatttttttattttattagtcaatattaattattaattttttgttagtgaagtatttgaattcatgatctctcctcctcttttctctctttaccatcaagtcagtcatataactacaaatgtaggtacatgtaaaaggaactccgacgaacaagtcaatggtgctctaaggtttttatgtgtgagatcaatgaaaatgtacctcaggattttccctctggatgaatatatatatctttgttgtcgagatagttatgcgatgttcggagccacgttggtgagttgctcctctatgcaacacggtcgagttcataggtgacagttgagactgccacgagctgagcatgtgggggccccacgagccgagtacgtgtcgagtttttcggactgtacggtacataagccctccaagctctgaattttgtatgaatgatagagttttgtgtgttgctttgaaatttctattgtgatagtattagataatgacaaaatcaagttaagtctcattttttgtaaggattaacttaatgactatgcatttttgtttaagtattatattgtggataagatattgttacattagaaattttagagtagcagacagattatgcttattaatcaatattatgcttattatttccaagcaatcatgttaacaatcatttttgtccctatgtgtcacgtaagttcttttattaacggtagcatacagaagttaacgagtgaatgaatttttcacattttttttcacttttgaggattaaaatttgaattttcatattttagaaacaaatttatcaacgttctacacatccagaaatgaaaatgactatttatccttaccaaatttgatcctttatgcatgtgcctatcaccttttttaaggaattgatatgtataatttgcatcatcaagcacataaatccaattgatacgaaattatctatattgataaataatcttgagttctaatcttaaaaatataattgatttaggtgttggatgattttattaaataacatgtcataaatactatgcaattgaaagttccatcctataatttatgttaataagtaactcaagtattgtgtagatattttttaaaactattaaaaaaattgaaattagtagagaaagtcaattatatttttctgaaaatatttttgctgtttttatttttttcactggttcattaatttcagtagtggaaattaaattaagtaattaattatttttaaatttagggagaaaaaagaatttaaaaaaattgaaaagagtaaatttcaaagcataaacatttcatatttgataaataaaatttcatagtaattaaagttgatatttaagaatctgacatcttaatgtaaaaataaattctaataaaaaatcttaagaaattttgaaacaaataataattcgagatttttcaaaaattcaaaagtaaattttaaatattaataaagactcttatcacaataaaaatgagaatataatgaaagatgtccctatattcgtgaattaacacttattacaaataatgaaatatatatatatatatgtatatgtatatataacttacatatagaatatatttatcaaaataatataatacgtgtcgtagaatatataataatttacttaattatcttactcattgctattaatttttttttgtaaattttaacaaaaataataataaaaatctgtaaaaaacagaaataataaaaataatttatacttttagtttaacgatttgattgatacaatatgttttaaattaaattattacatgacgtaataatgccaatttttcattttgtaaattggttgtatttgcacaaacgtatatgaacttgattcgtcaacactactaaatgtatgttttataattttaacaaaatttcatttaattcaaagcatatttcatatttaacttttcttataactatgtcattgatattattgactaatttctgccaaaaaaatctggttattcacttttaatcgagcctttcctcttactcatgcttagaaaccaatcaagtttcacttggacatttgttactatttaaaattcagtttgttactctgtttcaaggcttaataatattatttaagtcattagaatttttttaatgttaaattatgcatttacaaatataaaaattatttaaaaatttattacgtatgagcatcatcaattcatcatagagtcacataagttaacatttgaattgataaaattgactagttgtaaaaaaaaatattgttaaaattgtaaatttgtgaagacttatatatcctgtgttgatgtgtatgtattgcacttttggcatgctcaaaagatttagcaggggaagagttgcagattgggaaaacgttgttgcagtcaatgatggtcccaattttgaattgccacaacattttcatgtgtggtggtggttccaatcacatgccacgtatcatgatgcccttttcatttgaagatgtgtgtgaagatggtccaggtgctggtgcatatggacatcttgcctcttgatgcactcaaggccgaactatttgatgagtaaagagatttcatgaaattgaatttgaagtttccctcacatgcaataacattaataattactatttgttggagtgagctcacaacaacattgccaactcccaccaacttcaattgtaaattggtccaatgaaataatcgcatatgatatggtcctggcctacgacacagatttgtgatcaggttcatgaaattagcttgtttgcccctacaggtgcagccatttcttctacatgtatggccactttctggggtcactcagtccattattgatatgacatactcagatcatgccatcaactagcatcagaagtggcccagcaatgtggtggacatgcaatgcagttgagcaacaatgctgcgtgctttgagtttggctctattgggatcctctgctctaagtttcctctgaccttgtttgagtggtgtaaacgagtcaatcaaataaattttaattagtttcttttatcagcaaatattagtttgctagaatattaatctttgttaacagaggagatcaaacccaccatctatttccttttttcttctctcttaaacattcaactaatcttatatctttaaatctttaattagtctaattcttaatactattagtccaccagttgttcttttaaattgattttataatagacagtcctggtgtacttaattatttcatcaattttctttaacgagggaagtaaaatgttgagtttattcccttcctatgatatatatatatatatatatatatatatatatatatatatatgagattaaatccttttacaccggtgtaagaattgatagttttatactatttaataattttttattggataagtattttataaaatccaccgttagattgaaagcttatatcatgtaaatcacatgtctcaaatttcacaaaaattcgaaatcatttagaatgtaatcaaatagtctaattttcacatattttagaggtacatatactgttaattttttatatatatatatatatatatatcaattaggtttcaaatgatttcagatttttgtaaaatttgagacatgtgatttacatgatataagttttcaatctaacggtgaattttgtaaaatatttatccagtaaaaaattattaaatgatgtaaaactatcaattcttacaccggtgtaaaaagatctcatctatatatatatatattgtatatatgtaactatattttcatcattttgatctctgcgatgcatttgtaaattcatatgtaatttaattgtccaaatataccttttctggagagtaaagctcattcttgttcccagagtcttttttttttttttttttttccgttgcttatatgatttcattcggtccagcagaaagtatctaatttattttggcttaattgcaacatctatcgagatttgggagcctaattgattatttttaatcatttttttaatcaaatttatttcatccataatacttaaatttaatacctttttttttttaaggaatttgaatctagttttcaccaactcatgttgatgtaattgtacgattttcattccacctgaatcttttgaaaaatactacttcaaattgattttatgtaataattttcactgattttagttttttttttgccaaattttattgattctaaaatgagatgattttttttttacaattaatagattgattgatgtccaatcaaaccagccagtttaatccaaatttcaaaacattgatttatattgaaggcaaaatttcagtactgatatgcctttcttgaatttaatttaattaataataaaaaaattatatctacaacttaaaattatatatatatatatgttaaagataaatactataattagtctttaaaaaaaagatatttatagacaaatatatatatgaccctgtttaatatctatagcacaacttaaaaggttttgttaaacaaaaaaatgtgtaaaaaaatcaatgggtaacaaagtaaatagcaaaatacaaacattttcaaatagtaaaatagatatagatgattcgtcctgatcctgcatttgatatggtctaaattgaaagaccggaaagctttttttttggattataaattaataataataaaaaggctatacctataacttatagctataatatcttatgagcctatcgtatctaaattaaatctatctatagtctaaagtaattctttttagtaataaaatatgtgtgacaaaaatagtaagaaacaaagggacatataaaaagtgaactttcgaacaaaaaataattctaaaattatttgcacaggtttattaacatatatcgtataattaatacaaatgaaacgtatatttttaaaacattactttttaggctataattaataataaaaataatatatgtaattataatcacaatctattttcggcctacatatatagctgcaattaaagataaatcgagatcctgatcaatccatatgtaattgtcttacaattattcataatatactgggttcgatccttgtacaagatcattaaaataaaataaaaaactatgaagatatcaatggacaaataagttgtgaccctatttaatatatttataacagaaagtaataaattttattaaccaaaaaaatgtggaaaaaatcaatgggaaacaaagcaaacggtaacatgaaaacattctcaaatagtagtatatatatgtatgattcatcaaaaaaaaaaaaaaggagaagaaaaaaaaatggatgatatgccctgcatttgatatggtctaaataattgtaggaagttcagtactgagaaaaaaatttagattataataaggttatatctataacttatcgctataatcttttctgagcgcatcacatctaaagtaaatctatatctagactctaaagactaaagtaatgcttttaattaataaataaatgttccataaaaaagttaataaaacaaagtgacgaaaatgaataacaaacaaagggacaataaaaaaaatcattcgaagttcgaacaaaagaatatataacataatttgcacatgttaattaacatttaattattaatacaaataaaaatatatttttaaaacctattgttatacggtctattttcagcatacatttagatataactaaaaataagtaataaaatttttcttaattattagtaaaattagtcactactctacgttaatattaatattatgatgactaaaaaacttatgtatacattacaaagatatctataaacaaataaaatacgaccctatttaatatatttatagcacaagaaaatattaaccaaaaaaacgtggaaaaaatcaatgaagaacagagtaaatatagtaaaatgcaaacattctcaaatagtaagatagatatagatgatatgtcctgcatttgatatggtctaaataaggaatttcagtactgagatgcctagatgtctgctttaatagatgttccaaagcagaaattcctagttttacgcaaatttcatgtccgacaagtcatttagctcatgagaacctcctagcttgaaaatgatcacatgcaatttaaatcctcaaagttatttaacggatcaagcttcattcattcactggcattggtgagatacgataagatctggtaggaaatcggaaatagttgaagggtgggcattttgaaggacagtggccacataatcttcggctaatggacaacatattttgcatgttggattctagatatgtgatgagaatccaagttgcatcccatcatttaccttcaaaggaaagcacatgtacgttaaatgttttattctttttaaagtccagtgagtcactataaaagaagacaaaatatttgagtatcacatatttttctttttaatagttttttaaaatctactattactattttgaaggctataaattattgtatttgtaattacatgactttattagattccagtctttcatttatattaacattcaatcacaaatcacattcatttataataagtatgttaactttaaatataatcttaaaaatcatattaataataatttcttattaatagacagtgtaaaactttctaaactgataacaaatattaaacccttcattgtcgaaaggttgtcattattgttaggtggtaacatgttaagatcaaccgcaaccgagggatgccatcagaactcctagtgaagaaatcttgcaagagtcatcatggctataaacaatgatgaaggcatggttgcgattgtagtggaaggaggtgacgagcatggagtgggcattgaatacgtggtctcgttgaaggggccagaggtaatgtatgtacgtagttagattggatgttgaagcctaagaagcatggaggagggaaactctttaatatcttttgaaattacatatttttttaaaaaaatatatttgtgaactttaataagtatttgaattttatgttaattatttttataaaaatatttcctcatagagttttaataaaactaattattttttatacttgatactttttttaactcataataaattaacaaattttgtatttgatttttgataaatttttcattaatttgttattaatatttttcaaagatactaataataaataatttttttatcaaaaaataaatataaaatttactatttatggtagattaaaaaatgtcaagagcaagaaacgaattttttattttatgggaatcaaaaacaaaaaaataatttattaactcttttattttagaaaataaacacaaaatttgaataattatttgaggtgatagatatattttaactctttttttcttggatacatgatttgttctttgggttaggatagtttttcttctcttcacaaaatccttcatttaatagtggtagatgtaacttcttgcaacattaataaataagggcaaattgattatcccacacttctaacaacatttcaatatctgtttcccccctcttctaaaaatgaatgtggggacttccaattagtcaaagattcgatcagttccataatttgcaatgcactagagatttaaattgattttccatttaactctaatataaaaagttttgaggtatcaaaattgaatcctaattattttttgtaaagagaagaatttgaacgttgtaattggagttaaagttatctaataatggcttttcatattaaaatcaagtactgaaagccacccatgattcgcaccaccaacatgacatttgaatccgaatgtatgcgaactccaagttccagggcatatgctgatctacctcttttgcaaattaaagtttctggtggtttgcgtcactgtgatctcttctttgcgtgcttctttttcaccaagattttgaagtgactaaatagctacgagatgtgacattttattcaagttttcaatgtttttgatgtggaagatagataaaaagcattagatgccatgcttctgccacagttccatttaaaagatgcttgtcactcattgaaaaaaagttcaaatgccaaagggtacaagaacgtgaacaaaacatgaagaacattacctgtttcgggtctaaatgaattgttaatatgaaaccagtggcctaaattaattaaccaataatgtttacatcaggaccatgattcatgaaccatcctaaaatctttttaaacgattcccaaatagtgatctccttctgtagaacaggatcagatatcagtccaaagatcacatgtggaagagcatagtctacacaaacgttaaactaccatcaaaagggatagttgtttataaagtgtctgatttggaacagtaatgttgctttcttaccacttattctggaataatatatataaagccacaggtagccttctgttgtattgcaagcatttgaacattttctgaaaaatagaaagatagagggaggccccactcagcccagaaacaaaactgcattgctgaaatgaagaattgtgatgaatggaaacctttcctagtaatgatatcgatagatttttctttaaccatggtgaacattctgcttaagaaagtccttcaaaaaggaatgaaccatttggtttttatcacatatcgtctgtcagttgctactatatttttggtccccatcggctactttaaggaaaggtatataggcaccctcaattcctttatattttgtgtgaatcaagagtatttccaaccaattatgagagactataatctcttttagacattgttgaaaaaaaattctacattgtctatctcaattattttggtgatctttatatatatatatattacttaattgatgattttaagatgaaatttaacgtgatattaaaaactatagcctatttctccttcatgtatggcattttaccttttggattatttttttatattattgttagcatgcagataaccaagttgcaataatgaatgactatgaaatcacccacttgaacgtaattctctttagaatcaaggatatatgttaagctaataatcatatattgctatccaggatgagtgctcaaatgggctcattaatttatgccagaaggaaactttgaaagatcttaataactgtattttcttgcagaaatggaagaccacggctcacatttcaatttttatgctaccttttcttcagtgccattattgggttagtcatgaaataacgatctttctttatgtgtttccaattcctgatatagttctttatgcatggttaacatgcatgatagtagaaaaaacacgtaatattgaataattaatttctttgtagggcatccgtaacacaatacttcttccttctggggatccaatacacctcagctacctttgcttgtgcctttgttaatatggtcccggtgatcacattcattatggcattaccatttgggtatgaaaagaatatatatttacacaaaacttattttattcatattcttattcttatagcgactatcatcattcaaatggagaatatatataaatgcaccatatcctttccctttttcttttgattccactacagattagaaactgtgaacattaaatgcaaaggtgggaaagcgaagattcttggtacatttgtgtgcataggaggggcattgttgttgacactttacaaaggaaagcccttgtttgatggctctcactatcaatctgcagtagccatgagatctgcaatggaccaagcttcttctactactagaacaacacagaaatggactattggtgtaatagctttgattatgggaacccttttttggtctttttggtttattttacagtcaaagatagggaagagatatccttgccagtattctagcacagccatcatgaccttctttggagccatgcaagcagctattcttggtttctccactggcagcagcaacttgtcctcgtgggttctcaaggataagatacaaataatcaccgttctttattcagtaagtacactctttcaaattattttggcttataaaaaataattaggttgattttttttttataagaaaaacaaaaccatgttgtacgtattcagattttttttactaatatgttgtaaattgattattggttgatttttactagtcttctttctcaggttttcaccgttttaatttctttatttttttcattaggtaatttagttagaccatgaaccgttcacacatgtggtcgattttgaaaagtatgatattttattattgaataattccaaatcctctaatattctcttatttcttttatactaatatatcatgtattaaatacattttatattttcaagataatattttttattatatacttattttttaactaggagaaaaaaattatatttctcaacaacaacaaaaattgcaaaagaatttataaaaaaaatacaatattattgttcacaatttgtaaatagaatataattaagaatatatgttgaaagagtctaattcaattaattgagttggatatatgaattatgataaacgttctaatactattgttttcgacttctaccaataatatatataaaaaaaaagcatgttaacaaagtgaaatactattatatatgtttttaggggatagttgggtcaagtgtgtgctatgtgggcatgtcatggtgcgtaaagaagaggggtccggtctttaccgctgcattcagccctcttgttcagataatgtccggcatgattgatatccccttcttacacgagcagcttcatcttggaaggtgaattaattcttgtacctaggactatagcacattaattcttggaaaaaagaagtaaattaaaaaccaaagtttaatatatgcttgtgcttgttaattttatagtgtggtgggatccatgttggtgatgatcgggttgtacatgctactgtggggcaaaagcaaagatatgatgcagaatattggcgctactaagttcgctcaagaagttgaagaaaccaaagaacaagagccgcaagtataacgtagtgttgctgtctctttgtacggtgtcactcaaatccagtggcactaacttatgtttatcagtttaatatatatatatatatatatatatatatatatatatatatatatatgtgtgtgtgtgtgtgtgtgtctcttaagtatatatattatgaaaagaaaattttgagtagttaaaatagagataaagaatgaaaggaaggaaaaggatataggagatgtggtgaatgattctgatagaaaaaaaagataaatgaggataaaactaaaatgagctatcaaacatcatagtgaataatatttctcacaaagtgaccttaataatctcagagaatttgaatttgaaacaggtaaaaagaaatttaattttaaaattcaaataaataattctaatgataaaaaagtccatttattatatcttacattatggatgtctaaagttttcaaagcataattgatctttaaattttgttaaaacaatttaatatttaatctggaaatatatgaataatacatttcctatctgatcgaggattgtttataatcttttaagtaattggatagaaccatttgttataatcttttaaataagtctttgctaacaacctcaagtcctcaacattgtcattaacgtcttcttggattatattaagatttttttttctattttattactttttatatagtatgaaaaaagaagaaagaaagtgaagcaaatcaaatctaacagaacatcaaagtatataattccaactcccaagcatgtttaaggagactcatctaatctaatgatctaacactctggggcttgagaaaaatatttttgaaaaataagggccatagtgtgtcacgaaagtcgggttcagtggtgacattcgacgaacacataaatagcatatcaaagagaattaattccgggcacctggtgtgagtgagtgaggctttgccgcgcggtttcatttcatttcaccgcagcaagttcggttcggtgactccataattcccaatcatcaccgcagcaaccaaatagggtctgcgtttcgtgcaatcaattaatccattacatgttatataatctcacacacacacacacacacacctgaaccaatttaggtttcgaggaaacggcatcatcgatggctgagaaggatgcgacgaagcttaagctgaagcatcgaagactcaagggtcacgacgacagcacaacctgctgcattgcctcacgtgaacgctctcatctcatcgtcacttccggcgatgtcagctccttctccaatttccatactcttcttatctctttccaatcactagggttcaggattcatctcctataaatttatagttttaactgtttggttgtgattctgaaacaaaacaggatggtcgtgtttgctggtttgacttgcgatgccctgatgagccgagactggtgatggatgttagcgtggagccagtttcctccctttgtttcaagtcaggtctgttttatttattataatattggttttcgacttgttattttgatgtaaatggcggaagggttcgttatagcctttttttgtatcaacatgggacaagtgtttttgaaaaatcaaacacatcccaactacaatgaaattttctatcgatacatccagtagatgagtttacttgcatcttttacaaataattgccatttgaatcagggatggaagatatgatttatgtctcctcaggaaaggaaatcaagtgttttgatgtgcgattggtaagcatttattgcactatttattttcttcttgaggatatatggatatacgttgttcttgatttattctcttgctccaccttaatttattgcattatactgatcctctgtgtattatgttgtgtgctgaaggctgccgcccaatggaagccattggagaattataattataacaaagaagagataaacaaggtagatgctagatagtaggacttgtattcaaataaatgttatgcacttaccagatcttgttgaatgtcccaactgcttcttgttatataaagtaaattgaagcaaatttgttgactgtacttaacattatccatgcagatgtagatcagaaatcgtatgtatgatttttgttgtcatcttaactgtttttgtacaagacttttatatggaatctgttttgtgtttagtggtataaaacagaattgtaagtatgattgctcttggaattttggcttagggcctgactcaaccccacaagccttataagatctatttaagccatatctctagtcaatgtggaactaaacacccgcccttcaactttgcaattaaggcagcccaaagaagccataactaagttgggccaggggtgatcgcaattaaggcgactttccaacaattgcagtgtatggctttcttcacctgcacaagatattgaaattattaaactagattacagaactattcctgaacttatagctgctttgcatttcttcattctgttggaatatcaagttatcaactgatgctatcctaggtgagcttcttttgtttaaaaatgctgttataatacaattatctgtctggttttgcaggttgtatgcaactcaaagtcctcatttcttgctgcagcagatgataatggtgaggtgaaggtatgccttgtatttatacaacaatgcttattctgatttccttagtattatctcatttatcagctctaatgaatatatcctttccacttgtaatgcattagagatataaaagtcattatctcctattctaaaagatttgatacatgccataaaacatggaaatatactgtgttgtaattgataatttaaaaactgacgtcgtttcttgtgtaatgtaatttactattcattgtttagtgtacacttttaaatctaccatttctttaatttaagaaaagccaagttaatggttaagtatcgtacattttcattttcctcattataattaaaatttcttttacagataattgacattcgtcagcaatgcctgtataaaacactacgagccggtcatacaagtgtatccttgctttttagctcttcttcactacatggatgctaattatgtaatcagaagttttatctcaacccactaatattttattttccacccccctcccccaattttttctggtattatttttttcctgtgattaataagtaatttgattttttgataatttaccttaacctagtgttgtagatatgtagcactgtggaattccttccttggagaacctgggaaggtatttacatatagtcttgcttatttttcacatatgaatctctctgtctctcctcctcctcatagtgcaattaatggtttccaatgagaaaaagatatgactgttatgtctagagtaaatatgtgaggtgtccttgtatgttagaatacccattgtcttattggaaaggaatgcagaattttttaatcaaactctacatgctaactaatcatgaagaaggaaattgttgggagggtctcaatcatggctcatgacattgcctgaggtgctttagtctcataataatgcttgtatggatattttggtcaaagaccaaaaatctgtgtattctaactctctcactctattaagcacatgagacactgaactgcttgacaatagtacctgagcatgctctagtcctagtcctatgataactggttgtttctaaattggaattcctaggaagtactgtgaataatatatgtcgagaagccattgagctagtgcaaatgtgctcatgcacagacacatattgggtgatatgtttacttttccaatatatataaatgttactaaaaaagctaaatcaagaaagaaactgacatagctggttactgcaacattttcttcttgagttcagattgtttcaactctgatttatagagtagtaatcttatgagggtttctatatctgtgttataaccattgacttcggcaaattaactttttgtttgatttggactcccttctaaatgttattaattttctgatttccatttctgataaactttgtgccattgtttcaccccaaacaacttaatttgtgcccccaataatagtaacagtataacagtcatgcatacacaatagatgtaaactactggtggttttaaagtatgaaaaaatatatttaggaaagttataacaaaaatatgagttggatagaacaatcaaaagaatttgtacaagcacaagattctatttgaaatgaaattttggaaccttgtggtataaggttttacaataacagctccatttgtttgtctaagtttcatgctagtattcaagaaacttgcacccatatctatagaaagttgactccatttttattttttattttttaccagtcattagtggaggtcttgattccatgctcatgttgtgggacttctccaaagggcgcccctacaaagtagtggattttggtataatttttcttaaatttcttactttgcctttgctaagttttgcatgagattacttgaatgatctaaattagagccttctttgatttttttttttttaatttgacatttgcaatgatattaagtcctcacttctctacggctttttttgaatgcattcagcaaaagagaacttagaggataatgattgtttttaattatgttcgaaagcttttgcaaccatagtcatccttggccatgattccacagtagataaaaacaaaaggtttggccacttaaaaatattttaccgatgaaataaaacatgaaaatgatggttggtgactattgacaatggagaatgcaagtcacaagcagttattatccaaaacatgaaaatgttgtcactgaagcctggaagttttcgatatatgtatgcatgtcacgaggcatacatgcctcagcttagataataactgaactaacagctggtacttagtgcaatgtaaattaatgatccttgtgctaattttgtttttatagtttcacagttgaaacttgcaactatattttacatggtggcattttcgtttatttacttatgcaaacatacatactcttaaaaatgataagagtaatatacaattgagatccataacgaaaacttcaatggatctaagctgttggaggatgccttatttttttgttggtcttggttagtcaatttggagaaaggatttaatatccccttctatcattggtctagtcagatgagagatggattttgctagaaagttttttgtctagtttttctaaccttcatgtgagcttaaccttaggttgacctttggcatcttaatgcgggttgtcatcatgtattaggttgccaaagttccggttggctccctggggtgttttttctttttttcagtactacttgtactcatctttatcatttatatatatatatatatatatatatatatatatattatctttgctgataaaaaaaaaaaagtaccccattacccagaggctccttgctatgcgaaagtaagagagaaagatattgtatgcaaccttacctttgcatatgtaaagaggctgttttcagattcaaattcatgaccaacaagtcatcaaggcacaatttagcactatgttagggctcgccctcaatttaataaacatgtaaaagtaaaactactaaactgttgatccttccctttcttcgctgcagctacatttgatgtgagtagtggcattgctggccggtgtgtcaatcctgcttttgttcatgcaatagctgttccagaagtcgacatgctagataaattagacaaaatatgtgctgttgcaaggggtgatggagcaattgatgtgattaatatcgaaacagaaatggctgctacaaaatcaaaaagctcttcaaattcacgaaaaggatcacactcaagatcaaaagatggtagttcatctagcaatacagacgcagatcaaaatggaaaaaagaggttgcatttggattacactttgggtggccacactgcagctgtttccagcctgtaagtcaattcattatctgtgactgcaatatagcaactgtaacactaaactcacttgtcccctaactcgtgggtgacacagggcattttcattgtttggggaaagagggaaattcttgatatctggaggaaatgataagttggtgaaggtatggaattggtcccgttattcagatgctgggttaagtgacgatgacaacaacaataatatcctacatttgaacattgaagtacctcgaaaagtgagttttgtaataaaagttaatttaattggaacttttggatgttggttaattattctgcttctgccaaatatgtctgatgcattcatttgtactctttatttggcaggtcaattggctgtgtaccacctcagctgatacagacaaccttgttgtgtgtgacacatctaaagtagtaaaggtctacactataacatagtttaaagctagatgacagtgattcttggaatgagtattcctggagagcaaacaaaacctaaaatgactgtttgaaactgtaatgttgcacttgctctgaagatcgtgttcctgacaggaaaggtgctaatggcccaaggcttttagcctagatatacctgcctaggttgccttgtgattctctccctgattcattgcctacaggaactgttcaatgatgacctataattattcatttacatggtgatggtgtgattcatgccatgtgtgtttacttgcacttttccattcgtctatgttatctcgcctcgctcttccagatatctcttgctatcttctaatttttggctgtcaaagctattatttgtaaatgtttaatgtatgctagaaattagaagtgaagcttctcttgctaagagtcctcgtgcaaatgtatttctttttacgtttaagttgatcgttttcgagtaattgttagtgaacactgaataaagtaactcactcttataagtgtgtttggatagataaaattgattttgattaaaattgattttaaagtgatgtggtttatgtatgagtattttattataaaataagttaagagtaaaattttgtatctaatgtgcaaaaattattcaaagttatttcaatttagaatcaataataaattcttctttaacataaaattaaacacgtaaaaatatattcaaaatcaattttagattctgaattaataatttaatatcaaattaaaaatacactattatcaatacttgatattataacaccctgaattacacagagccaaaatgaaaatgaatccaatgtagtgtgttgtaaaagattttgtaaaaatgattttattcttaattatagaaatcttctttaattttttaattttaaatgttttgataaaaaaaaacagtaaaaaaactattttcatggttttttatataattttttacttaataaaaaataaaatagaataatgtatttatattaaaaatgaaaataggaaataaaaacgaacattttgtcgacgtaaacaaattcttacatctatagtttttatgcactaattatatttaatttacttcaattttataatgatcttagtgttaaaatgataacaaactatggggatgccatataatcgtgttattgagaatgataggaattaactttttttagtttaggaatcatactgcacattaaaaatatattaattagtatatttaatatttcggaggataatgtgtcgtatcatttctattttcatgatttgcaggagaaatggcgtattcgatgtatatatatatggcatgacctaacgttctagcaatattgaattgaaatatatttattgctggcaacaaacaaaccaagtgatgcaaagttattcctttaaaattggaaaatcagagataattaaatcgggcagcataggctcaaaaataaactagtttttattatttcacagagaaaattgtaattttgatatccctaatttttcaaattcatgattttgattctcataatttttaattataatatttgatcccttaattttataaattaataattttggttcatctaatggattattaactaataattatgattaatagagttattaaattaattataaattaaataaaattattaattattaacaagctttaataatattattaatcctaatattgtgctccatcatgtggagtcatatgcaacggtaaaggtggaagaagagtttgcagaaaagctgagaagcccaatgttgtggaggattatgattaatatttttattaaagttttaataatttttaattaacttaataactcaattaattaaaattatttgttaataatctattaggaagatcaaaatcatcaatttataaaattaaagaaccaaatattataactaaaaatcatgggaccaaaatcatgaatttaaaaaattaagggattagaattataatttaaattattttatgtcaaagatatcccttatagtaggagaataattcattttgagacactttccaatgtattctttttttattgattaaaatttattaaaaaataaaattaagagaaatattgaattaagcaaaacataaaacttacataatttagaatttttaataaaatttaattgatgaaaacaatatttaaaagaagatattaaaaagtatgtcactaatattttccttgtaaacattgaatcaattagaaatagtatacttactccttgtacttccaaaattgacatattgttcacttcatcagctgatgtaccccaacacaactgtcatctgaagcctcccttacacttcccacattaaattgatatattgcacacttcaacgaaaaaatagactttgcttctcatcactcagatagtcttatgttgtgtgccacttaaactatgacaccaactttccaacctcagaaaaagaacccaccaccaccacctccaccatgcaaatccattgcattgctacacaattgctttctccaccccccatacgggtttatgctttttcatataaaaccaatatgagcactgattgagaagcaaagggtcactgagagatatactgacattttggccctttgataggtggtgcaaaactaaaagatggtgcaatctagtgttcccctctgcaaaacttgtggggaacaagtgggacttaatgcaaatggggaagtgtttgtggcttgtcatgaatgcaatatcccaatttgcaaggattgctttgagcatgagattaatgaggaccatagggtctgcatgaggtgtggcactccctatgaaggtaaccctttaatgtctactacattttatttctaaattccaactaagaatttataatttgcttctgtttgctacgtggattgtgactcacgttattgttatgctcccaatttcagtctccatgcaatggttatttgagactggtgatcttgggaggctaattaaaactaatgcatttaatgaatcattcgacaaagtaatagagtattagttttaatttgtgagaaagaggaaaacaaaagtatgtaacattgtttaatttatctataaatcttttaaagaaaaagtatgtaacattgtgtatgtaaaattatttcaaaaagtggtttattttctagttcaatgaattttgaaacatcataagtttgttttctttttctttttccttttgtaaattctatagagagaagaaaggaggaggaggaggatttccatgagataaaggttcacgaaaatgaggatgatgatttccatgagataaaggttcatgaaaatcaatccacaacaccttccgaaatcagtaactctcaggtgataattactaggaattattagttgcacaagtactaaatagctttaattttgaggaaaaacagaaatttttgtaatattcttacgttgttaatttgcatttgcacttataatcacaccttgaattttgtaggatgttggactccatgctagacatgtcagtacagtgtccacagtcgatagtggtaagtgaatgatacttcagacaatattttctactacaatatctttagaagtaagcattgatcattacaaaatggttttttctgtagaagtaaatgaggaatctggaaaatcaatctggaaaaatagagtggaaagctggaagggaaaggataaaaagaacaagaaaaaaaggctgcatccaaggaagaaaaggaggcctcaattcctccagagcagcagatggaagaaacacagtaagctcaatgagaaatgacaacaatttgcggagatggaaaataaactgtaatatttaacataaagcaatttttaaaatttaacaaaaaaatttgattccttaattaggttaacaatgagaagctatagaattatatgccacttgtgcataactctaatgataagtttatgtgaggatagggtagagatgtttggtttgatgaatggaatcagacaaaaacaaaaagttattaatttacaaatcctgtgagaaaacatacattttccaaggtaatgttgtctgatagttataagctgaaatctaaatataaacatttcaatatttcatccgtctaatgtgagacgaagaatcaatgaaaggcattctttttactatttcaactgtcagaagctgatgacatgagatcacaaacctttgtctttacacttcagggaactgaaattgtaattttaccagatattttatcaaatcttcctctgtatagagaacaataacaaactcaagcccctgacatattaaaaatctatttttttacctgagcatattattaattgcttgaggatcattcatcaaatttttattaaccatctgattttgcacctgctagacaattgatttaatttgaatatatttcatgtatttatgacttgttacatttctcattattgcaaatctatcataaaaattaatatatttattctataattcaaatggtgatatgatttgcaggcccgcagaggcttctgctgctgcaccactttcagtagttattccaatgtcaaaatccaaaattgcaccgtacagaactgtgataatcatgcgattgataatattgggacttttcttccattatcgagttacaaaccctgttgaaagtgcttttcctctttggttgacttctatcatctgtgagatctggtttgtattttcctgggtgctagatcagttccctaaatggagtcctatcaataggcaaacgtttattgacaatctgtctgcaaggtaaatgcacaaagttgtgaaatacttggatgtgttttgccttgtgctttaaggatgatttgcactaaaacatcatactgtagaatggaaatgtttgtttctatttctttccctaatagaaattgtgaaaggcaacctataaaaatgaactaatgaaaataatttttccatgttaaccttaattacttcccgtgtaaaaagttctacatgatgaatatgatcatgtgttgtcacatcatcgaatgattttggctgtaacgagttgataactgttacctgatgagtcaaatactttaaatgatatggtaacatattattcggggagagtggaagttttactcttaatcaaaattaaatccatacaataaagtaatatttagaagagctgatactgagcctttgctttggatgctgatgcgcacttctataataccatgccaggtttgaaagagagggtgaacccaatgaacttgcagctgttgatttctttgtcagtacagtggatcctttgaaagagccaccattgattacagcaaatacagtgctttctatccttgcggttgactatccagtggataaagtatcctgttatgtgtcagatgatggtgctgcaatgctcacatttgaatctcttgtggagactgctgactttgcaaggaagtgggtgccattttgcaggaagttttcaattgaaccaagagcacctgagttttacttctctcagaagattgatttcctgaaggacaaggtgcaaccttctttcgtgaaggagcgtagagcaatgaaggtaagtctgtaaagcttcctacttatgatttcagtgatagaacagttttgatagttagatgtatctgatttgctagtattcaccaccttgttttcccaaattgagtatcttagagcaacctcttcatgattgatttacctttcaattctgtcacagagagactatgaagagtataaagttcgagttaatgccatggtagctaaggctcagaaaacaccagaagaaggatggaccatgcaagatggtacaccttggccaggaaataactcacctgatcaccctggcatgattcaggtatatccattatttctgtatgtaatcaactatagtattgacaatgataggcataaagaaaagaacactgtataaagtactgagtcattctgtgtgaaaaaaaattgtttcctttttcatataatggaaaacatttatgttagtaagattgactagtttagttctagcaatcaataattggtacaagttcttgtatttaagcaaaatttatgtttcccatttccaggtttttcttggacacactggtgcccgtgacatagaaggaaatgaacttcccaggctggtttatgtttccagagagaaaagaccaggttaccaacatcacaagaaagctggtgctgaaaatgcactggtatgtatagatagttcactaatattttgtataaggtcattaagattttattatgcttgatgtttgtatggatttatgcaggtgagagtgtctgcagttctcacaaatgctcccttcattctcaatcttgattgtgatcattatgttaataacagcaaggccgttcgggaagcaatgtgttttctcatggatccagaagttggtagagatgtgtgttatgtgcagttcccccagagatttgatggtattgatcgcagtgattgatatgccaattgcaacacagttttctttgatgtaagttaacatcgattcaatgattttatctagagtcgacagaaaaacgacatctccttatatgcaatgatttcaccaaatacacactgcatttgcatgcatgcaatgcagtaactgttaacaaccctgaagtaaaaattgtggacacaactctgtaatttccaaccctcatccctgtttgatggacttcaattgttcatttcaggttaacatgaaaggactggatggcatccaaggaccagtatatgtggggactggatgtgttttcaatagacaagcactttatggttatagccctccttctatgcccagcttaccaagatcttcatgctgttgcttcccctcaaagaagtccaccaacgatgtctcagactttcaaagaaatgcaaagagggaagaacttgaggccgccatttttaatctcaaggaacttgacagtaagctcagttacttttttcaatcagttctagagaagcatataacagaatcttctatgcaatattcttctggtttcttttcttcttgcagattatgatgagcatgagaggtcaatgcttatttcacaaatgagctttgaaaaaacttttggcttgtctactgttttcattgaatcaacactaatggagaatggaggagttcctgaatctgcagatccctcgatgctgatcaaggaggccattcatgtaattagctgtggatatgaagaaaagactttatggggaaaagaggttgtttgcctttaatgcaaatgtttttgtacaaagtccttcaggttcttagtttcctattctctcttccaatgatatttttgttaatgtacttataccaattaaaatctcattctagatgcacagtctttactttttaactcaatttcttttttgattaattaaaacatcatcttctctttccagattggttggatttatggtttagtcactgaggatatcttgtcggggttcaagatgcaatgtcgaggatggaagtcaatttactgcatgcccttgaggcctgcattcaaagggtctgcacctatcaacttgtctgatagattgcaccaagtccttcgatgggcccttggatcaattgaaattttcctaagtaggcactgccccctctggtatggattttctggaggccgtctcaaatggctacaaagaatggcttatataaacaccattgtctaccctttcacatcccttcctctcattgcttactgttctctgcctgcaatttgcctcctcacaggaaaatttatcataccaacggtaatttcctcatctttttgttccaggatatatagttaaagagagagttgttatcaattcagcttaatccgaatggataccaattgtcctttgaaatacagtaagcaaaacaaaagaaaattatttaggttaaactatttacgtgatccctatagttgtctccattttaagttttagtccttttataagaaaacagtaaggtttggtctctgcatagtttttgtgtgacagtttatcaccgcaagaaatttttgtaacaatcttacactgtcaaaaaatgctctctggggtgagtaatagagaccaaaactttatatgtgcatcggtaatgactaaaacttgcaatttattcatgtaaggagtagaagttgaaagagacaattagatggaccaaataaatagtttgaccaattatttataaccatagttatagtcttatagaccagtctataacagttttactaatcatcaatgcctttcatcatgttgttctatacaatttgacacagctttcaaaagttgcaagtgttctctttctaggacttttcctctcaattataataaccagtgtgctcgagctgcgatggagtggtgttagtatcgaagatttgtggcgtaatgagcagttctgggttattggaggtgtttcagcccatctgtttgccgtgttccaaggacttcttaagatgttggctggtgttgacaccaacttcactgtcactgctaaggctgcagaggacagtgagtttggggaactttacttagtacagtggactactctcttgattcctccaacaactcttatcattgttaacatggttggtgttgttgctggattctctgatgcacttaatggagggtatgagtcttggggaaccctttttgggaaagttttctttgctttctgggtgatttttcatctctatccattcctcaaaggtctcatgggtcgccaaaaccgcacgccgaccattgttgttctctggtcagtgttgttggcctctgtcttttctcttgtttgggtcaagataaatccatttgtgaatacagttgacagtgaaaccatcgccgagacctgcattgccatagattgttaagtcacaaaaagaatgcttaccaaaagggtgcatgggataatgacttcatccacagcttgtgcacgttatacaaggattattatttgttagttctttgttgaacggtgtagccatgtgagctgaatggaaaatctgtaaccattagcctgagtatataatttatcaacgtgaaaaatagagattattcagtccattgaaaaaattgaaattcagttagtagtccattttttgctgtttccatcactatgacaacattaccattatattctctaacactcatgagtcatgactaaaatcaaataatactttactgaacaatttaatatttctatttaaataactaaaaacaaaataaaacatattatctaatatatgttctttaagatcaattcttaaaagagatattaacaaaaaaaaaaacttaataggatgccctgttcgtgaaaaagttatatttgaaaaaattaacaaatttattaatcatgatgatttgtgattacatgactgtactttttggtagagaaaaatccaacacctcttccttattcacaattaatagaaaatttacaattagtaaaataaaaagaaaaatgttcatgatttattagatttattttcattctttcaaataagaatatgatataattaatttcctttaataagaatatgatataattaatttcctttaataagaatctaattttaaaaagatatggtaaatatttatacaaagaaattcttgattggacacaagccaatattaaatgttaattaaataaatacactaatactacttaatacattaaatacatatgaatgtgtatgtaatattaactactccatccgtttcaaaataataaacttgttaggttattttacacaaaacaagaaaagttaatcaacaaataaaaaaaagtagtaattttctaaaatttaattttatattatctttaattcatttatacatttttttccattactaatattacaagggacataagtataaaaaaagtaattaatgttatattaaagattaaaatgacaattattttgaaataatttttttcttacacaataattataatgggacagatgaaatatatattatatttaattaatataattaacaaataatataatattattgtatgtgttaactacacataaatacatacatgggtgtgattttgattatttatattttatttaataataaaattttaatatatatttataaattttacatgcatgaaaagtcatatttaataaacatttattatttatgaaatattatacacacatatgcatacattaataatatatgtatttaatacacaataatattattattatattcatcaaatataagtatataataacttgccctcaatgcccatagtcgtagagtcattccctctctctttcccaattgcttcatttgctcgttgcagttgacattaatatggcacgtcctaacactttgttgttcctgttcatgcttcacttagcttgtgtttaaaagccagaaagcttgttttagacaagaaggtgaacccatctccaaaaaagaacagtttgtttctgagtgcatttcctaagggcattgtgccacgtacctcttcaccaagcaaaaaagggcactccgtggaggttgatgagaagctcatagcacgacatctcgtaccaatccatcgatgtattctaaaatttcttctttaatttctttctcgagatggcaccacatttgtttgttggttcagtttttgttttatggtcaaattcttttatggtgacagacgaggggattgtgaatttgtaatacaaaaaaatctattatttgtcatatgtgcctatgctttcctctgctttgcgtatttgttttccctttacaattatactctgagaaatgtaaagattagttacatttttattccttgaacttttttttaaagttaattttaagtttttaaataaaatttgatttgtcaagattttttaactttttttttcgttaagattttagtccatatcatctattgttgttaaatgatgttgtgatgttaatttaattattatttaattatattttatggttgtttattttttaacagttaaaaatcattagaaaatatttgatataactttcaaaccgaatatcaaataatttcaaataatttttaactgtccggaattactttctgttggttctcatactaagaaaatcatgaatatcatacacaaccctcaaatcaacaacaaataataataaaaattcctaaatcaacaacattttctcttttcttctgtgtcactcccaatttcacgattcctacgtttccaagttgtagctcctccttaattctaatttcttctttcgcgttatttttatcttcggccacgttcttttctttccctgaacttgaggagggttgtgccattatttattttaactctttctggagattaaagcaaaaatgaattaagagtttttattgtttaggttatgacaaattaacaaaatatatatgtattaaacaaacccttcatttgtatcactcgtttttcagacttggtgatatatattgagtgttgcaaaaagaagggtttgtgcagtacattttacatatatattatgaatttgtcataacttaaacaataaaaacttttaattcatttttgctttaaccttaagtagaagtattaaacaaagcaatggcagagcccacctcctcgagttcaaggaaagaaagaacgtggtcaaggaaaacaaagcgaaaaaagaaattagaattaaggagttacaattgtgaaattggaggaggggagaagagaaaaggttgttgattcaagggattttgtttattatttatgttgatttggggactctgtatgatcttgtatgaacttcatgatttttattattactcgtgagaatcaggaaaaagtaatttttggccgttaaaaattgttggcaactatttgatatttattttaaagttttatcaagcatttttgataatttttaatcgtcacaaaaatataataaaaaaaattgatttcgcatcaacattttgacaacatcaataaacaacacaagaactaaaactttaatgaaaaattaaaagatattgattgatcaaatttttttaaaaaaattaaaaaataaattttaaaatagtttaagatttaaaaatataattaacccaaacataaatgcatacattttgaatataatattccatttgagaaaatgttgaaggcattttgcattactcctaaatcctaaagtattatctatgataagaattaatacaatatatgtttgaaaaaaaaatatgagatatatttgaatcatttaaagattggattgtacacatcatccaagattgagtgagtaattaaaatatgttaaggattttgctctatttcatttatcctgaagagaaaaaatgggtcttgaatttcacagacaactgtagacatgagctgctgctactcattgacttattgggttttccatgaattattctttcctttaaatttcaggctatgaacttcccaacttattaaacaggaggtaagtattgtccaaagttcttacacgtcatatttacgtacgtgtttcattttctcccatttattgaaaaataacaccctactagctaaaaggtatatcttcctgtgaaaaaaaaaatattttatctgttaacatttttttaagtattatttttctttttattaaagagaaaaaaatcgttagctaaatttgttttgcaactgaatttcttaattaatatagtatgatatgattagcttataaattaatttgttccttaaacataagatcaaaaatggttcaatctcaagtctatatgtataaaataatatttgttgaaagaatcaacttgttgaacagatttcaatattttaaagaattaagtctaagctcaaggctgaaaaaatagtgttcacaaaaaaaaattcttaaattttttaatcgaataataggtctatttgtcaatatattgtttacttactcacaaagttaatttaatatgattaatagcttaaatgattggcttaacataaattagttttaattacttttataaactgttttcactattgtagttatttttattatattatgaaaactagttttggttgcataaaaaatgaaaactacttttcgtaatatgtcaaaaaaaatgattacattatgaaaattaatgtcttaaaaggatatttttgtaaaacaattacataaaaaaaaaaattgaagggtgtgcaattaaagagaaaaggatggggctgcaaatatagttcccttgggcctattaggtgctatggagcatggaagggttaggcctaattgagttttacaaacttcactctagctagttatctaattttaaacatgacgttgatatgttaagatttctcacgtgcataacaaaaataactatagtataatactcctcataaaacacaaataatcctctttctttaatttagttttaaaagttgagttagacttagtccattattaataatattttagcttgttgtttgaaaactttgttgcaacttttcaactgagattgagctaatagaaatttggccatagcgaagttgattttgatataatcgaacagactgattaaatatatagatgagcattatgaaatcttaattgtataattactacgcctatcggtgtgcacatcttagtggagtagcatgttaaagcaatataaagtgaaatccttataattgaaatatgctagtactatttctttgtaataatttagatgttttgtaagtgacacattaaataccttttggttaattctgtcacattatataagtgggctatgaaagaaagattgatctgaagagaatgtctcggatatggaagcacaaacattcaagagattacactataaaaagttgttaaatttttcattgagttgttattacttatcttggtttttctttgctccattggatagcttttcaccaaatcaatcgttggttcagtccaatattcatgagctcgagttctattgttttgggctgacacaaatacacacacaaacgcatgttagagaattttagcagtcacattgctacctgttgctctcaacatgcatgcatgtttgctaaacacattttagccatcgtattgatatactttattttctaaagtgcacgtgctcgtatccttaaccacatactctagctctattaatcatggagttatggaaaaagtttttcaccgccattcatggctgatgcactcgttacacgctcgaagacaaaagatacagaaaaacttcaaataaaaggatgtcagacagtaattgacgtattttcaaagggtttcttaaaataatatattgtaattattatgttttttcttttgatatatcaaaagaaaaaacataataattacaatatatagaagaaataaagaacttaagtataatataaaacgtaagaacagggaaactaaaatgccaaaataatcttgaaaaggagagagatcgataaagagaagaaatataataatcatcacgcccccattgcttccttttaccccgtttttgttcttctttttgttgtcgaactgaaaaccaaaccattgttgacgtgataataaagactagttatcatttatcaatttagtaaaataataaaaggtccggctattggttaaagagagaaccatcaaaggtcgagctaaatgaaataaaattaatgtaagagtagtggaactgaggaaccccatggaagagctggatcccactcgcactattctaattcagttgaaaagttctgaccccaagaaaacattcccaggtaaggtaccattaatattttaaacggataagttttcactttttttatgtaaacattagtattgattattccttccattgtaccaaagaatgaaatggaagacataaatacctcagctcaagttagattaatagggttaatgaaccttttgagtctcattttatatgaatttttagttcctaaaatatattttgatcaattttaatttcttataaattcgtttattttgttttaatttttattattaatttaaattgttaagcgatataacatgacattcacataaacatgtaatataacatatcatatgaacaaatgatattgacatgacaacagtcacccacgcaacatttttttaggaaattaatttcaattactacaacaatttgcaaatgtatcaaaatttatttttgaaaataaatcgttattaatctactagaaaatgcaatcggtagtttgaaacaattgttatatagttaagaactaaatcatataatttactcaattgttatctttaaaaaaattaactatccatgtaaacaaaattaacaaattaatagattacgtttttctaattgtcacattattttagaactaactttaatgaaaaaaaatttaattaaatatcttataaaaaagattaaaattacacatattttttttgagatttgaaagaattatatatatatatatatatatatatatacacaaacttcccttaaaatttaagaaaattataaacattttccctcaatttttaaaacctatataattttcatcaatgacgttcaaacatttgacaataagaagtgaaatctattacaaatgacatttaataagttttttttttttttcaaaatcatcaattaatttaagatacaggtggcatgcatttaaatacgatgtccatataagaagtccctctccttctgttctcactacgatcactcttcttcctactcactagtcactattgctcctgcatgcctttctgaccgttgagttgagccatgataccatcacccctccctccctgcctcatcaccattctcctcttcctcctccccaccacaaccctctcactatccctccctctcgacccaaaccaactgaaagccctccaatccctcaacatccccaccccaagagacccatgctcccaacccacctccttcctctgcgacacctccacacccttccgacacctcacctccatccaactcaccaactgttccacttccatccaccactccctctcctccacggccctcaaatccctctccaccctccacctcctcaactgccctatcactccctcctcccccatccacttccctccccacctcctctccctaacctccatcaacagcctcccccacctctccgccgcctccctctcccgcctcaaaaacctcacccacctcaccctctcctacctcaccatcaaaccctacctcatcctctcccacttcaccgccctccaaaccctaatcatctcccacgcacacctcaccggctctctccccaaacacctccattcccccaacctcacctacctcgacctctctttcaacaaccttaaaggcaacatacccccctccatcaccatgttggaaaatctccaagttttaaacctctcttccaatgcactcaagggtgagataccctcttccattggagacttgatttccctcaaaaacctctccttggctttcaattcgttctcgggcaacgtccctgattcgttatctgccatacccggtttgcttcacttggatctcagctccaaccagctcaacgggactattcccacgttcatttccgaaatgagaaacctcaaacacttgaacctcgccaacaacctccttcacggggttgtgcctttcaactcaagttttatcgacaagttggaggtgttgaaggtgggtgggaatgggaacttgtgttataaccgttccgttatgtcttccaagtttatcgtgaagcttgagattgctccttgtgataagtttgggaggccggtgtctcctccaccttcgaagcgttctaattctgcggatgatggcagtgatggggattatgattatgatgaagatgatgatgatggtggtggcagtgcccgtcacatgaaggagcatcaccatgggcccaacaaggtggttctttgtgtggcaatagcgctttcttccattgtctttctcgttgttttcctaatactgtgctccaagtgctgtcgctgaggaaaaatttgatttacgcttttctgaatttagaatataggaattttggtcatttattcaaaatggttctttgtttaattcatttatttattatacgaattcgaaggtgaagaggaagagtattgaaaaagaaatgagagattgccaaaatgtggcacccgatagaaacaggaggggaaaattaatgtgcgagttttgtttcacttgctatttttaatcaatttcttgttcggtgcaatcatttatatacaaggtatcatgatggtctttgccacttttgtaattagttgtgtattaatgtttatgaggagaagaggtggtggggatggatgatgcatatggtatccagaaagcatcatgtggtacccagaaagatgtgattaccttgtgctataaccacttatttctctcacacttctcattgaatacgccgttttgctgacccagcgagcctcaattacacttttgattattgcaccacgctttcattactctttttctctcaaataaactttgaggagcacatgtacactatcgttgctctttgtctcaaattaacctttagtaccacactttcattattattttttatccaattgacttttgagagggttaggaatacaatttctagtaaacttgagtagcacactataatttttttttttttttatcaaatagactttgagagggttaggaatacattttctaacattaggacacttttgtaatatacattactttgttgataaatattattttttggaaattataaaattagtattgatgtatttaatttaaaagagagaaatatggtagataaaaattaaaaaaaaattgaaaagaaaaaataaaataaaaggaaaatgaaaagaaaacttgacttctaaaaacaaaaatttaaaatttttcttttttttattttctttccaatttaaattttttctttttttttctttccattccaccgaacgaaccatgagtctcaggcataaagttagggttcgcaaattgtgttgtattaaaagaaaagtgcttccaaccaaaaagaaaacacaggaaagtgcctactatgccatttgtttcttatgaggcttagctttctgctaatttaaatttcttctaaattaaacctgtgaaagaatttttcaatttaatagtttatattgtttaaatggaaacttttttatagtcttttctatttgcatctcttgtactatgtaatttccctaaaaataatgtttgaccattgtttcatttgggaaagaaaaagaaaagccgaagttatatttaatttatttctggttttaatctatatatatggggtaatatagtgattccattatttattggcacaacttgatctataggagacgaacaacggtgagctggtcatggttgatcacatgatttggtaagtagggaataataatgcatggtcgtggatgtctggctatgatacaattatgatgtccatgctgattttattgtggatggtttggtatgagatgtccaacataccctgattaagtagctaaatatattacagcttggtttactttggaatgctccaattaattagccccatacgaagtacaaggaaaatattgcactgaagcctaagttggcaagtttgagcagtccaagaacgtttgagggaaaatgagaagataaatggccatgtagagaacctcaggctcaaagtaacaatctaccattattgttgtatggctaagcttgggtgaaatcaatatttgaataatgatataccttgatggcatggtatcatgtataattgtaactttgtacattatgtatattatatcacggtttcaactacagaatttttatttgtgactataaatctttacttttccttttaaaattagtagactgtaaagacttatgaatgatataatccattattattttaacccatgaaaatgattttgaagggctacatttgtgacttttgagaagtgaagttatttgattcacattcctttaacagtagacaaacaaattgaatgtgattacgtgaataagtaatgtttcagctgaatcatatacttaacggagagcaatttgaatctaaaatacctcaaacacgttacatgtttagtatgtggcgtggcatccacttgcaattatactcctaattcaaaaaatgggtacaaacacaacacactgcgctgactttctcattttttaagcatttttgtggtcattctcatttttatccccttctcaagagtcaagattggtcaacattatcagaaataaaataaaaaaaagttggaatctaaaagcaaactgagatcactcacagagtcacaaatcataaataacatcctgccactaatctatttcagagaaaaaatgttacatctgaaccccaattatagatctctgctacaatgtttttccaatccaaatatagatgtttagataagtcatccatgaataacatcacttcacagacgaagttaggacataaagttgcctctgacgtaactacaaaaacggtagcctcaatcactgattctacacactatggctatcacttcaacatacacttttttggccataacgttgtatcctaatctataatgcgtcctacatcaataagagaactgtgatcctgaaatacgcaattatcaattctcacgaagagaagaatgatacactgacatgggagaacttcccctctattgaatttttccgatgatttactagaaacctctgcaagaacataaaccatccttgaaatggtgaaaccggtttgaatctcgcaacaaaatttccctcccggttgtcttggacatgaacttccccatctcatgacagtccccacatactcttagattcttggttactctaacagtcctccctggaggcaaatttaatattccaaaagccatgggtaacttctcactgtgtccacgtagaagcacttccttctgcctattatctgcattaatcaatgaacacctcatcttattagagtaaccttccctattcattttcattcgcaattttctcagcaatgagtctatccttttggcctgggggtgtgaagtatccccagcaacaaagatattaaactttccttggacctttatcaaactacagccttgatcctttttcaatccacgtttacttatccttctttgtaactttttcacttcttcccacttttcggcctctgcatagacatttgctagaagaacataataccttgtgttctctggctcaagctcaaaaatgctctgccactttttctgctagatccacatcatgatgtatcccgcgcccagaaagcaaggcatcccaaattgcagcatctggtttaattggcatagtttcaatgaacttgtacgtcctggatagatttccagagcggataaggagatccaccatacacacatagtgttctaacttgggctcgtgttgcattcacttctcatggaatcaaagaatttccatccctctctcagtaatccagaatgagtgcaagcataaaggatggaagtgaaggaggactcttcaggctcaatacctgcaatcctcatcttttcaaatgtggatattgcttcctttccaaacccatgcatgccatatccagctatcataacagtccacaaaatcatatcctttttaggaatcatatcaaacagttgctatgcaagaactagtaacccacatttcacgtacatatcaacaagtgcacaggctacatgtaaatctgaaaagtacccttttctcaatatgtgcccatgtatctctctgcctttctccagagctgctaagcctgcacaagccattgtaatgtcatcaggcttcgactgtttttgcatgtccagaaacagctctggagtttcgttggggagtgagttttgtgaataacctccaatcattgcattccataagacaatattcttgagtggaagttgaaagaaaattaaattagcttcttccatgcttccacattttgcatacatattcatgagagcattagaaacaggcaaacttgaccccatgttgttctttttaatgtaattgtgtacctccctatatccaagatgttgctaagcatgaacaacacttgtgacagcataaatatctggcctaagacctttgctttgcattgtcaaataatccaatagcctcatcatgtagaccttatcgaacatgagcagctatctatgattgaagtccaagaaactatagttgtttcacccatcttcacaaaaacttcatttgcaccatttaaattaccacattcagaataaatgtctagtaatgtgttgttaaacatgacatccccactgaaaccaactttcactccataagcatgaagagttctacccaatgtaaggttgccaatatttgcacaagccacaagaacgttaaccacggtggccgaatccacatcaaaccccaaattcagcatctggatgaaaaactcaagtccatttctggaaaacccattcataacacacccactaatcatggaattccaggaaacaacatctctgtcactcaattcatcaaaaaaaaaaaaatacgtgcactctcagcttcaccagatttaaaataagctgcaattagagagttaacgacagcattataagaaccaaaacccagttttaaaacatactcacgaacccttttacactccctcacctttgccaatgcagcaaaacacgtcaagatacaagtaaatgtataagaatcccctctaattcccaacttctgcaatttctcaaaaagacccacactttccctgtacttaccaatcttcacatattcagacatcaaaagatttcagaggaaaaccttatcattgaggatcccatcaaatattcgtctccctttaatcaaatcaccacaattcacatacataaagactagttttgcccccaaaacctcatcaattgccatgccattggaagtgataatggaatgaaaacctctttccatcttccaaagacttaagctgagcacagagctgcaacaaagaacagtaagtattcaactcaagttcagatttttgtgaccttgagagcaattccatggcgtttcttagatcacccatttcgcagaacttgcaaatctttgcatttttgtccacggttacgtggttatgggtggtctcagacaaagccgcagagacaccaacactgctaccgcaagaaaggtccaaattcgaaggtgacagacatgttgtcctagattgtctgaagaagatgaaacaattcggagattttgcatagtttgatttgttcctatgactatgatatgttggataagtgctcaacgttgctatacttttcgacatggtcagcgttggcctctgtcttcgtcttcaaacaacattgatcccactatacatacctagttacctacctacacgaaaaagaaaaaaattatgcctcgttttcgttctgatcttctcagttcccacgtgtacttatgttaataatgttacgacattattgtttgcaaaattgaaaaaacacttcttccgttgccgggacttgaacccgggtcgctcgggtgagagccgagtatcctaaccaactagactacaacggattgatacaataagctttatattatttaattatatttattaatgactcactacgtacatatggtgatttcttgtgaatttttaaaggattacagttgaactcgaagcattcgtctccatactctcaattttaaaaaaattcccgtacccaaacctatattatatgcatgggtaatattaacttcgatgcctgtgccttttcagattggataactaaatgcccgtatctgtattttataaaacatgactaaaattgaaattatattcaaagatatttcaccaaacataatcttttagtaaaatgaggaatatgatcaaatcagtgacaaacctatatataaccttctgaatataatttgccccacaaggattttattttattttcttaatattatatgtatgtattatgtgtatgtcatacccccaacaagtttacatgtgtatttaatccataggttaaatttttttatcacgattaaattttgcccctcatatatgtagcttcaaaattaaggcaagcgttcggagcatatagcttttaagaccaattttacttaggttagaagctagaacatttgcaaacaaaaagaaggcaatagaaacacattgatgacaccaaatgacattggattctttgaacttcatactagcagacaggtcaacagagattagaaaaaagtgaaaaaacgaaaaagggagaaggaaaatcaaggagaggctccttttgtttgattgttttacagcgaataatgtaccgtttcaaagttctaacataacatttatgcctttgggaaacagtaaattatcttctttgctttactcctttataaaatggatcccgctgttatacatatctcagtaaaccacacgcactccaattaaaagaatgcaattgggaaagaatttggccataacttgccaagttggtaagtttcttaacaaccaaatttcaaggcttcagggaactacataccctgagaaatgtgaagttggtcatggttaagcattaccaccccttcagaaaaacaatatgcaaggagcaaatgatgcactcatcatttaggcaggaataaagatttgaagggaagaatagtgtttgactcctccattagaacatatttacccggaagaaccatggtagaacaaaagctattaccaggcatgccattaagaagttacaaaatggttgtccgcgccagcatccaccaaaccttctggatgaggtattatcactgtccatgaatctagtatcgttccactcttcaataaatccattatccgtaacatccgaaacattttttgcagtctcaccacatatttcacacaacctgtgatcatgaaaggtaacatagaacaaaaggaacctcaggattattgaactaaaacctagtttgaatgtgaaacaagattgaccatgcttggtgataacattcttataaccatgtaaatgtttaaaaaaaacacatgtaaactcttctctctcagcttaataaacaagaaaggatatcaaattacaaaaagaataacccacaagtacataggatgtgaatggaaaaaaaagtactgatagagcttcccccacccccacccccacccaacagctttcaaattcttaagggtcctaagatgaaaaaagtacatacattagagtaatttcaaaaacaaattagaattcaaatgaccaaaaaacaatggtattcccagaccattcttcaccaggaacagtataattgtgaaccacaaaaatttgaatttagcatacatatgaaacatcatatcgtaattcgaattttgatgtaaacaatattgaaaacagcgactgagactctgacaaagctctagattgaagcaagttgagagagagcttctcatattatttcatatattcatatactatacactaaacttatgcttgatgtcattatttggaattttggatgtcaatcaacctcagttcacaaccactagaaaccaggccatttgctaatacctcggaaaaccaaccaggtgtctgaatcaatgtagtcaaacttgaagatcgtaataggatcggagggggggtaaaagatcgtaactcgaggatcgtaagagttacgtgtatatgtaaaattatatttatatacatgcatatacataaaaaataacatagacaagaaaaacaatactggtttataattttttcactctgagatagtaacaaaaaaatactgccattccttgaactcattaatttagctaaccaggaaattattttcataaacaattgaaattgaaatacttaaatgacaatcaaatcaaattccatttttagcatcacaacgaaatccaataataatatccttattctctttgatttgcatggtatgattctgtgtaggatgattcaactcaacatatccatccattatatccagctggcacagaagattgctgtgtccatatctaattggatccaaggaagccattcgaagatgtccacagaaccaacaagttcggcccactcggtttcctctcaatattctaaacacacaaaatcaaaaccccaaactcattataaactctcccaaacccatactacactctccaaacacactcacaccaaaccaaaccaaaccaaatcccactctttatctctttctccgcgcaaacaatccttctccaaggcgacgccaccgtacaactcccgatttaagcaaagaccaacagaaggaggtgcttggttgcaaatggcagccaccgcaagcaacaacgacgtcgccgccgccgccgccggccccgtgatgagcctaatcaacaagagcctcctcgccctccgcaagaagctgaactgcaccctcgccatggaagaggctattgcccagggcaagcctctgaacaaggagcaggaagaggttctccgctccaaaccttccgtcctcgctctcatcgacgagctcgagaagctccgccagcctctcgccactgccctctccgaagagctccaaaacaacggcacctcctctcaaaactctctcgagaacgagaccgaaaacgaaacccaattgggattgaaacggatcgtcgatccgtccacctcgcaagcaaacgcgcgatcccccaacgatccgcaaagtcaacgatcctccctccgagtaacctcgtcgacccctctgaaaatcgcaagatcgcacgagtatacgatcatactcgcgatcttgacaacattggtctggatgcatttggccagctcacccctcatttaagtctattaccaatagaaactccatgtgtcacggcacataacaatgatgtcagttctccagttagagatgtaccagtaaaaattgaaacagctatgagctgcatacattaaccaactgactaatgataaacaatgaagacaatttcaaaagttcatcctcaaatttacaaatattttggagttatgagtttaatattgataagataataatagtaataaaattgtaatttagaatttcctattgatgataacgaaatttaataatgacaatagtaacgctaatgctatatgcataacagcacaagtatgcagcagaacttcaaagatttcataagacaagaaataaaagaaaaaatctacctattaagcaaaagaaaaaaacaaccaactattatcagaaaagaaataaatgttacaaattattaaaataatgcatagcccaagacgatttctttttcagaaattctgaaattgtgccaaataggattactaaatactaatactaattaatcagaaacatagaaatcctcagggcatgttcaatgttgcaggcattaacaaaaaacttcaagaaaaactaaacaaaatgttgatctacatactagaaataaacaagtattagcaaaagcaacagttacctgtttcctttaagcttgaaccatgcctcagcacaatgactatgcacaatccctagctcatctttacatgcacaaccgagctgaatcaaatctgtatgagtagtagcactacttgcagtgccaacatctgctgcttccaatggttgcccagaggccagatggcaaatcctacaaatcatttcaccttccaaattctcactaaacccatcacagctgtgacggtttatatcaatcacacatgaatttttatatgtctcagacaccccatttgtcactttcatggacaccttgttcaaccctgattcattaggttttgcttccaatttcctattatctccattgacacactcaacctgagtagaaggatctattgcaacacaagtctcagatacttccccactaaccaaatttcttgaactataactagttccttgatcaaccctatgcaatgtatcattaatttcttgtgggtcacccatgttctgatcattagcttcttgagacccctcctttagctccctattcaatcgaagatcattgtacatctcttttgaagtcccatcttccccacttacattaactccttcatccaagctatgtccacctcctgcatcaattgcatttccttcaaccaattggttcaaatcctcatccaccctttcatcgacataatccaaaatctcaacactgcctttgctttttgcctgatccataacaccaatatcaaattcttccactcagtatttcaaaacctgaagaaatttggaaaagaaactcctgacaatacataacgcattcctcccacagtgataaacccaaaaaaaaaaaaaaaaaaccttctgttatttgcagaggatgaacaatgtgatcaaataaaaggcggaaaatacatatctttcaacaaccccttttcatgttttgagacataaccttcagatattgttacaaaaacataaacacacgcaaacaaaaaggtaaaaaatgaaacttggattaccaccaataggatgtttcacccgaatcagacacagaggaggatttacctcaaacattagattttagaataaaaaatgaaactgggcatgtttgaatccaagcacagcgccttaaaagctctggactttgcccctggttttgggtgtagttggaagaatggacaaaattgtgattatttatatgtatgaaaaggagtagcagggttaggtaaggaaagtaaccgggaaaatggtatgaaaattgaaaaaagagattgagtgcatttgaatcatttgatggaatggattagtgtgttaagcaaaggataagaaattgaggattttgtctttattccatgctttttccttaaacccttttacttttactacatgttttaatgaactttgataaaattatttttaccatgatattattttttcaatgaaaaccaaacatacacacaatcactcataagtttagaaaatattgaaaataatacttaattttattattattattatttaacagcaaaaggcaaaaaaaattattgaaaaacactacttaagcacaagtttgacaagtgcaattataaagtagcatgctttctacataattacattaccaaatctatgccaatacattattatgatcattattattattattattatttaaacattacgtctttgtaatttttcagtcaaaaaaaagtcatagtaatttttaagattgattttaataattaaaatagaaaaaaatagaaatgttatacttttacattttcaatgtaataatattttttatgataaaattaactatgaaaactaacgttaacaaaattaaacaaaaggataactactaacaaatcaaaagaatttatttatcaatttataatattaattataatttaatgccagttatctaaaaaaaggccagtttaaactgaaggaatacgagaagtgcttaaatatcttgtattaaagattcctcattttgcgttttgacagtcaaattctataaaaatgtgacctatataacaattaaaatacaatgttactataactaattaattaatataaaaatcaataaatttactatataccacaatttatgatttgatataagtataaaaatacatttttcactcttaatgaataacttatttactgttttttaacaaaaaaaatgaagatgtctatatttttaatgaaatatatgtttacattttagaatagtagaacacatgtacataagtaatttttgtctattttttagtcttatattgagtaaattcataaaatgtcttatataaaaatatattaataatgtattttacactgccatttaattgataatatgagatcgagtttatgattgatctaaacaatatttaattaagataaaatttactccctcttgataagtaaaaaaaattatttcacacttattaagaattattaaatttcattaaattatattaattctaaaacaaaaatatttttttttctaaattacctttccttaaaacttaatatcaaacataacaaatgtctttgactctattaaatgaataacattttaaagataatcttgttaaataatacaaaattagttaagttttgcttatatttgagaaaaaataaataaatggttttattgcttataataaaaacaagaagaagcaggtttaaaaagattttgatccttggaaatccactcaaattcagaagatgctattcgtatggttaaaggcaggatcttcatgttagtgataagtgtattgtggatgcgattaaggcaagcattgtgcctcttatgagtgtccaatttgttcatgtgtttagagattgtattaaggtggctgaccattttgctaagtatggtctgtccttaaatcatggtttagtttcctttgtggaggtacccttggttgtagtatctactatccaagctgagtttcaatgcttggtgtaactgttccgtttttattgtttttcgggcgtttgcccctttaatcagcacaaaaaaaaaaaaaaacgcttaaaaaaaattaagtctatctatcctggctcaattggcctattgggataggcttagctcctaaaatttagaccggaaaagttgagtttaattgacccaatctttcaattaaccatttaaattttttttaaatctatatatattttaagattttataaaattatttaatcttattttttgtttatttgtagttaacccgttagcctaacataagactaagtttgaacaataaaaatttgcagcaagaaaaaaatttagcccaattcaacaatttaacactctctcctgacgagtctggaaagcctgatttaccaaatatatttattaatttagatatatttcaatcacattcagtaacttaaattcaactatatcaaaatagttatacttatatcaaactctaaattgaacaaatattaaatctattaagcaaacaaaatagaatttcatgaagagataagtaagcctactactaaaaatgatttgctcagttctcgagaatattttaccatattagttggaacaatcaaaagataagatgtaggagtactcttttattaacaaaccggaagtgtgcctcgtattaaaaaaaaaaaaaaaaaacagttctagagcaccgaaaccatgtgatatctgacaacattatttagtcaattaagaaagaaatagaagaatgattaaagttgtgctcatggcacaattagttgataaaatactgttttttttataagatggaactcttgtaaccataatttttcttctatcacgtgaaaattgtcagttgtacgtgattagctatgattttagtgttagtaaaaaggaacacaaaccatgtattaagggtagaaaataacaaattaaagaacatattcccctttaggctttagcctactatttcttgctcacgtggttctgataaactggtatttgcattaacaaatgaatattagtagaagccaagaatcaattccaggtgcatgttgattgacgaatggttccttagcggattcaaatcgtgaaccagagataatcaacaagtcgtcaatagagtgattttaggacgagaatatattaacttataataaattaaaaaaattaattaaagttttagttaatgagattttaaggattaaaaattaattttttttaaaagtgtaaggattaaaaatattaatgaaaaaatttgaaagacatttatcagtcaaataacaatttagagactaataactttaataaaaaatagtgaaaagaccttgatcaattaagtaaaaatttagaaactaaatacataattttaaaaaaaaattagagattaaaaacttagttaaattttaaaataataattaagaaatgataaagtctttattaaaacttaaaagttttgaatttttaattgattgtagtactttagtgaatgtagtatatattctacgtagatgtatgaaactcgtagttactttgcggcaagcgggacctgtgtgtttggtttgattaagaattgattataagtttataattaattttggatatattttaatatatttggttagaattgatttagggttcaaatagttttgaataattttttattgaattaaaaatttatacttgaattttactgttaattttattctataataaaatatacaaaaataaattacataattttaaaatcaatttcattcaaaattaattttatcaatattcatctaaacactgacttactgataagaggggatatgtgtatttcgtttgcagctgttggcttgattgagatttgaaagttgaaaccaggtgctggcagtggcctttgctagttgatatgaatgctcacaagtcacgaccactaatcccattcccactatgcattagtcttaaattgacaaacatcttcagataacggaatttcatttaattttctgtggaattgggggaccgaaatcactcgttgaattaatgtagcatacataaaaggcagaaatgctgctcattcttcaaatatagaagaaagcaccctgtatttaaatattcgtggtcgttaggtgatgtaagcaatatagtacatttttaactcctcattcctaattaatccctcgaccttgtgttggtaacaaggaaactacgtttacataaatagtctaattgaatattttaaaaagtgttcagatccaaacatttttttagagattttccttttgttgttggctgatttgttggttgttgtatttttaaagtactttatccgtgtttttagttgtttttcaatctttccataataataataaaaaatgactatgacgacccatggtcaagagtaaccacttaaccaattttctctccatctatcactatgtaagacatttcatgtcagatatacatttgaacctcattattcaattcacatattacacgatttgactttgacattgaaatgtttgcacaggtgaatacaagtctcataaattcactaggaacagccattgtcgctgcctgagctgtctgctccgtccatcatatttggatctttccaaacaattggcgttagaacttgaacctctaagtctaacatactaagaagtccttagaaaaccttaatagatcatttccccacgacctaaggttatcaaaggaaggcactctattaaaatatgattggtccctagctcaaggatccaatcgtccttccctcaagcgttttgagcctacaataaaaaaatattaaaacaaactaaataaattgcaagaattataatttttttcacaaccagctaaatttcttcttactcaacaaagaaaaggccactatataatctgatgataaaggagatcgaccttgcagctggcttgtgacaaaagtagggacatttgtgagtcaatttggttcacttattcatcaaaaagtcatccagacttataaaatatacatgatttagtttgattcaatttttatttaaaataaaattataatcaaaccaaatcaatattttatgatttgattaatttttgtaatttttattaaaatattatttcattaaaatctatatactttgttttcatcttttaaattaatttacattaaaaatttactaataacaatctatgaaacttattaatatgtcaaactttctataataaaaatttaccaaactttcatccattttagattaaatatattcaaaaaaagaaaacgataaacattataaaaaatttatatatataacacttacaaaatactatgaaattcaagtgacacaacataaaatacataacactaaccctaaagtaatataagtgtataatttagttcaattttaaaaacacaaatcacagactaaatcaaacagatgaatttgaattttgaaaaaaatatcattcaaataaatcagaagcaatagtgcactgctgacacgctcaaaaggacaaatctacgcataaatccccaatgtaacatggaaattaaaaagggctgaacaatataatagactcagtggagacaagtgtttgaacaaatttatctcgtaataggactacatgtagaagaataaatttatataaataagatcaagacaaaaaaagaagagtatgatatataatataaaaggagaataaaatgttcaacgagacaattcgtaaaacttaaacgtaactatgaatatcacactttaacaatgttaagcttattattatttttgttcatagagcaacctctaaacctggtttcatcaagacagaaagtaacaacttcaagaacatcaagcccttcttacattttttcttccatcttaattcctgagaggagacgaagattagtacgtataaaaaccaaatcacactcttagggttgagcctatttccttttcatggaatggatagaagatgtttgggaattgtagcaataaaagaatgaaattataacggagatttttttaaataattttattttgttcaaaactatgcactttaacgaattgaatttaccagtattttgaatgaattgtacaatttttttatctattcaattatattagaatacaatctatgagactaacatatattttttttcttagattagataccatgggtgccccttaatttattggattagagactaatctcatttgtaacatgtaattgtcattgatccaataaaattttgtatacaataagattcaaatatatattgattattttattaaataaatcattctcaatcatgtgaataaagtgaggccttataatactgcaacaacccaatgattgatgtaatagaagattcttatcctaagctatttattatgaacaatttatattaacttaaatcattagatatttttcagttaatagcaatgcttatcctaaggtattcgccattaataggaatgcatattccagttacataaaacaaattttcaccttacttgaattccatgaaccacttagtattcggttttttcccactattgttgctccccctacttatattgtcaatgataacttgcaggacttatttggtgatcaaaatagaatagaataggaaataacagaatttgagaaggcatatgttttaggttgggttttttttcctttaacaaagacatgcatattttgtttcaattttcttagcgtgttacaatatacaaattatatatattgacgttttgagttgtacatatataccttgtgcttaacatttttactaacgaaatatttgcttacaagtcataaaccagttatgaatatgctccaagaaataaattaaccaaagccaactggtagaactaccaccatccattattatattaaagcaccttaacccgaattaaaaaacgcactagtagttcataaacttatcatttttggagaaaggacaagtacttaagtagtaatatgcccagatccaagacaagactacaaaatgttggtgtgcttagagaaacctataggtttcaaaaggatggatagtactccatagtctaattcactataaagccaaagatgaggcaacctctttgattggaaaaccaggcgcagcattgatggcacatacaccataaggccactcatcgctaacattcctttttattaagaggtaaccttcctctccccagtcttttccccacgagttcttcacaatccaatagtcttcgccacccgccgaaccataacccacgattaaacaaacaagagttgcttttgttgaattctttgagcagttctcaccaccatagactccctgtgattatgagaaatcaataatttacacaattagcatacacatggaacatacccaaagttttcaattttgaataacctttaatctctaggcattattcatattcaattaaccacttgtcaataaataaagatacttacacccgcgtaaaattgaaggccagttgcatctatgctcacactaacaggctgtttgctaacacggcacaagagagcttcttctggtccaaccacaactagaaggttatcgatactaacaaccttgtttgcatttgccttcaagaaaaagaaaaagaaaaccttaaattaagaagacaaaaacaatgtctaaatttattgttccaatttatttatttattttttaaaatttgaaaatacaaaaactaagctaggaaaaaagtgttaacccagaccttgcaagtaccgttttgggctatgtaaggataatgagcttctgtgtcaatgccaccattatctataacgtaaccaaatgcattgaagtaaaagcctccagcacagccattgctagcagggtcacaatccacgagttgttgtacagatagggtgataagattcccagtaactattttgtttattccttcgatggccccggtgacactgaaagcccaatggctttctaacaaaacaacatgttaaatcagtccaaaaaattcgtgcgtgtatatatatatatatatatatatatatatatatatatatatatatatatatatttcgttaatgttgtataatgaaactattttactattcgcatctttttgaagaagtaaaaaaaaacaaaaatctatgtaaaccaatgactttgcttttagttgtttcgcaaaatatttatagtgtatgaattaattaattttgagaataaaaaattatatgttttctgaaaaatgttttttaattctaagttagaaaatcatatcatatgtagccggctacagtgaacaacacaactcattttgtcacttacttgaaaataaagagattatttttttaacacaaatttgagacatcaaaaagtttattgttgagatgcacgtatatggaaaataaaataaaatcttacggcattttccttggtctctaacttgagtgacagctcccttgttcctccaatctacagaatcaggaagattatcacagtcatcatcatcatcacgcttctgcagcttcttcgtcctactctccaagttggaggagggtatctctatttctttcaagtaggtttccgcaaactcctcaggactcatatcagcaaacttgttcagacccaagcgatgctgcgtcggtgacttcctcttcgcattcatctcattgatatacctcagattcctttggaatatctggaacctctttgccttctcctctgggttgccatattcacgcttatgctccttctgccacacttgaaacacttcttcatcctcccaagaaaacttctccaactggtcactggacatagcaagggagagactacatgtgaaggaaacaaggagcaagaaaacaataaataacttggtcatttggaaagtcatcattcacagaaatcagtaaccttgttaatggttatgccgttcttgtgaagctgcgtgacatatatattgagtccgtgatgaagttgcttcacctgccacctagctgttaggtgaactagtattgatcgaatactcacgtttaattcgtttcctattttttatgccttttttttgtttctcttgcgaaaatgttaaaaattatactccgacacacattcttttagacatattttattaaaaattacaaaagtttgtaaaataaatcacatgttatttaaccattctctgatttttatttcatagtttcaataaattttgattaattaaagaaaatgtgtcccaacactaacgctaaagaatgtgttcataatatatctcatttttctttggttaaattttagttttgattcttttataatttttaatctgtagttttgattttcctgtttttctatgtgattttgttttttctattttaaaaaaattacaattttcgttcaatctttaattatgcatacatttatttctttcattttatattttaattaattaaattattttaaatgatatattaagtgaatattttagattaatagggtttaattggaccaaaataaaagaaaaaaatatttggaaaattgagaattggattaaattttaaaaattttaaaatagagagacaaaaatcatgataaaaatcaggagaaccaaattacatattaaaaattataaaaaagtaaaattataatttgattttttgtttttaggtggtccaatccaaatttgtgagtggagtaagtacgtgttattcattcttgtcatataccactagaatttatttatatgtaattttattcgcacgagtctcatgccatcttcccactcgagaggtcccccaacgctattttttttataccaaaatgataaaaaaaaaaacgatatttttgtaatggtgataattgtcccatataaatttacagtacttatgaacatttaagtaaaaatttgaatttcgcagagttaatttttttatatatctagttattgtattgaatttttactattaagtgaattcaagtttgaattctctattttaaataagaagtaaatttcgaaagaatgcgttaatataaaattatttataaacttttagctaaaaacttaagcgtacgttaacggtaattcataacaatttatactgaaatttaatagttattgacattgtccatggtccatgggtgttcttttgcaaattatagtgcagaaaaagacgagaaagatgtaatactggcgtttctccgcaggactgaggacgtgcattacctctgccaaaccagtgaatgagaagttggcttttttcatcaaaatagtgtaatattttgaattaattattaaaataataaatttttaaagaaattacaaatatttttatccttttattgggaaaataattttaagtgtaaaattttaaaaatttatatcatttacaattgaaaagtattttacttttatcgactaaaactatcaaaattattttataagtgatcatgattgaattagatatgattattatgaataaaaaaattattttaaatattttaatgtagttgtatattcataatttatgttaaacagtaattactcaataataatctttatatcattacctaatgaattctagttttatgtataaaaccaagattcaaactctaataaacatatttaacaaagtcaatttgacaatttttttagaggactcaattatatgtcaattgtgctggaatttgttattataaattcatttttttgaagtgagatagtatatacataattaaaatacataataaacttaatttttacaattcaaattggtaaataaagattaagaaaaacagaaaaatatttaaaaatgctaataaattaaatttaagatatatttgaaatttaaaattatctacatacatatatactcattaatttttaaaataattttatttaactaaataattgtaaacagtaattaatgtgttaaaattaaggttgaattgtttgactaatattcgaattcatttgaggaaaataatttttgatcaaattttatttatttttgatccaattccaaattaatcatatttgttttctctcattgtggcagaaaagaaaatccaatttgcttaaagggccgggattcttctctttaatgtttatttctctcttctatcttttttcactctctttctcctcactaatacaaaataaaaattaaatagtagatcagtagaaaaagcaagcgcgtggttgcaacggcacctcatcacagtgaaaaaaagtgtaccgactaatagcattggagtggaatatttagtccatcctgttgtcttcgtcagacacatgtaaaatccgaaagtaggcataaagcaaaagaagacgaaataccgaacctttctgtctctatctttgctttcctttattcttactcattcattccattttgcaacttaccaaccacttccttgtgacgtgtttcattcatctctcatgggactgaactctctcacccagtgatgttcactcactacttatttgatgattctattctatcccattttttgagttttatctggccaattcgcattcttaatgctacatgaccatgaaaaaaaaaaaaaaacacacctaccccagacactattcaatttggcttgaactgcaaatgcctgggatgaccacgtcccatgtttcatcctgttattaaataggtttgtttgatctttttcctcattaccatttatttatttattttactctagtgggaccttaagttaagcttgttagctgctatatatgatgattcatgaaagttctcttgctttatctgtttaatttattaattgtacgtagttacctctgttgttgtttttttgatagcaagacttgcaatggttaaatatttgtataattggcttattgagaagaggaaaataggtttttataggaatccgatcatcccaggcttgaatatttggtttcctaagcaacaaatgtcaaaacttttataactaaagtgcatacctttttttcccgttccacaatctcaatagaccattacagaatttctctttttctttggttaatggtggagaaaacggaaagttatttcagtcatcaatatcctgttatcatgagttcattttggtttaaaattttgctctctggttgcattattgtacttctctgatcttggttcaagtcggttgaattgaaatttgaaacagagaatctgctgtttaaattgtaatttaaaatgtaatgatctggttcctgcaccctcttttcagattttcttgattgaatagaaggattcttataccacatcctttttgtgctgaaattagtagcatatgatattcccttgattcttgaacttattattgagagtgcaacatagaagagttcagttgagttggtgtggaacatgatgaatgaaaggaaattgaatattgatgctcctcttatgtcggtgaggcgctcttttggtacatcaccatccttaactgaagcaaatagaaagatattagagaagccacaaacacttccacactacaaatcagattccattttggatcaggtaacagaacctgtcgcagtgtctttcaattgggagcatatccctggaaggtcaaaggattatgatggatcagaacctcaacctcctacaaaggcttcaattaccccaactccccccactggaaaatccacaaatgtggccaaacaatcattggaaaaggaacctaatgttgcaaataactttaggcccccaagcatatcaaattctttaagtgagaaaatagattgtgacaaagaacgtaaagatgagaaaataaaaaaggtggaagagaatgatgactatgatgatgatggtgatgtttattctgatgcacttgaaacactgtcacctacagagccattgtctatgaactgtagtgtgagtggtgtgagtggcttagataatgtggatgcggatatgtgtggagcctcttctactgataaacaagctcatgatttcatgatgagcaggtttttaactgcagcaaaggctatgactatacagcctcctcaatatgcttcttctagaaagcaaactgttctgacagaacaacctagggaatttatcaaattggttcctgaacaaaagaagtcatttgttagtagacatatcgctgacattgtaccatatactggtcaatgtcgagaggaggaagaagaagaggaggaaagtgacgatgaaactaatgattatgcaaataattcagctaaaggttgcggattatttccccgcttatgtgttagaaattcattgtgcttattaaattcaatgcctgggacgaaaatggggaatcagtttcccttgtattctgcctatgaggttggaaaacctgataaaagttctcatagtcgctcgcatagaccagctccatctataaagaaggtaacaactacataactcttactttctattcttgcattgcacccttctatagtcaattgtacccttcatgacatttctatgtgaaaattttgtacctatttatctcttcattaatattcacaaaatttgtatctatttctctatttaataccccccatgaagagagattgacacaatgtcacattataagtacaataaaattcaacattggaagatccattcccatttcccacccttaccctccttctgtatattaacactttcaccaatcatgacttgaactcattttaaccagagtcatgaatttttgctgcaggcttgggatgttattaataagagaaaatcaagctctagagctgcatcaccagacaagcaggatgtaattaaaaaatggactagtgaatcaagcaggtatacctactcaggtgaattgaagcagctaggtaggctctctccctttcgtcgttcaagagctgtttctgctggcgtgtctccttttcgaagtaaacctcaacctccctttcctggagcaaagttgcttggtgattccaaacaagatgataataatcattctggcaaattgaaattcccgagtagagggcattcaagtattcaagaggtgctatcacaagaagcaaaaaaaagctatagcttcgggagccttactattgaaaagacattgtacatagatactgcaagtacaataaaatcatcatgctctagttcgcgttctttaggtaacacaacagtggtaggaaaagacagaaattccctactagattattttcgagatatgaagcacctagaagctttggaggagaatttggattcccaagtgttgaatcctgtggatgccaattctccaactttgtctagcatgttacatctcatggccaaagaagataaagctgaaagattggcagccgatcaagaaattaatcaaaagtcgatgtccttgcaacttgtgccaagttcatttgacaaagatgcagagatcaacaagcagcaaattgtagtggttgatgattcaggaaaagttggcaatgaatatgttctgcatcctcttgccccaccaccattgccaaagtcaccttctgaatcctggctttgtcgtgccctgcctctagtttcttctaagaattcattcccacgttcaaatcaaggtacacattcccaggctaaaaggcagggttttagtagagcatcaagctatactaagtgggaaacaaaagtgaaatcttcgaatttgaatcatgatcatataacctgttctaaggtaaccttattaatccctttagcctttcattttttatttttagtcttcccccaatggttaagtcacaaaaccgataaaaactcacatttaacttttctctacaggaactactcgtgtataaatctcagcatatgaaatcatagagatagaattctggcgtgtatatcatgttatggtccaagcttttcatgtcctttattttttttcaggcttatgggatttagttctccttctattggtttttggcatgacagcataggttagatttttgtttttttatacaccctcatatcttatgttattattttctattggattttgtttccatttgttgacttcttaatcttgattcaatgattcttgacatcatatcagtattttacagagaggaatcaatataatttttggtgatcaataaaaacaatgaagcttctttggactagtggtactttgggtggattgaaaattacagaagctacccccagagaagtgcatatgcactactattgtttgccttttcaccttgttggtacttcctgacagcttgctaatcaagggaaaagaaccttctgtttcatcatatgcagctaatctttaagtatcgacattttatacatatgaatgtatatataaacgacattagtaattactgttattcatgcataattgtttcttctttttatatacattattacagacataaattattcttgagatttttgtctgtctttttctttcactttcataaatttatgtccaacagtccaagtatgaaaatcaaactaatttccgatttagggtgcaatagcacttattcaatgggaatttattcataagcttgattattataataagttacaaaaagaaaaaaaaatactatagaaatgtcataactaacttttctaaggttaaaaaaataagcttcatatgagctcttcatgatccttctagtaaacctagcacgtgaacagggcaaagtacatctcattgatcacagtcttgacggcttattaatcaaaaagattgaaaattattttgtttatgattttttagttcttttatgatttacacaataaatattattttattttattttttgatcaatattttaaacacactgattaataataccttatccaaaatacttgttctacattatttaaatgctatgaaaactgaagcacacaattttcaagttttctctgacaaatacattgactgcaacttcttaagtatgtccatttgtcttagatggatgaataaaatcctcttcaatactggaaatttctggtaagagcacacaaaatctttgagtctttctctctcttgccgaaaactttaaaaggaaccaaactcgagatggatgtggggaatggtttgaggtggccggttgatgtcttcgacatggattgttgacttagaataagactttgaaaagtgttgactctgatgtgcttgatagaccaagaatcaagttttgttgggatttgtcaatgttttgatgtgactaagatgatacgaaaattagtagatgcttaaaatgtattttggcgctcaagttaataataattccatctaagtgactatgtatattgaacattatgtgacatcatttttttcacattctcattcgaagtttactatcttcatttttttcatcttcaataaaacatgtagtgaactctgagtgggcttttaatttttcaatcttcgagggagttattgtaactgcctcaaggttttgtgcaacaatcatgataattcaatattattttaaaattcctctaattaataccctaatttcctataaatagttttgcccccttttcttatgtttatcatttttcacgaagtaactttctttttgtttctacttccaacaattttctagcaaaaattaattattagaaaaaattaaaagtggccaataaatttttttaacaatcatcaacataatcaataaataatttgtatctataacatgataacaaaaataaaagcaccatcccatctacacacgttagagcaacatcatacacacaagtagaaatcctcttcagttattggaaatctctagtagaagagaagactaacccatatgtaccacttccctttgcaaaaggcaagatgacatgtagcatagatagacgtgatacccactacacatgcatgtcaagtcatgtgtaataaaattgactttttttttttaattatcaaaatgagttattttgtaggtgttttacacaactaattacctgtcatgttttgtcaagtatatatcttatatattttgtttgtcttgtgttaaaaagcaccaccttaataagtgttagtcatccgtatttattgtcaatttgaatgagaaaattaagtaaaaatgtgacaagagaattagttattaaaattagtaatttaacattcactcgagcaacactaaatacctaacaaagatggtgcatattattagctgaaatgcttttgtatattcatcaccctcgaagaaaacaagaaatgctcctcatatataccagagagagagcaggaagaaaaaggcatatgtaacaaactctcactaaccaagcacactactgcatcacaccattagctgtgtgaggttataacagaaaagaataaaacaataagaaaaacgtttctagaaataaaagaaaaactaaaaactaattataatcttgatactccccctcaagatggagagtgtatatttaacactcccatcttgttgagcaatgttgtaaactggccaggaaacaatggcttggttaataagtctgccaattgcatttgagaagaaacatgcaacaccttcacttctcctttcaacaccttttctctaactagatggcaatctatctctatgtgctttgtcctctcatggaaaactgaattttccgcaatgtgtaaagctgctttattgtcacaaaaaatcaatgctgcttcctgatgtaatatgccaaaattaatcgagagagaccttaaccaaatgagctcacatgtaacattagccattgctctatactctgcttcggctgaagatctggctactgttggttgcttctttgacttccaacttatcaatgaatcccctaggaagacgcaaaaaccagtaatagatcttctagtatccttacatgctccccaatctgaatctgaatatgctttcaattttaattgcccagtactaggataaaaaatgccttgcccaaccgttccttttacatattgcagaagcctgtggacaacatttaaatgaggttttctgggatgagctaaaaattggctgagcctattcactgcatatgataaatctggtcttgtaatagttaaataaagtaggcgtccaatcaaccttctatagggtagaggatcatctaataattcaccttcttcttgtgacagctttatgttgacctccattggagtagtttttgctttgcatccagttagactagcatccttcaaaatctgcaatgcatatcctctttgacaaatggaaatccctttaagagagcgtgctatttctataccaagaaagtacttcaaattacctagatccttcaacttaaaatgattgttcaagtaaccttttagttgttgcacttcagtatcattatttccagccactataatatcatccacatatactaaaatggccagaaaacaatctcttttcctttttacaaaaaaggaagaatctgctacagattgttcaaggccaccagcaatcaaaacttgtgaaaacttgtgaaaccattgtctcgaagcttgtttgagaccacataaggacttgtgcaatttacaaactatgttgggtggaagaggctccccctcatggagataaccgagaggtggaaccatgaagacttcttcatccaactcaccatgaagaaaagcattgtttatgtcaatgtgagtaagagaccagccattcaaggaggctaaagcaagtagtaaacgcactgaagttattttagctactggtgagaatgtatcaaagaaatcaatgccttcttgttgattaaaaccttgagccacgagacgagccttataacgttctaaggtaccatcagcatgcaacttaaccttgtagatccatttagaaccaatggcttgtttgccagagggaaggggaaccagagaccatgtcccatttgtttctaaagcatcaatttctaattgcattgcctgctgccaggaaggaactttgacagcttcatagaaggaagaaggttcaggatgtaaattaaccgagccaataaaagcagcatatgaagaggatagcttagaattgcagagaatatgctctagaggatgctgtgtagaagaattcacagtataacaatgatagtccttcaaatatgtaggtggtttgacaaccctatcagacactcttcgaatttcaagtggctgggaggggaaactggaatccttatcaactaagggatttgaagaagggacttgagtaggtaaaacagaatcagcaaatatctcattagtatgtggaggcagatgtttgaagggaaactcattttcatgaaaaacaacatcccttgaaatgaaaaccttatttgttgtgacatctagaattttataagctttgtacccaggtggataaccaagaaacacacctgggtactatattgtgcttgttactcaccatcttactggaacaaattaccacacctggaacagagctatgtccacggctctcactgcaaagaacaaattgcagttcgttgatggttcccttccttccccagattccgaagacttactccattctttttggattcgatgcaacaacatggtgacttcctggttgctcaattccatctcacgcgaaatcgctgatagtctcctctacatacccactgcagcagggatttgggttgatctcaaagagtgatttcaacaaggaaatggtcctcggatttttcaattgaaatctcaaattaccacactcactcaaggtgctctagatgtcaactcatattatacacgattgaagatactttgggatgagttgaaggaatttgagccactgccttcctgccgttgtggtggactgaaagactggaacctctttcgtgagcaagagcgctccatccagtttttgatgggacttaacgattccttttcttcaacccgggcacagatcttgctcatggatcctttgccatcccttggaaaagttttctctcttgtgtgtaaaatcctcaaataaataaatagatatatatttatggtcttaaccataataataataaaataaattttattaaaataaggacaaaatttagagattttagctagccacgtgaaaaattcctctgataacccaaatctttaaaaatctgctgaagaagctaaggtggcattaagaggaacaaatcatcaaaagaaagcctcaagcagcttccacgttgatgaaaaacattaatgaggaaacattgtaatgattagtttagataaaatcttccaaaaattagttacatagtaactaaactcaatcttgcccggttataatctaaccaaatataacactataaatacccctacaactcagaaaaacacacaacactatcagttttcctaaaaccttctctctaccattttctcttacgtgaaatttttctgtcttaaactattcccgacaatccttactcggtttatcaaaattttccaggtaggctaggcttcaatttataacttaaaaatttactaagtaaaatttatgtaattattagattttgtttaactattataataaggtttacaataggaatacggtgatatttttagattacacagggatttatacattgttacgtaaataaatctatggtttataaacaatttagtattaactattagtattaaaatagtaagatttaataaagatatagtaaattatagtatataactacgtgaataattaaagaccttatgtatataaccttttgaatagcaaaatgaaaaatatagtatattagaaaggtagtaagagacttggtctctgcatgaatgaaactacgcttatttcttttaagcttaagaagtgatgttatacgagtgcaacggaggctaaacttatgaagcctcggtcatgtgctgctcttatcattattttaatctttttggaaccatgatgcttcccagtccattcatataaataacgtcatcgttactgttttcatttttttattaatctagctaggctcatctagtttggcttattctttcattttacctagcaagttcatttactactgcaaccctccaccaaccaaaaatgcatgcataagttttcgagccaccatactaaccgattactacttccccaagggaccctaccccggccagcttttgcatgaactcggactgtatcatgcaagtctacccacaactagctcggccaacacaaactcagccacttctgttgttcgtccacatacccttgcagaccccattcagctcggccacacctattcaaaccagctatccaccttcacctcagcatgatcggatatctccatcccggtatggccaggtaccaacacctatcccggcctgtacctagcttggcctgcatccatttcggactgcacgtatgcggtctgaacccaacccgacatgcacacatcttaataatcttgaaaccggacactcaccacacactgcatgttcctactcggacagcagtataccaggccaatcataccaaccgacctcggcagccatttgtactcggcacggaccttgacccaggcagccatttgtacccggcacggaccttgaccccggcagccatttgtactcggcacggaccttgaccccggcagccatttgttcccggcacggaccttgaccccggcagccatttgtactcggcacggaccttgaccccggcagccatttgtacccggcacggaccttgaccccggcagccatttgtacccggcacggaccttgaccccggcagccatttgtactcggcacggaccttgacccctgcagccatttgtacccggcacggaccttgaccccggcagccatttgtacccggcacggaccttgaccccggcagccatttgtactcggcacggaccttgaccccggcagccatttgtactcggcacggaccttgacccaggcagccatttgtactcggcacggaccttgacccaggcagccatttgtactcggcacggaccttgacccaggcagccatttgtactcggcacggaccttgaccccggcagccatttgtacccggcacggaccttgaattcagcatgtattcgttctaggcacatgcacacatgcaaaccggccatatatcacctcggcaaccaactaacccggtaccatgcttacccggccataaccaatagccatgtcaacccttaggcatcccctcatctttccgatcactaatgtcagatcgaacccggccaaccatgaccccggtcatatgaaaaacaaacccggctaaccatgactacccggatcttagcttggtatgaacggtcttcccgaaatccggccaaccatgaaaccaggtcatacccatagaacatacctttcgacctcatcatcaccggtctctatgctctttttataccattaaaatttccccagcaattatataaatatatatataaagatatccagcgggttcatacgatacaatttgggttttgttttatatatatatatatatatatatatatatatatatgttgggaagggcatcttaagccataactgtgttcccagttcttacgtaagcatatatgactgtttgatttaatacttcgtactagtttgctatgaaccaaatattataggtattgatatgtgtatatataactttaattataattgcgagcaaaataataaagtataaataatacaggtaaagttacacggataccataactcatgacgaagagctatgttgaatatatgtgaagaaattatttactaagaattttatcaactcggtcttggctatatatatattatacttcaaaccttaatattggcagctcataaatattaaatttctcctgttggtacactataacgaggattaagtatgaaatgttatatatcttatattatgaatttttgtgtgatgttacaaatgtataagattgacccaagtttcatatgatggaaatcgggcctatgatgagagatcaggtgctaatacatggaaattcatgcatgattagcgtaagacggccgcagcattcctacatgatgtacacatgtagaggccatgtgcacctgtgactattgcatttcatttcattcatacattcatgctacgcagatatattgatttatttgttattctgttaaattgttgattagtcttgctttattttactaacctgctaatatgtttggtggtttagatttgcctactgagaaatttatttctcattagatttatttaatgttttatcttagatggcgtcaatcataatctttcttgattctctggatatcgcctggtacatggatgaagtccgccactgctatgtagttaccatgcaacctgtgttgcgtgctcatatatattttggtgcccattttcctgtctcagtctttaatgaagcatttaatccctacgatccctttcttcagatggctcctgtatatccaaaccctgccacagatcccatcatcgtgctcagcgaagaggatagcaatggagaccatatttaaatgaagggacaagaactttgtaaataaataagaatattgcagtactatgagaataggaatgtaaactgaagctagtatgaaaaatatgagaagtattttgtaataaaaataatgtatgtatctagttcctggtgtattaatatctcttgctcctaacttaaaaaaaaaaaaaaaaaacacaaaggatttaaataaaggaaaataaataattaaataacttaagtaatgaaataagtacttaaaattatttagtatgttacattgtgctccaggaagaacgtcaaagaaacatgcatttgggtgtcccttctctcccgattgtgaatgctgctcagttgccaggaaagggtcgtcgtccgttttgtactcattgctcaatgactggtcacactgttgacaaatgcttccgcctccatggatacccacctggcttcaagggacgcgcaaaagggaacgtaggaggcagtagccccaaactgggccaaaattcgacgggctcagttttatctgatgggcattttccccatactgccccaactggcccaaactccaacctcagcccagatcaggtttcacagctgttggcattacttcatcactccaatcccgtttctcctgtccaaagtacaacctcaatacatccaactgccacgtttcgctcttcttgtccttccattgagtcatccccagttgattgtgcttctatctcctctgtagcacatgtgtccggtgagtcatctgcattttcttcctcctcgtggatattagatacaggtgccacacatcatgtttgttgtgatctcaattgctttctctcttcatctccaattgttggtttctttgttaatctccctaatggcacttccatttcagtgccacgtttgggctctgataccatattagctgaaatgcttttgtatattcatcaccctcgaagaaaacaagaaatgctcctcatatataccagagagagagcaggaaagaaaaaagcatatgtaacaaactctcactaaccaagcacactactgcatcacaccattagctgtgtgagattataacagaaaagaataaaacaataagaaaaacgtttctagaaataaaagaaaaactaaaaactaattataatcttgatacatatcaggacaacacctcttgcatcttatatagcaaaaatcatccataacagataaatagtttaataaaacacctactttagtaattaattttgtgaattaaaccattttgttaaaagagtcaataaaattcgttgaggtttcttcaatctctatctgaattaaaagattccctaggtttctctgttgcatgaacagttactgtgctatagaatttataactaagaaaaaatattttttatctaccaaaatattgagtattattttaaaaacgaaataaatatacatataaattctaaaacatttttttgggggggggggggggggggagcgccgcgcatcctgatcagcagatacagttcttaaacaaaattcaactgaattcttggatgatcgattttggaatagaaagtgagagagggattcacattcacttgttcttctatactttggtatagagagtgtgacagagagaataaacaattcaagtactcttttatatagctgcttcaaaacttaactttaactacacaactagtgatattcaacaaaccaaaaacacaatcactagtaagtaaaaaatccacgctcatcataaaactcaacttgtgtgtgcaactcaatttcttttctaacacatagctactaaatccatgcattttccaacataaatcttcttctctgtaggtgcagaagtactaatggagctcttgcagtaaggcctgatagccatactctcagtgttgctgaactacgtatccattggatgtacttacacaaaaggttagcgccagaacatgatgaaatatgtgttattttccttcgctctcttttattttactttgtgccttatcaaaccaaatactagcacacacaaaatctctctgttgaaaactcactcgtaatcacgaccaccacattcattttacattcaaatccgatttaattattattattatttttggtgtgaggataaaccctatgtactggcaagcccataatttagcgttgtagcgacatataattgtgtaacttaatttgttttagtatctatatatctttactcagactatatgaatggttgggttgtggtatttgcattatacattgacatggttataaattctatgaaagtgaaagtttcgtgttgatttcttgggtttctctgcaatgatcagtcttgccatcattgttgccatctctctgacttaaactcagtcgcaaatcaggcacccattgcttctctttctgcaatttttcttgattcgactgcatttgattaaaaaataaataaaaattctattaatagtgaaaaaggtaaaaaaaaaaaaaaaaaaaagttcaatacattaatagtactcatgcgaatatgaaggtttttttaatatatctcactactaaaaatcaatgaattagtgatcaaatttagtaatgaaaaatttcttttttattatatgttagtgatggattttttaaaattacacataaattattctctcagtaattttaatttttctaagtgtctagtttttatttatttttttattttaaaaagtataaaaaaaatatgcttttaattcttgaaaaggattgaaaatgtaatagtttcattttattaaatataaagactaaaaataaatctaatttatatgaaaaaatggcatattttcaagcaccaaaatatatttaagccaaaaaaaaaagaacatacaaatattttagtttcttaagtcttaattaccttaatccgaaatggaggctcaaattctagctttaaactgttggaatagttgcgatgctcgtcggagtttgatagatgctccttgattcttgtgttgtttccaaagtttaactcacctggtctaagcagagatgctgcagtggtgccaaattgatgtacaacaggttgtgacacagcattagaagtaatattggcaggtaaccttttcttccagtgatggttgttcataatatctaagggaggccactttttctcttcaagaaactggcttggtctcatgggtgcaatgctggtggcatcctttaggttaattttgtttgaagatattgatcttccttgcgtttgtaaggctgttgaggagataacttcgttgctaaagtaacttggtcttctaaaaggttgatgattattgaagtaccattgttggtgcctaatgatagataggtatatattttgcaaatatgtattaattagattgcaaaaccatggaaaatatagggaataaaatcaattaaaatgtgcatgcatggttaccttgaatcgatggcttttgaatgtgaatgtgatagggaggagggatgcatgagaccctgcaaataactgtggtcgttgtaatcacttgctagaataattcctccatttcccatcttaaaatgttgactaggattcatggattgatgggctacatgagaaatacgaccaagttcatgggttgatttgtatgtttgacctaatactgcaaagtgaatatggatgaatatatagtaaaaatgacaggtaaaatcaagtaatcccaaccttaattatgtccttctcttagaagaaaagcttctaatttgctgggaatcataggttagaaattttagtttatcatttttagtatgtattttttaaaaaaataacattcttggaaaagaatgttttctagaaatgttttataatcagttatccactaaaacttttcatgtgaaaggtgaaaatcttgtttttttttgggtttaattttttttattaaaataaaaatatcatattattcttcattaaattatataatatgataaataattaaaataacttctttaattcttaaaaaaattatctaataatttttaataattaatcaaacaaattttatttataatcagaaagtatgagattcagaattcatgattctagtaattctcatgcataccaaacgccccgctggagtcttaccgtttaattacctcctattttttttttataataagacttgattgagaacgagctgagtacaaaagataccgaacccatagtgataagacctataactacaacgtgactaagattaacaatacaaaacattctatggatctatatacaaataactgaaatgaaatgagaaaaaagacagccatgaccccctcttggcagagactcaagaccaagactaggaccaaattttaatccagtctgttatagaaacaaaatcaaaatgaccatgattaatcttaattaaataatgttctagagtaacaatcattatggttaaaccacgaaatactaaaccagcaaccgtccagcttaatttttctttcctctctcaactggttacattacaatgatcaatgctattagatgaaagcacaatactaagacaccattgatggattatctctagagtttaaagttactttaaagttgaagttaaaaataaattttttaatttgaagtaaaaaatgtttaataattatatgaattttcaagcatgaaagttacttattatttatatttttcttcattaaaaagctattttttttcttaaaattttgtttgattcaacttctctttttaagaaaaaagagagacccaaaaataagttggccaaacattacttaaaatcactccatttgattggtttcctttgaatagttttattaaacttcttaaaagcagtaaaaaaagcatttttaaaaaacattgtttcttataattaaattatattatgaaaaaaagctagatattaatgaaaagaagttaattacttgcctctttaagtataacacttgtcattcttattgttattctaagctaatcaaccttcctttctctatatcttgggtgttattataacatcttcaatgtgagttgtgaactttgcatccggcattataggagaggaaactatatcttacaaaatatataagatatatatcaaaggatcatactaattaagttgtattcctatcttattgtacacaaaaaaggattcatttgctttagaacgctttgcaagatttaaaatagttctcaccttgcccagcctcgtcgagtttcttgcttcgatacatctgaaggaaaattgcataacaatgaatttatttattgcaataaaacatcaatatttaagtttcaaggggaaaaaatacaatatcaaacccgcaattttgttgctacctgcaagtgactcttgacatgagcaatgctgaggcctctcacattcattagctgaagcaccaatttgggtgttgctcctgcaccaatagatgcaaagatttcagccaaacattttagggcaaataataggctttttttactaactaaaatttcttaagagagaatacaagggtactgtaaatggaacacaaaactctagtaatatcatattaaaaggctaaataaagacaaactttatgatcaatacatcaataaaataaaataaaaaacaatgaactctactggtcttgaccttgagcccattaccaatattatatgaatttaatagacatacataaaataattttatattaatattctataaaattattattgatatcataattattataaaaattaataaatttattatacatgataatttatgaagaaatgagtgcatagcatattttctcattgtatatagtaagtatttctttaatccatgtctcacttactttcttgacctccaagcctttcaacagcatgcacaaaggatagatgaagttcaggtgtccaccgaagccgaggcatctttgatctaacatattgtctcacgccacctctccgttcattacttccttcctttgttatgctgctacttttattagttgaagtaccttcttcctttgcttcctcgcatccctcatcatcgttgtcattgttatcttcactactagcttcttcattcaaatcaaaggatgagcatttctgggatgatcccattgaagagtcatcatcagcatgttcattcctcttatattcatctgacatatttatttgttgttgctcgatcaggatcacctccaacttcaattctttatcaatgtgtacaaattataaatggcatttcatgtctgaaacaaacacgacattaatataaatttaaatgtgcagatcaaagttggcaaaataaacaatataagggaatagttatttaaagaagaatttgtgagaacaggctgtcgtttctctacaacaattacgaagctttaaaattcaatggtaaagtaatagtcactagctagattacaagaaattgtaccaaagaaaattactaagcaatgaatagtgagaagttatggcacaaagagcagtagtaggtcaaattgaagaattatagtataaaagtgcaaccaacttctctaccgagaagatgtgaataaaatttgtgagggatgtgttaagtactcagatctatgtatttaagtggaaaggaattaactcaagtggtagacgaggaaattcattactactaaaaagatggaaattgtatgaacaaacgctttactttagtttaggtcatgccatttcctactccggaaatataacaagaaatatattgtttcaatttaatcactgaaataataaatttcaaaaggctcgtaaagggttcgggagatttacaaaataaacacactcacatgatcatgttcttgaactcacacgcatatatattcatgtgtaaatcgtaggtagtgaataagcaagaaaactaggatatagcggaagagagagatggagagagagagagagagagagagagagagagaaaattttcattcagcgttaactaacattttataatcaattttcttgtcattttatctgtacaaatgctttatgatatcttgtgtaaaatgggctttcaggacaagaacaaggtgcgcttacacacttgtatctcaattttaattatggttctttctcttgatattagaaaaagatgtatgatgaagaaaaagggttaattgctttgccggccgcaaacctatgaaagatatattaaaaaacaaagtcagttcattaccatgaacataacacatctcgggtagggaaatgcggttcagaagaacgtatccggtgcttaaaatttttctttggatgagaaaacttaggaattgattaagaaattaattctcaataggttgtgtatgaataaatttcaagtgttttcgggaagtaatatcgaagagaaatcattttatatgtaatcataagaaatcaaagagaaaagaatagtattcatgatccaaagtacacaccacaaaaaggagacggggacaaaacccatgaaaacggtgaattgtttgaactggtatcgttgatgatttgtccaagaaatcaacaaaattaaaaaaataaagaaaaaatactttgattttgagtgtttcacctttttccctaaagtaccaaccattcacgctgatgatgtgttcctctattctttctcttccaatgagcctattcacgatgatgtgcctcttttctttcttttccaagcctattgatcatagatgcaacactgcatatatatatccaaccatatctctcttcacttagtcacctatggagaaccttcgtggccttattgttataaaactttaaagaacataactcatggacagattgtgctggatttagtcttggatgatgctgtgttctttgatatgcttggaaggggaaagagagagagagagagagagagagagagagagagagaggatatatggtcttagttttgggatgtctttggcatatcattcagcagaagaattagagtcataagtttaagatattagagaggcttttatggtacgaaaggaaaagaaagaaagaaaggaaaagaaagaaagaaagaaaaaaaaaattgagaatcaacaatattcggacaggctacttgttctccttaaattgtaataaacctacataatggatacagatgttgctggtcccttttctacttaatttctacccttttctcctctaacccttttttctcttcgtcccctcttgacagttgtaaaaatcaatctacctctctgtctgtctctactctctaactagctagctcgtgattatcttaattgtttgacctgtgctagggactcatgcactttgatgttaattatgatatttgctctttattttttgtaattttattttatacctcacttttatgagtgaaaaaaaaatagaaaggaggggaatgtttatttatctcttttttcacgtgtacaaaattgtaaaatatgagtttagaaaatgtgatatatgaataatattaatactgttcgttttaattgaccatgctagctccatattcttaatataggtgcatgtatgttgtggaccccattctataatcaacctttcattttcttcccacctaaactaagactttgttcccatttcaataccactgtttttctgtcgtaataatgtgtgcattttctcagtcgcttctctcatatactatatttttaaaatatctcttcttttaataatataccatatgtttccactgacttctttgatctgtatgtttaacagtgacgtcttatttttggtatgctttgtagaatattagggattggacaaccttaattaatataaggctgtaatataataggggtgtgtggttttaaaaatatatagtcaattttggtgggaaatgtgcaaaaatataaataaacgacatgtataatttagtttttgaggcattttcaacggtaactggtggctaaatatgcatttcatgatttcataatagacaattgtaatttacttttctaattaagtgcatgcatgagctatatgactggaatcttgactctaactttgaagacttccattcatggaaatggagaggaaaagacaatataggtatttctcaatttactcaatattgaaataaggaagtccaaattaaagtccaaagtccaagcattatattataatcaaaataaattaatactgtaactgaacatagcaatagccgagtattttaaccattaagatctcactttttaaccaatatagtaatttacttctgttaagagaatctgtaggaaaaagaggatttgttagcaaaatatttgacaatcgggctttcttctaaaggaatctagaagctgggaggggacgttgaaatttatatcaactttattgacttctgatgcacccaactcttttaatttgttgaataccgcaaccatatatgtggtttaacttagtcatgtctttgtcaaccccagatattattactattaacaccaattttcctaatccaggttttttgttaaatgatgaaaattgctctaactttcaggtgatcacaacccgtcatcacgtacaactcaaaaactaaaaagtgacattgcgaattctggtttatctatcctctgacaagtaattaataatatataatacgtacatatatacacacatgaggcatacacacaaaaataaagagagtatgctatgttaaccttttttataacattatattttttcttttctttttcgtcatattaattatcttattatacacttataatatatactgtccttaattaattataagatttttaaaaaaattatttatccatttttataagatctttttttctaatttttagttgtattaattattattttttacatatttttatttaattattttttctccaaacattgatgagaaataattaattagatagacatataagaaaataataattttgaaatgataatacaaataattgatagatttaatgtaattaactaaattaacaacttttcttaagacacatgaattagttaaaagaatcttataattaaaaataaaaagaatatatatattatttttttaaaaaaagtgcaaatactatttgtcagtatatttggacccgatcaagtaattgtttcaatgttgtattgattgctcctattatatatcacgtgctccattttttatacatacatacattattttcttgagacactctttattattaactgagatttattaataaaagtatagaaatcacaagtaaaattcattagaaagtatgttgttatattaatagaaaaatcattttaactgagacactcttcatatatatttttcaataaatttcaattaatagaaaaattatttaaaaaaatatgttgttacgttttgtaaggcaacaaagtttaacatatagttgacagataagtgaggtcctcaaacatattatcgataaatgtttgattcttggtatcatatataaaaaatgttatatattttgtattgagagttacaattaaagtcatttcaataacctctacatttcaaaaaaaattaatcttcggtaataaattgagataaaaaaaactaagaaaaatacattatactattaattactcaccaaattcaatgcacaagtaatcgagggaggcaggtctgaagtttggtacatgaaaaaaaatgagggatggcagggtctgaaatccgaaaccaaacaaagaaaacatgtctctcccataagatgtgctgatcataagggcacaaattttggtcattttcccactttgggttgtttttgtcccaaaaggacaaagaggacctgtagattgggacaacgttggaatcagccgagaaattaggttttgctagatggcgccaaactccaaagctcgttttgcgtggcatgtgcatatatatatatatatatatatatatatatatatatatatatgtacatttcaagcccagtgctcgatcacagtgagagtgtgatagagagagagaagcatacagtgatgacagatattcgaagaattaaagaaaagggtttggcagagacaagattacgtggagaggaagggaaaataggagagcctatatcaatagagattaagaaatttaagagaatagagttggttttgtcctcacgtttgcatgagagttgacatttcaagatatattaattaaactgcataagaatcttttcaaagaattaggcgtatttttatattatttcatggatgacgacgtccaacctagcattacattattatacggacatacctcagcgatctacaactataaaatactacaagatattaagcatttcttgattgacccataaaggagaatcatgtcttataacaagcaccggaaaagagttttatatcaataattaataatgtccaaggtatactatcccctcttgtgcccttgtcctttcgtgatttggtaaaccttacttatctatatttttgttggtcttgacaaaaaatttaaagaaaaattttcaagcgtactgttgcgtaataattattatgaatataatgagtgagaaatcattatcaccacggattagtttaattttttactcttgggactcacgtaggatgttgcatgttgctgttagtatttaattgaaattgagaatccatcattgaacgagggataaatgtacggcctaagcaatatcattattatagtgctaaatttatagtttacaaatgatcaactgctgatcaatttggaaaccataagattggttaaagcacattacacacagtaactatacgtattttgaataaaagtttttttttttaattaacaagtgtagttatatggcactaattaaaaagttaattaaaaaatatcaattccttcaataatttatttattttttaatttttaatttttagccagtatccataaaaaaacttgttagacaatcctttgtattaattctaaatcaaatgattaattagattagtctttctgattaataatatttgaaattaataaataaatgaagaaagtaccagatattttttagatattatatatttttttattattattaaatattaggcgaaattatatatttcagaaaaatataaaaaagaactccattaatgttacattaatttacattggccagtttttttctccttaaaagcgtatgtgtttcaatagatccaactatagagttgctataattgtaagtaggagctgcaggcaagtaactacaactatggcgtccctcggtatttcaagcacatgtcaaaggaaaaaataggaagaaattaatatacacgaatttttatcaacgtaatctattatatatttacgtaaagtaatcagtctcatctcttttttatctaaatatataatcattatttaaaggaagccatcaataaaagtgaggtatgctttaacgtacgtgactcacgtcctccactttgagatcacgacccctccatgttcgttcgtatagctcgtgcaaacgttcattaaccaagggaggaagggattctgattgaggcacttcaagttggggctttcagaaactcttggttgcaggtttgattatgatgaaattgttacaaaaacagaatggggtgcaatgactcgtcattggatctcaagcatttaattgaaatagaattttctccttgatagcttttcaaaggctgtgtcaagaaaagaagactgatggagagggtgaataaaattaacgatctacaggacccacatggtatcataagcaaaaaaaattatcaaataacacttgccaattttcggtgggagcttccccgatgttggggttgggatgacataaagaagataaaaataaaattatcatttacttttttctttttatttattaaaagaatatttatttttaatctaaaccattgcagtattttaataataaatctaagggctaatattagtgtttcacccatggatcacttgataacttctccaccccaaaattcgcctattttctaaagaaaacgtgcatattattttttactaaaaaatagttggatttaaggtgcacaaggtccatataaagaatatgcctttaagattattaatattattgtggtggaatttattatttttaaatcatatatcacaaaaacatcttataaaataaaatggtgaagagtttactgatgttcaagcatgtgcatctcattttttttaatctttggaattcattcgcttaattagcctctctatatattttgcatgaataaattgttaattatatattgttatttctgaaaacgcatgaattatataggcatttataaatagagaggcttaattacttctctattttgcatttataagtaatatacatattaacaatctaaaggtttttttacacaattatttaattataaattattatatataaatttttttttacttttataatggttatcttaaaattcatatgaaaaataatttatgatctttgacattgtatctaggtaactgtccaaattatgggcgaactaggataaaatatttatgataaatggtcaatttcattctaaaaagtgtaaggtgataataatttaatttctgaaagaaaaaaattaatttaattcataaatgtataaaaagtatgataattatgttctatcattaagttttatgggaccatttagttattaagtcataatatttaataactattggatattaagttgtaattgttaaaaatttatttgtcattaaattgtaaagttcaaagactaatttaatattaaattatatgataaaatataagtgttacaatttttatatattcaaagaactaaatcagaacttaattttattcttttatagactaatttattaattatcactttacatttttagatcaaaagtaaccatttacccaaatatctatttccatctttctgatttgcattaacaaacaagtttttgaaaatctagatcatcaatttttggaaaagggaaagttataaacaacaatcactagtcttcagaataaaccagttattttcaaaataccaattagaaataaagttgagcttttcataaacacgcatctaaactttaattttcaaatatatatacatcaagacattcaaaaatataaaaaagtttctaatttattcataaagctaagacattagagcattctgagcaccagagtggactcaaaaaggtttgtagatagaaataaaattttaaaaagcacaattcaaatctgttatgttatttttctcacttaattacaactcctaattttgtatagcttgaatttgtaacacctatgtagaggcaaaacatttttggacccatcctattttctttcctatatagaaaaatcttaggatcgtaattagagatgctaattatactgattactaaaaaaattactttaaaaacaatgtttttttttatataacttgtgagttttatatccttcaaccaagtatcctaagtttcataaagacaagtgaaatccaccaattataaaaaattacgaaaatcacaatcgttatttttaaagtatgggaagtaggaacaaagattactttgattgaaaattgagggactaaaaagttaaaacatattttatcttataaattatttaaaacagttttttttttttcgaataacattgaagtaaaattttgaaagataattattcttaattttttatgatacaaggcacatgttatgttacaatggtcaagtacgagaagttgtatatgatgtacaattttttttaacccttaaattaatcttactcaaattattatggtgcatttcccgcacaaatataccatctcatctctttctcattccctcgtcctcttccatattcttctcgatctcccctccttctgatccctccgccgctgtccctctccactcaccacctcccttcgccctcattaatgcctactgcaacaacatttccccaattccatcacccttcatacaaacccttccgaccatcactcttcttctctgaacttcgagtttatgtcatcactcttcccacactgcactaatgccttcctcaattccatcatttgggaaagtggagatcgtgttcatcaatccgaagcacacgaacgacaccaatttgagggttttgcattaagtcattgtgtacaaaagcctaagttgattctgctgcctttttcgcttcccctccgcaagctctaccgcacagagatccagtgtgcttgttccctccccgttttgcgattcaactcctccctgattcacttcaacaagatcacacctgtgtgtggcactctgaggtttgcgagcaaagtcgacaacaccacgcatatcaccgaggtcgtcaccgtcgcactcgcctagagcatttcaattattaaaaagtttgattaagatccaaatgtttggagcattttttatgttgtatgttaattcaaatctgggtttttgttatgttgtatgtcatttttcgtcatattcgaattcatgatttggattttttctatgttgagcttgtgtttcaaatatgggtttttactatgttgtgcgataatccagatttgaatttcttgatatattgttcaaatttcttattcgttgaaatgcataaggggtttggtgaaaaaagggagaatgaatggaggaggcttggtgggtgatggtggtgcttgtggcaatagtcgttgtgattggagggaaatgacggtggtgggtggaggaaccgtcaaaaatcgcttctgatgacaacgtgcaagatagcattggggtacatgaaagagacctgaaggaggaatgatacactatgggaagtccaatttatcaaagattaattcaatagtaaaaaaaaaattgtgtaccctacacaaattcccatacttaaccactggagtccgtgccatgatacgaaaattagctgaaaaaagactagtgttttaaaaatgagatcgaacaaattagaccataacttttttatcatcagcaattagaccataactaagtttttcaccaaaaaaaagaccataacctagcttatatatggtatcatattggtattagtttaatggtttttaaaacattattagaataagatcgacacaactccctgagaggcataaatctatattaagaatttacatggatacgcttacattcaccaattaaagagagagtgctggcaacaataattgaatatcatgcatgaatttaaacttttttagtgatgacgtgtgttcgaccaactccttgactaaatttttcaaagaataattaattaacattgcccaatgtagctgtttatctttcttgatagaggaagaaactagtgtatgattaattaaacgagttttgattgctccataacatattaaagaacaaacaatttgacttaaataagaaatttatgcgtggcgtgaactgttacgaaacagtggttaaagaagaaattaattggaattgtgttcaaaacacgaaacgaaagatattactagtagacgatttaaatttcccgtcatttactgcaacagtataacaaattatttatagtattaatccaagtactcataaaatgttacaatgttacttatgctcttaaatataagaatatttttttccttttaaatatatatttttttaactaactttatcttattatcttatttaatgttattatttctaaaatatccttcatttaattgagatgttagttttaatgactttttttattcttgatacaaagttctaataaatgataagttgaaaaaaatatttttattaaaattgatgtaattaaatgtaattaattaactttcttaattagtataatgtatttttttctatcttatatttaagattagatggagtaataagtaagaagaagttgaagaagagatagaataaaggaaaataaaataaaattacatttagttgatccagtattctctcaaaaaccaatatcgaacggttttaccggtaaaatcaacttaagaaaaaaatgtttgaaatgtaaatattaaataaggttatttatttcagtactttcttggatataaatgaacccgcgagacagggagtgtgattctcatccccatttttaaatttgcctaggtggtattttactccatcccaacaagggtggaaaaaaaaaatctccaaccttggggtcctggcaattcccaccaagatcctcatattcaggggcaaattgttatcctacttgagactttgggtgtttttgctatacctactttgtcgatgagctaattgaaataggtagctaaaaatttaaatatggaaattaaaagtaaataaactaattgattaaattaacatgttataatttggccaaattaaattagttgaactagctggtcagggttaaaaaatataaaaatatatttaattaattgtcattttataactatatatgttttaaaataatgatcacttttaacattttaatttactttaaataacttctcatattagaaattaggataatagtttttttttacattttttatcaatttaaaatatacttattaaatgaaatgaaataaaaatattttttaaatcaaaatgaaataatataaatgaattattatgctattttttagaccttacaatttttcttcttcttattttcagttttttactagttttgttgattattaattctttatatttaatttatatttttatacctgttatcaatttatatttttaacattaaatatttaaaaaatcattttaaatgatttttaactgtaaaacaataagttaaataatattttcttatagttttacttgaaatataaaaaatattcatgaatttattacttttaatttttatatttatttatttttatataaatcaatactaaatgttccagaaacattaatttttgtacctatcattaaatattttaataatttgaatattgtattattttataatagaacacggaataatttagtttaatttcctgataggaacttacaagttatataagtaaattttaaaaataataattaataacgaaacttgctagtaatatctttcttatggaaactctcatgtaatttaaattttaagtaaagcataattaatatggaaagtttcaccatttcgtaaaatttattactaattaaattaagttattttaaaaattcgatatattatttttggtgcagaaaaattctattgaattaaaaggtcaaattttaaattactaaacagttaattaggcttgacctctctgagtaggtgtatgtcattaattaccgctatttaagtagtaccaatattattatgttagttcaagtaaaattaagtttgaattacttaaattaagtgaattggatagaaaaatataattaggatagaggatcctactaaaactgattattcatatttttaatagaaattaattattaacaaaatcaataaatatttcatacttattatatatatatatataaattagtttttctaaaggtttaactcccttaatttttccagtaaaaaaaagtcccttaaaagagcccgttatttgacaacaattctgaacttttttttttgtcagctggtgtctattaatctaattagaacaaggttgtagtctatatttaaatatatcttatcacaaaataaataaatttttaggtatgaagaaactttaagataaatttcaccactgcaataataaataaataaaaaaagaagatacattacacatgtggtataaatgacctatccaattacacctcttatgcattgtaattgtatatgaataataaatttacacatgtctcactcgttcccactcttaataatccgatcagtggtccaatgttgacaaaattattgtaatgggggtgtttagtaggaacagacagagtaaggataataatgaaaatgtgaaataagtaaacagtagcggtcccatattaacagaacatattggtaatggggtgcttactgcttagtaggaaatcgttgtgaaaaagacaaatatgtaccagctcagtggtcccattttcctactgatcaaaaagcataagaaccactaggtatgtcttaacaattagaaaccgcttgatttttgaagatttcattcattcttaaaccaaccttatatcttcagcttcattcacttctatatcaactaattgtaattaccgtttgacagataaccatgattcaagaaagccgatagagttgtcccataagagtttccaaagtccaaacacaatattgagtaccgaacaatcacataataattgagaaaagagaaaagaaaaaacaaaaataatatatattcctggttcattcaatgtgagctaaatccaacttttcattatactctctcatgaaatcgtataattatattcagattacaagaaattatataaacttagcccattcatatatattaaaggtacaatatgaaagatactcaacaaacaaaaaatatgtgcagtgacaatgcatacgtgtcaaagaggctaactcccaaaggcaaagggtattaatatattatttaccaataaatatatatatatatatatatatatatatatatatatgcaacgttaatttctatatatacaaagcagtatatatatgtccataatttctttagatggtaccacctaatagtctaatacagtaatactatttattattctatcatatacgtaggttattgtctggccagcttaatatagttaaaaacatgcatctgtatctggctctggcctttaaataactagcagcaaactgacagaagaagaaggagagttattgaagagctctgggtggtactaaaaattaattaatgtcagttatatgctctttccagtcagcttaattgcagaatgtgagtgtttgatttcctacaatgcatgctaagaatttaaagactttagcagtgtttacgaacacgtttcactcaacgcttaaccaaatactcactttgtttttatgatttgaaaaacattgtacgacaattcaaatttattttgcttaacaaacgaagttttatataaacgctactggtatttgagcatttaccaaaagaaaatttataataattcactgatcaatttctcttgtatcttatttttaactcatttttgttgtgtctcattttttcatcctattatttatcacatatattattttctctcttttttcttttcatttctctattcttttaatcctaattcattccaatttaggatgtatgataataaggacttttacctaaattaagaagtataaatttcttcttagtttgtaatatcttaacatgtccattttggttgtacgtaaaagaggcaatcttatgtatgagaatttatttcaaaggaaacaagaaatgtattaagaaattttttcctccttttttatttataacatttagtatcaaagtctaactatcttctcgaagtaagatagtaatatggcacttatggtcagggtatgtaatacgtggagactctgatatataatacatagtctaaggtaatgatattaaaaaaaattcatagtctaaggttgtactaattgtttggcccgagaacaagttaaattggttaaatgtcggctactaactaattagtaattaggatctcacattttcagctagctcaatagaaatgcataacggtgacaattacgaagaaatgtagtgtattcataaaaaatattatataacatgttggtactttttgtctttctgagataaaagttgtctcatgatttattaaataaataaaaataagtttttattgttatttatctatatttaagttgtgttacctatgtttttttatttataaaaatcaaacataaataattataattacatcgcctagtatataatttattttatcaaattaaatacatccttaacaattatctctatcaaacaaaatgcagcaaaatcaaatatcaacatacttgacgaaaatgaaatttaaggatttattttcagttcaaatattatttgtttttgcaccaactccacgtttgtatgatgcactcaagtcactttatgcgatgtccactaataaataccacactttaaagaaaaataaaatacagagatcatgaatggctatgatgttgctaaccttgccattttggtagccattgatgagaagtgatggtgacttactgactagctagggttagataaaactaagccagctaaaggcaatttgaatttgagcggtgggtattgcagtgtccccaataatttatttcgtcattgatggacaaggttagtacttgaattcgagggcggtacaacctttaggagaattcttcaaaacaaaattaaaggaattatttttattttatatattcaattgatatatttttattttatttctgcaccacctccacgtttgtatagtgtaatcaaatcactttatgccacatctactaataaataccatatataaaagaaaactatagagatcatcaatggcaatgatgctgcgcgctaattaatctcgccattggtaccaccattgatgagaagtgatggtaactaacagactagagttagataatactaagccagctaaaggcaaattgaatttgagttattgcactgtccccgataatttatttaggttgtgtttagtaaaatcagttaatatatactttgaaatttataagttagttgaatgtttataaattactactaggagttggaaggaaaagttacaaattagcttatttaattaaaaatatttatttgatgaaattaattgatgaatataaaatgacataacataatatattttgttatttgattatatatatatatatgaggaaaataattttaaaatatcacattataaaaaaaatgaagatttgattatttatattgatgagttaaggatacatattgtttaagatgcatgttgtggctttgtgagtgtgagaataaaagatgtgaaaatcaaatgtatgacataattgagagtgacaaggtaggaaagagtttccaaatttaaaaaaaataaaaataaagacaaaatcaaagtaaattagtgaggataaaaaaaagttagcagtttgagctaaaagtttgtttaagtaacttatgaaaataacaaggaatgaatttcgattcctaacttgatcatgaaattataattaaaaatattactttatcttaaaatgaatcaatttaacatgaaaaaaaaaaacataaaaataagctagcaacttactactaaaataaagcttactaaataagcttttggttctagtcaaatactgtataagtttataagttatctgagtgatttttaaatcgcgcactccttaggcaggtgtatttttcccaccagtttagagaagttaatatggagcggattggctagctggagagactcataacagggagttgggagctcattggagccttcaacctccgtatccttgcatttctttgctctggggtggtgaccttaccctgtaatactgtagtttttgtttcgggtttctcctttgctcgaaaaaaaaaaaaaaaaaaaagcacactcttgatcaattcttgaactcaaaacaggactacctaaggggaaaatcttttggaaaaggataattataattgtatatgcatttttcttgacaattaatgttctttttaaccactaaggttgacatagtggtagaggatttgaaagttagcatgaaatttgaagtttgaatttcatggttgttattgtaaaaaaaagatcaatatatatttttttgaaatattctttattattaattaaaactttttaaaaataatagaattgtgagttaaatacatttaacaataaatagaatctctaaaaaataaataatagaaatacattaaaaatgtgtattaacattttttttatttctttatatcactttctcatatttttgtaaccaccccaccccacgccaatgcaaataggatacacgtttaaggttattccttttgaaaactgaatagtatgacttttcctttcgcattatacatactacattactacataaaaggattacaacgaatcatttgacagcaccaaaaaactaatcataacagaatagaaacacataaaagaaacagaatacagaaaaactgtagaagcttcttcctcgtttcacggcaacaaactaacatcaccaacagtgaataaaatcccctctgtgcatgattccatggaggcagtaacttcagatcggactcttcactttgatcttacacagttctttcaatcaaatggttaggtcgtcaatgctattaaaagaattttcatcttttgggaatgacaatttcagggcaaagtatattcgtcattcctatagagcttcataaagacagcttttggtagtttttggaaaaaaggacctaaaccgtgctcaattgcattgacaggatccttattccttaccgtgtttctctaattcacgctatagattcgcaaaaccgtctctgttttgctgttcagttcactattcatctcaagagcatggcgtggtaaatacaaggtgcattttttttttttttcagatggcccaaaagtatgttcacaaagtaaaactgaagaagtatcttgttttagttttcagttgagcctatcgttaaaccaacttttctacaattttgtcttgaaattcaacttaaaataaaagtaaaaggagagttgtttttattaaaaacaagttaagaaaatagttttatatctcttttaaactctactttattgaagtaaaagagttgtgtgttttttatatattagaaagtagaaacaagttaagaaaatcgttttacatctattttaaactccactttccttttcctttttgagaaaacactatatatattaaaattattatagaatttaaattttatgaatagatgtatgattgatgaaaaaacatatttgggagaaaatgttagttacacatttaactaaagtttctttttcgtatcagattattttttatttattaaaagtcaatttgaataattttcataatatacgttttattttttatatgaattctaaaagtatgaaaactttggaaatgaatgagttgaaatgatattttattaatcttgaaaagattttaaattatactgagtatcatcatactaagatcttgatttattttaaaaatgagatatcatatgaaaattaaataaaagaaaattaaaggtatttcacatcccattaaaactatgaaagtataccaaacaaatatattcttcaaatacatgaattatttctaaaatattattgataatgcttgcaaccattgtcattgttgaaattaatgatttaaaattaaaattttgcaaatcttatttgagatattaaaaataattaataagaagattgtaagaaataattttacaatagataagaaaaaaaatattaattaaattttaaatataaattttgtttaaagtttagagacaagcctcaacaggaatagcatgatcaaaatgcaaccaatagcaacgacatttatgatttgaaatatggagaaggaattgatgattaagttgaacaatacaagtaaagttgaaatatgtatcttcctggttaggtggtcaattttacatagtcagacactaaactacgagtgcatttaattgtcatgccgtatattagtatatttttgttgatttgtctttactttagatcgtgacaagcaattccttagccattttaatttgaaatagtctttgggtcagaatgggtactgatttgctccatagtagaatctattatctaataatagactacattagtcatattattactattaaatgggggaattaacaagagattccattccaagttatttttttgttttgaaagaattccattccaaattaattatgatgatatcgtaaaaatattagtaacattttacatgcacctttaattaaatgaaaatgtaagaactttattaattacactatcccaatccatatttgtacacaaatgaaataataatagtgagcgagcagtaacaaaaaaaaaaaaaaaaaaaagcgcgtgcgagtaattcggaagtggtggccaatggggcctacaacgaattttaggaagaaaaaaaaaaaatatgagaagggggaattgtgtgtgtgggtggtggggggtgatgagagagaaactgagacaagagacaagagagacaaaagaaccccaacattgtaagattatgaaggtggtcggagaaaggtttctctgagatcctcctcttcacaaaggcagcaatttaacgtaacaacattatattcatttcaatcttttaatttgctgccttttttttcttcttctcactccttccttgtctcagtttaatccaccccccacccaacctgtcaccaccaactcattgcattgcatcgcatcatcaaatcaaacattgttgatccttcagtttcaacgcaaaaagggcttcttttcctgcacccttttctcccattcgcatggtaattcaattccctttttacccctttttgttttttgttttaacattgatgggaccaagaaagtttgcttgctcatgcggttattccttgtttcttcttttgttatggttttgatttgctgtcaactttatcattttcatttttattttttttatttgttggaataaaaacatttgtttattttttttttctctggatgtaatgtaatttcttacagccccagcccacattgtttggaatcatcattgagaggacgaattgagctgggtatgcttttgttgagcaaaaggttgtaaggaagagattgatacacaaaatgagggaccctgaaaccaagagcttcaattgtttttgctttccattgtaaagtataagttttgcatagttagtaaattttctgctgcttcatccaaataggtggaagggtttctatgtacagagaaaaccttccaattttgtaaatttgatatgacatatcatatagcttcctgactttaaagagatatagatattgtcgctaccaaagtgacattgccttctcatgccaatggaaagcatatgggggccatttggattatggctccgaatttatgttggattgatttctctgtggggaactcgacagtgttggtctctgaacgatgaaggtgatttgcatggattgtccttttagtctccctaatttacagtgaatcatgtaatgcatttcttgtatcttgatgtttgatttttgctgttgcatttggaatggacatagcaggattaaccttgttggaatttcggggaagaataacttctgatccttttgctgctctggcaaattggaatccaaacgattgcaacccttgcaaatggctgggtgtacgttgtgttgatagtcaagtgcaaacgctgtaagttccctttgatttcctctttttaaattttttatcgagatagtatttttttttaccaaacagtaatacatatagttgtccttgatgcttaaagaaagcttccattttggttgatgtgaatgcagttctaaattttatgtgcttatagaattttgtgccttcttgtagggtcctacctgatctatctttggaagggacattggctcctgagcttgggaaacttcgtcatctaaaatccctgtaagggttcttgattcatgtgtccgcctatcctcccccctttttttaccattatgtcaaaagtaaagcacatgttatgctggtgaaagctctgattaaacttgatcttataataatgtaacttaaatctaagagctcagcatttgtcacatagatgtcattcttaaatttagtaaataatcatgatatgcttgaaaaatgaactgctcatactaacatgtaccttgttacagttgtatcagtttcacattccttaatcacactatgccgcattcccttctgtctggaatgtagccatgaactcaggagaccaatagcagtaaataatgtctgtgtaaccaaacaaaaaaaatgatgcctttgtttgtgtgttatgatttttataattctttctttaccttttcaacatttcttttcttttcttctcccgtctatgcaatgttaatttgtaagcctgccttcctgcaatataacagttctctccccatcaaaaactctaaaagtagctatattctcaagtactcaactccaaagaattacagttagtttgctctcagctggattattatatcatgttagtgtccatgagggttccttgtctctgttggacagattatcatgagcccttctgtttggttattttagctcttgttatactataactcaatgttatacggtttgttaatatatgtctttaatgaaagactaaatatgggctaggaagttttaaaatccaatagttcagttgacttcatatagtaatttatattcaaatacatctctaattcagatttgctccctttgttactttgaaatagtgtactatacaagaacagtttttctggtaccattcccaaagaacttggaggtctagacaagctggagttattggatttaagggggaatgacttgactggatgtatcccagcagaaattgtcagggtgttgctgtcaaaacatttgtaagttaactctttttcttttttttttcttcttcatatatttagttatatttctgggttacctacaatcaaatttaattttttcctaggttggtttgtgacaataaatttgaaggcagtgattctcaagagctcagatttccctctaataacaatcatttaactactttggcaactttatctagtggcaagaatagaaagtttgcacacctgtaagtgtatcttcatttttttcctgacctagtgaccttatgctttccttcctttacctttacttatgtagtggcaagttaattagtcataagaactactgttgtcacaaattttattctttttgcaaacaatgaagtcttttggacaatcactggaaaattatttccacaaggtcaggcatcaagtcaaatatattccatgtagtcaactgcactcttcatgtgcctatacataatgatgtcattatttaattggtttaagatgttctattaatcaatctgagatctcatattgtcataaatgaaatacttaattttctgtttacatggggtttctgtatattgtcttaaatagatacaaatcttcattctgaatttctgatggcacttgttgatctgtttaaccttttctgcatcaacaccaatgcaatgtttattctttcttaactggaggtctatggaggtaaagataaattgaaatttgtttctgttttcagtttttagttaattgttttaactccttaaaacccagtttgtctttggttacacatttatagcagtagaagtcacactctatttatctatgattggctcttgtctaattgcatatgtgctgcgaagattaaaagttacctaaataacaattattaaaagcaatctgttcatcatttgtcatttgatagcccaatgactggtgaaaatccaaactgttgatcatttcattatgttcattgaaagtttgtggtgtacttcaaccatataaactcaaaagagactcgcagaatttcgtttgttcagtgtttgtttttccatttgattttcttttatctgatcaccatagttatttttttgttgttatatgaggaactgaaatttttgtgttgtcttatagctgtgctaaggtggtaagattagatttagcagtagcaaacttttagtagtaccatcctcttgagattgtatacttatcttaatatgctgcatcctttatggttaacaagaatggttgagtttctgattttttgacctttcgatgcatggtgtgaaaagtatacaacaacaagaacaacatggtgaaaaaaatatatgccataaaaatttcaagcaatggaacatggaagattcatttgttattccacttaaaggaacactcaaaaattacctcaaagctgtcattgctgtggcactgccactgtgtgtagataactttcttccccatatcaatcttaatatgtacatatattttcttctttcatcatgtttagcttactaacatagtctgctcttatttgaaggttcaagctaggaaaggctactccccatgcctatgaagagaaatactgtgacaatctgactagtaagtggagaaccttgattggtttatggcctgtgagaaattgatacttatgctcttaactgactttcaaaacacaccttccatcatgtaggctctgatgagtcagagtttggccagaatgtaccaaatctaatcaattcagcacgacgtaagttgcttgatcagtccagtaaccttgctgctgcacctttcagtggtgggcctactatggagatcagttctattccaattacccagagcagtggagctttcccagctgtgccagacagcaataagaaacaaaatcagtcacctgcaccattgccttcatcttctaattctccacctgtgaatcaagcaagtcaacaaaattcacctaatggtgcatctggaaaatcatggaagtatattattataatcgcaggtgttgctgtcttggtcattgtttttgtgatcatgctttgcatttggcgtaaacgagcagcaaaagtaataaagccttggaagacaggaataagtggacagttgcagaaagcatttataacaggtattatttcagtaaatgaataaattattgatattgaaaatgactctttaacataaataatgtttgtttaccaaattttaaacgcctcatactgacttccctcatatatgttctttagtctatagtaatttgattgattattttcatttgtttatgtaagttacaataagtccattacctttttttaaggtttggagagtctcctgttcaacttgttcaagcatcgtctttctaatttgaataacaacaattttatgaacgtatttcattattttatggtcagctaattgcaagaaaatggattctcttcttgttaggcaatatatatactatctaaagtgtcaacctatgaaacaattttgtctgagctctcttccttaagttattagctcaatccaaaattcctgcggtgttttgtccttgtatgtaatgtaggggtccccaagttgaatcagggagagctggaaacagcctgtgaagatttcagcaatattattaatagttttgatgagtgcaccatatacaaaggaacactatccagtggagtcgagattgctgttgattcaactattgttacttctgcccatgattggtcaaagaacatggagacagcctatcgcaaaaaggttttctccttttcaagtcaatggaaaggaaaaagttgaattagaagtcccaattcaattgagagggactgtcgattcttaattacctgttgctaattttgttccttgtatgcttcagattgctgaattgtcccgtgttaaccataagaattttaccaatcttattgggtactgtgacgaagaagaaccattcacaaggatgatggtgtttgagtatgctccgaatggaaacttattcgagcatctgcatggtaacaacgtccatctctatctaaaggctcaagttattaccttgtgcatagcaaatccgattaaagggttaagttctcttcgtaaaaaacaacgtgctgaatttgtgtatatttgctctcttttcagttaaggaagttgaacctcttgactggagcgcaaggatgagggttattatgggcgtggcttattgtcttcagtatatgcaccatgatctaaatccaccagtagctcattccaacctcaattcaattgctatattattaacagatgactatgctgctaaggtatacacctttctattttttgtttttaatgtgtgttaggtaacaagtaacatatctccattctattgctctcagatatcagagatctctttcggcaagcatgcaaaaaccaacacaactggagatgaatcacagaaatcttctgagttgccaccccaggctgatcctgaaactgatgtctataactttggagtattgttgcttgaaatcatttctgggaaactaccttactctgaagaacaaggtcacctttccaactgggtaagtttgaaatttgtgcccgttactttgtttttctttcctttgaaagtacccttccttgtactttcaagtgcaactccattgttctatgtcacttaaacaaaaaaatcctgatcaacttcctaggctgctgagcacttgaatgataagcgaagcatcggctatctgatcgatcccacgctgcagtccttcaaagatgaagaacttgatgtcatctgtgaggtgatcaaagattgtcttcaatctgatccaaggttaagacctacaatgaaggacataactcccagattgagggaagtgcttcatatatcacccgagcaagctgtcccaagactctctccactctggtgggctgaactggagatcttatcagtggaggccacttaaaaagttctatctaactctcttctgtgtattctaagtcaagtctctctctaacctttaccgtgctggaagagtacagctttctgataatgctatatggtatttgctactcaaattctttaattctatttgttctttcgtaagtccatataatcaaaataccatagctattattgtcccagtggaagcgtgttatgtaattttgcaagtggggtgttgtaaattgtacttttgttgatgaatattgggatgtaaaaaagtcttgacaaattaattggtatttcagtcccaatgaacatgcaacttctatacgggtctattcaattattattaatgaaacttttaagttgtgactgttccccgattaagatagtctaccaattccagaacaaacaggtaggcatttttcaaaagggaggcagaatagttgaaaaaacacaacataaacaacgacaactgagctttatttgattccacaattaagtaatatgcatcaaactacgtgattagattattcggctgcaccagctatatgcatttaattgactaaattgtttaatagtcaacaaaaaccacttttagtatgacaaacacttattgaactatcagtttcaccacttacagtgcaacttggcttatgttcaaatatttagttcggtttatagagatattttgcacacccttggcagtatatagaccattcatttcactttattactttaaaagatatattttttggtacaggtaggaaaaacaaaaacaaacaacatttgtaagttactttaaatatctttaaagatatttagtattgtcacttgtcagactgccatttcaccccttatcttatttgcaatggatgcaatcgatatatctttgatgtcgaaactttatttcttaatgtgacacatttcttttttaacttttggctacatacgtttacctttttcatatttgtgccacatattcaaaatctgtatactttagctgctgatttcccattcaataaccatagttagttcactctagagggaaaatgtatacgagcacaagattgggttgccgccaagtgcttctgattagtgtggaggatgtttttattattttttatatgtaaaaatcaaaacagaaatgtcaataaatttataataatttatatattctatttaatcaattaagctagattctattaacaaaacattttcatttatgattttgattaaggtatgcacaaaaatagtgatgacgctttagagattaattgtgagtcagcaaatcatgcgaggacgcggatttgatgatgtacgttaatttatctcctcatatgatctctccaatttcattacttcattttggtaatctctccaatgttgttttccccacactttactctacaatcacctaagtcagatgctaccctcacgtaatcatgtggcctcgaaaagtctttcaactcaaggcacatgatgggaaaaaatttgaactattaaaacgcaaactcgttcattatgaaataaccacaaatcagaataaagaaaatggtaaaaaaaataaaaataaaacaaaatccgcaaatttatcaaataatcataaacctaaaaaatttcctaaacacctcttttaactaataaataaaaaatggtcagtctaataaataactaaataagcccaaatattatagaacctctgtattcactattacggaagcttttagaaaaacatccatgcaatttatttaaacttaaacagaaatggattatgatttgtcaaacgttttttagtttatttttataattctttgctaaaacatatctaaataagttttttaatcttatttcaaaaaattataatcaaatttataacataaactcacatataatgaattttttttcctgaatgcacatatataatgaaagtttaggaaataaatatttaattaaggtcatatcgtcaagttattttagttattttttagttatttttattaattaatttttttttactattaggtacataattttttttagtagcttcagttatgctcaacaaaataattaataattgaaaactaaaagctaaaaaattaacttattaaattataagtattcgataaaattaggtgttgaagtaactaaaaaatgtaaaatgatagaaaaataataaaatcatgatttatttaaaaatgataattaagaaattagataaatatattgaagataaaaatgaaagaaaatataaaaaaaaatataagttagaagctagtattttaaaatactcaagaagttactaaaaggtttttaccaaacaatcaaacaactttctcaactaataaaaaagttaaaagttaattgaaatgtcttatcaaatatattttttaacattttttaaaatggagttgaagtagttaatcattataactttttatattttcttccatttttattctcaatatatttatccaattttttaattatccttattaaataaattataattttattatttttctactattttatattcaattacttcaataattaattttatcaaatacttatgatataataagctatttttaaactttcaactatcatctatttgtttttttaacttttaactagcttttcaactttcacttaatttttcaattaattttatcaaatataacctaaattatttatacaaacatctcatagttcgattttcaaatgaaaagaaatgacggcaatagaaacctactgtaaatatgttccattcaaaacattttccattatgaacttaaagagtttaattttcatgtgatgttggtgtaatgaatcttatacaatggtttttaattttttttgtttttttaaattaattgttataatgattaactaaatttttaatacataacagcatgtaacggatgataatgtaaatgttttatcctattaatacattctaattaaattttaaatataaattatggattacctacaggtcacatcatttatttgatgagtgtatttttttatttagtacaatttataaaaatttcataaaagtatattaaaaaatgtatgatatatttttattatcatttctaaatatcctctagaaaagtatttataaaaaaattatttataaatcatgtctatggataagatatattcatgacatgaatcatatatcaaattggaatattataaagagacatgtgatatattttttgtatttatatctttttatcatattatttattttattcaaactcatctaatatcatattatttattttattcaaactcctctaatttttctctctcttagttataaaatttgttattcaagtatatatcatttctgatagtgtgccggtcaaagagtcttgtgtataattaaagtagtgtttgatagctgaataataataatgaaaaatgtagtgtttgataggtgtgctcgaaggagacgaaatatagaattgttcaccctaataataaaaaataaaaataaaaaagtattcaaataatataaccaaaaaattatttacactaataacataaatcattatttaaggtaagaagtcgcactttttgtttttttttttttttcatttttacgctgaaattgattctccaaaaatcaattccatgtgttatttttttttatcatgcatgatagaggatatttgatataaatattgtattgtgcactataaataatgttttctacaagaaaatttgactaaacactaattttaaatttataacaaagtataatttatctcaaagagtacttaaacaaaatgcacataattaaatactcaatataaatataaatggtacaaattatacaaattatagtgtaaggtgagaaatatattcaattcttcattttgacattgtgaatcaatttcacaatgtattattttttttttaaatgaccttattaagtcgattttatggaaaattcatgtcgtaagactttgttttaaaaaaaatacagttcagaatgtgtttttttttgttacatatttcagttttgtttttttttttgtaaaaaatagttttatatatttttaaaaaataaatgtttttttaaattattttctattttgtttgttacagtttttttaagttcgttgaagaaaaaaaataccttgtgaaatcgtatcgtgcacgatatagtagtgtccacttgcattttagtgacaaaactagaaagaacttattgtagtagagacaagataatatctcttaatataaaaacttaacatgatgaaaaaaaaaattaaaaatagcaaggcttaaattagaggagtaaaataagaaggattagtagggtggttcaaactcgtctaataaaatataagacttgagttttgaatatgaattgtatatagattcttttagcttaacctaatgatgaccggatctaagcttagtttttttataaaaaaaaaacttgagaaaatcaaatttgtgcttcacttttaaaactaaaaataatatttttttatccaaccattataatctgccacctacatcgagcaagtaacatattttgtctcttctaatttaaatgacaacttcaaatatagaattgaaaatcttaaaatgagtccgggcatgttgtttatgttcaacttgcatctatttgtaggactggacattggacatttgtaagtagtccaaccaattatagatgtcttattaatccatttcctcttcacagcaaacactagctatgtgtgttatgaagtaatggatatctaaaaaagtgaaatcaaatatattttttttaattcggtatcctctacaaaagttaagaattaatcctttaagatattaaaatttatttaaggaattgatctcatttaatatatgtttataaacctataatcatatataaaagataaaattatataccaatcatatcacattatattactaatcaatattctttattcaaatataacttttatttaaaaagaaaatactatctgtgattcaaatccgcactaataagtaaaaaatgtgtttgatattatttcctagggaaatcaatttaaaaatacaaaacactcctatcatgcatctttttcagccttccacttcccaggttggttttgaatatataaaatcagcagctacagcagaaaggtggacatgaaaaagtttttgaacagccaaataggttccaacagtcggttccattagccacaagggcccctacaatttgaattatttgaaaccactggctctctgtttttggaccacagaaagaaacaagcattggaattggtgaaggatgagttagaagacaagtagacaagcgctcaatctagttcaacaccaggcttcattgcatcagcacaaagtaccaaatgatccagaaaccatagattagtgatggcatgtacataacgtaaaacatgtgtgtattttctaacaagtcaattttcacttaaaaagtctcttcatgaaataataactaagtttcttaagagtttataatttataatttgtagacataacacctatgcattgctatgtttagtaaatacgacggttccttaggcaccacttgtaagtgtgtagggccacgctacaatcaaacttatggtgtctgttttgctgaagcattttgggtcaaataataggcaccacttgtatgtgtaggcccggtgtgaaagcaacaagcttattttttggatataggagggattttcagggcatttatcattcatttgatcaatgctctacaatgctttcagaattgagtgaatctcatctatgttgataaatccggcatatttctcccattttctctactctggcatatgagtatttgcttttcactttgttccattgtttaaaatataatatcaacaagaaatgcgctggaaatcagcatgattcaggggaaaatagatcacttattttaaacgagaaacagtgaaggaaatcttctttatttaatagtataagccataaggctttcatttccctttacaccgatatgaaatcttgacctgatttggttacatatactaggacgggttgttgttgttatgacattctgattcctctctttagcctatgtttggtataggagaaagagagtggaaaggaaaaaaaaattaaaatttgaattaaaaaaaaaataaaaaaaagaaaattttaaatttttatttttataaatcaattttttttctttttttatttattttctcttcattcaaataaaagaaattatattgttcgtgttttcctttcactttgttttctttccttcttaccaaatatagcattagagtgaattcccacaatctcattccaaattaaggtgatgaatatatggagttaatatgaagcactagacacccaaatccagtgcaatacctcacggaatcacaagaaagttgcattattattttctcattacttgcaataaagaaagaaaataaatacagttacagagcaatttaccaagacatgaaaactgtgaactgtgaacatgtacacttcattcactatatttaaattaaattagccttacagaaatacaacatttggacatacaaagacagtagcatctaatgctccagtcaaggagcaaacctaacaatgccggaaaattcttgagggaaaaagaaagtaaaatttaacttacacacagcctaaaataacaagagagaattagtatgctatcatcttctgtcattctcctgctaccttaattaatgcaagcattcattgtcttttttggtttccgatatgtttcgttctttggaaacaattatagagcccaagacatgatcagatagtaaacatggccatattttcctgttgacattctaactttgattcaccatgttgcgagatactagtctcgtctgctagacccaactctggttcgtataaacattcattatctgaatgtctgttaagtgcagagtcagaaagtgttcgatgttgttggagttcagattgaatgtgtgtagattgatgacaagaagaagaagaagcagattcctccatccccaaattctccaacgcgggtctcaactcagagttacaaaacttgtcatactcggccttatcccctccctttttcttgacctccaccactaccaaggaaggtgtcaactcaaaaacctcagcagcaatagtcaaaggccccttcacaccttctctacacccctccaagctcaccctgcaatctttcttcctcacagtgaaactaaccaactgagcaacctcctccaatttcgatataatcttcgacaccggagcagatgacacaaacctcgcctcatcacccttttcctcaaacaaccctgatagatcaaagccctgagaaaacgatatgatgtcaaacgcattcaaactcgcaggcctcggcagcgcaccattactactattactattaatattcttcctcctaatctcaacctcagaatccgaggttgccaaatcatcatcatgatgaagtaactgtttctcatcaaaactacaaactctatcatcttccacataaaacttaatctgcttgaaacccttcttgaaccagcgattctccatgacttcaggaatagaaattcttgtctgagggttagtatcaagaagcctagagagaagtcttgtaagttcagaagaaaaccacctgggacaccgaaactcacccttgtaaatcttcttatacatagccataacgttacggtcatggaagggcaaatagccggccatcagaacaaacaaaacaaccccacaagaccaaatatcaacctttgcaccatcgtagcctttccgcgccaagacctcaggagcaacatacgcaggtgtcccacaaaacgtgtggaacagcccgtcctgccttatctgatccgacacggcactgagaccaaagtcggagactttaaggttcccatcctcgtccagcaacaggttctcgggcttcaggtcccggtggaacacgccgcgcgcgtggcaaaactccaccgcggaaactaactgctgaaagtactttctcgcaacttcttcttttaatcttccctttgcgaccttgttgaagagttcgccgccacgcacgtactccatgacgaagtagatcttggtcttggtggccatcacttcgaagagttgcacgatgttggggtggcgcacgcgccggagaatggagatctcgcgctttatgtgggagaccaaacccccctttaggattttctccttgttgatgatcttgatggcgactccttctccggttttgatgttgcgcgcgtggtggaccttcgcgaaggttccgtgcccgaggagcttcccgagctcgaaccgccccaggagaaggttcgggttttccttcttcggcggcggcgccacctcttccatggtggtgctggtgatatcgattgatcctgtgagataaaaacagtggaagtgttcgctagtggtgatggagcttcattggagttctgaagctatggaattggtgggtgtggtttctattattaaattgtttcatttgatgatactgttgtattgtgtgtaggaaaattaaagtaaataaaataattcattcatattcatggatttactattgaaagtgtggattttttttttactgaaatgattaattatttaaattttaaaataattaatcattttaaatattaaaataattaatcattttaatcatgattattttaaattaattattatacttatatttagtatttcgttaaaatttaaatattaacaggatattatcttgatgtttttaatggaaaaaaaagaatcaaattaaaaattttaaaaatatataaaatcaaaataaattttaaaaatttaatgtaatgaaatgaaccatttaatttatattattttttctttaaattaacattaaaaatttaatgtaattaagtttttttatttatcttttatctcttttattaagtttaaattaacattatagatttttttataacacaattagcaatttaggtagtgaataattattttcttattcgaaatgattatttttatgcagaagatttttgctatttgtagaaaaaataaatgattttccatctattttagtatttgttatttttggtaggtgtgctgattatttgtttgtgacgtagttacttaatcattgactctggcaacggacacagtgcaggtgcagcggatgtttcttagtactttttcttttctttgtttttatgagtaaataaattattacgtttagaggacaccaccaaccgtgccttaccatttcacttgtgtttaattataacaatgtattgtctgcttctaagtacatatatggtactacaaaatattacttatgaataattctatattgctgatgtagtaaatgttttattgaataaagagttttaattttaaatttaggtccacgataatagaatgtaatgataatgtattgttgagttaggaaaacaaccagcggaatttaattatttaaattttgtggcattaaatttataagattcgctaatgattagtggttcaagaaaatgtccccactatagtattttattaatagaatttaatcatgctaataaaaatatatttcaatttatttaaaataataataataattttcaatttaattttaatataatatcggtatgaaacttttttatattaatttgttatgttatagtaaacattaatactttaatcaataaatttaactataaaagaattttgatattgtcaattagtcaaaaaagttatcattagagtaagtttattgacttctataaacttactataaaataagtgtaactataaaggttactttttatataaaagaaaaaaaaaacatatttattatgattctttacttgttaatagtttaaaaattcattacattgttaccaatatatagaaatgaaactcaaattttgtcgatataaaaagataaaattattcataaagtatggattctttcctggctgctttaaaacttaaaaaaagtatatacatgtcttttttaattaaggggggttttatcatgtaattaaccatatagttgatattttataataaaaaaaactatatacttgatatatttaattaagtatcttgtaattttttaaacaaaatcaacatacaaatatatgaaagataaagtatgtggctgtaattttcaaacgagaagattttttatactacaaacgctaattgttccatttccatagacattatgatgacatcttactttttgtacaagaaatttttcgtatgattgtttttttttttgtttgttaaaatacattttctttgtccttgcaatgttccatccataattttgatcttccgtttctaaatcgagaagaaaattaaacactaaatcagtaggaaacttgctttcgttgtttcatattgtaaacattattattatttttttcgaattatacaaatttataaattaggtaaatttgtttaatatataaatcattttaatttattttatttatttttacatatttacaaattaaactatttacccaataaactaataagtaacaatcatttatctattatttgttaaacaaggggttagattattttggtgatgaacaacaagggcttagattgtacgagtacgagataaatattatttatggttttcaggattattatggggtcccttaatttaaagtggaatcatcatcattcttcatggccatgtgcccatgtgcctccttttcctctccaaagtgcctccgaaaactacttgaactctttcaccgtcattagtgctccaaacctcactgtctcataacgacttcaacccaataactcacaactcacaacgtaaagagagacaaaccaaaattgatgtttttgggtgtggtagcaacgaatgaatttggactgccatacggggtgtaggaagcaacgccctaaaaattatgatatattgttttgttgggccgaaaggcccatttaaaaggataatatcatttaaatggagggggagaggagaggtgccccatgggccatgatacataaacaaaatacaaactcttcgtcagaagaatatttagaagatacgcagtccagtgaaaagaagatgaagggattattagtgtctttgagtagatgttgataaagtaagcatgttctgtttcagttactggttattaagagttttattatgatatgttttatttaattttgtgtttcatttttcttttctttttctagccaaattaccttcgtggcgcattttattgtgttaaattttcattttgtttcattaaaaaaaatcatttttgttagtgttcattcggtgattttgttgatgtagtcatgttcccattattttatactcagaaatttgctaaatttgatgtcatagtttttgttatctcacaagaaaaaatttctcattaaggatcggtttgtttcagattataaaagaagtaatttttgggtgaactaaggtatttcttgattgaaagacaataactaatctccttagatattgaaatccatttaaagatttaatctcttccaacatatgtttaaaatagtttatgattataataatatttctaattccttttaacttgttttgaaaatttgtaacaaatacagtgtttttttttaaaaaagaagtgattctttaaaattttaaacaaatgagccctaaaaaattggtgtttccttacttaattttatactctttattaaaactgttggtatcggtattgattgtgttaagttgctattggcctagttctcacaagtcacaagtaaagaaacatttttgggttgttttacattctgatggcttttatatttacttaaataagttggttagttagacttaatttttttttaatgacaaaatttaactttcctatttgattaaataatttaattttctttttggctaaatttattttgtaaaaaaccctaatctaatgttggcttaatataaattaagctataaattccagtcgagcaacttcacctatttctatagtattttgattgaagtaacttataagttactagactgacatatccaacacactcatatataactgtttctaaacttagtttcgataattttttatcaaaatattaataattaaaaataattttacattgcgattaaaattatgattattataaatttaaaatataatttatacatttaaaatatttatttatcataaattttaattatatataaatttatatattaaaaatatttgtttattttaaatagacagagaggagagcagaggcagtgttggctaagacaatggtgtaacgaaaagctttggagggtacgatgaacatgacatgaaatgaaagtataggataaaagtaatacactcacagttcctctaaaaatattttttgaagaaaaaattaagaaaaaatgaaataaagttttctataaattaaaataaatttttcgttaattcatttataaatgtcatcttatattttagagaaattatattagtaaatttttaaaaattaattaataaaaaatttatttttatttataaaaaaattcttcacattttttcctttttatttttttttttaaaaatacttgcaaagctgaagcaaaaaccaaagaaagaaacacataactttattaatgcaaccttatccgagcaatgtgcttttgtgatatgagaagcttcaaggagaagactacgagaaactctctgatctcatttgattgtgatatttccaaattcggaatagaaaattaattgaagaaaaggagcttaattagttcttttcggacatgtgtaaataaacctcatacaaacattagaagaaaattagagataaaatgaattattttttattaaaaattaatttttatattttaatttttatatatgtataaattgattttaatttatgaaaaaaagttgttgtgttttcttaaatattatctgaacaaaatattagttttattttgttttatttcttactcgtttggttcctacctaccacatttccataccacaaggtacacgttctttatttgttgttacctgctgcaatttttttatttcttattttatttatgacatttacttgataagtcttacgtattggatatgcatgtgggtagttcatcaaatcaaactattagagtgaagattttgtaaaattaaaatgctaatatacattgaaagaaagaaaaattgcattttaagttgttgcagccttgcaggtcccattgcgtcttttcccaaacctccaactaaaataacaaatagcagatgcaggtgcaaagcttatcaacaaaacacgttacgctgatgaggcgatgttcctaatttgaaaaatatcctatttcacgaaccaaaataatacaattttaataaaaaattatcaatttaaaattatttataaactatttatcaatatgagattgtttctaaactatgtacgaatctggaccggtcacgcccaattttggacgcgacccaccagatggcgatatatgtcatgacatatggagcgatacatatataaacttcgaacggtcataacttttgattggaatgtccaattgagacgtagtttgtgtcaaaacgctcgaaattgagagaagtcctgggcaagtccctaaacttggtcaaaaattttccccaaaagaggcctctaagtgtctcaaaattgcgatttaatcttcgaagttccaaaaaaaattttgtttataattttttaattattttgtcagttaattgcctgctattttttacttttttattgtctctcttaatttcgagcattttgacatatcgtacacctcaatcggacattgacacctcgataggacatatcttagagcatttgatgaaaatgtctgatcgaggtgtacgataggtcatttgatcgaaattaagagagacaataaaaaaaataaaaaatagcatgcaattaactaacaaaataattaaaaaattagaaaaacaagaaattttttgggacttcgaagattgaatcgcaattttgaggcacttagaggcctcttttggagaacatttttgaacaagtcacctttaggaacttgctcaggggttctcctctcaatttcaagcattttgacacaaactacacctcaatcgaacattccagtcaaaagttatgatcgttcaaagtttatatacgcattactccatttgtcatgacacgtgttgctatctagtgggtcgcgctcaaaattgggcgtgaccggtcacacccagattcaagcgggactggtcacacccaattttgagcgcgacctactattccaaattcgtaaataatttacaaacagtctcaaattaatattttttttattaatattgtattatttgaattcttttagcccctaattcacatcaaattattggacaaaacaaataaacatttcaaaatattctagtactaaaagtcattatcattatttttttttaatatgaaaaaaaaagacactcgcataacgcgtggattgattaaatatagttatatataggtagctatagtatggtaccgtttctgatgtagtagaccgggcaggaccgctgcagaattatattttttacaagagaagaaatcgtattttaacagttttagaataatttgtttaaaagtttaagtagataaaatttgttttttaaaaatatttttattaaaaacaatttaagtaacacataaaaagaaaattatttcttattttatcaataaagcttttttttaaataagcttaaataaacggacctaaactgaatttgctataaccaacaatcatttgcactttcaagtttcaaataaccgaagcctctcctcaattacggttgtttgtaggagtgacatagagaaaaaaaagagaagagggaaagaaaataaatgattgataaaaaagatagtgtgcttagtagagtgaaattaaagaatgaaagaaataaaaacgtggtctctgcaaattggcgcaaaaattgtgcaataaacctgttttcagtgattatcaatgattcagaattgataatgaacatttttttatacatgaaatcatttgttctccgttgctagttgattacgaatggtttcataatcaattatcaattttttcataataatttatcagtgtttcataattgattatttaactttaaaattttaaaaaaatgttttacttctgttttccttatttctttttcttatcttcaatcgaatgtctttatttaatttcattctatttctctcatctagtttattcattttatttgtcacctaatttttttcttgttaccagacacattgtaaacattgtatacattagacagatagactacacatttaaaaaaaagtaaaaaaataattaaatatgatagaattatgatttatgataaaatagatagagatagataaaaataataatattgataatagatttaaaataaagaataaattatgtattatttctcgtaaaaaaaaatgtggaagcaataattgccggcttcagtcaagatgtgatttttacgtcaaattaaatgtctctttgaaatggttttcaaacaagctgtaaccactatatatatgaattgtgcaaagaccttcttaacaagcaaacatatcgtaaaaactttcaccgagttatggctttccttgtgtttcttctcttctccctcttaggtttctcttctagttccagaatatcaactcatcgttccatattggaccttgacctaactaagttcaccacacagaaacaggtgacttcactgttccaactatggaagagtgagcacggacgggtctaccataaccaagaagaagaggcaaagagacttgagattttcaagaataacttgaactatatcagggacgtgaatgcaaacagaaaatcaccccactctcatcgtttggggttgaacaagtttgctgacatcactcctcaagagttcagcaaaaagtacttgcaagacaccaaggatgtgtcgcagcaaatcaacatggccaacacgaaaatgaagaagaaacagcattcttgtgaccatccgcctgcttcctgggattggagggaaaagggtgtcatcacagaagtaaagtaccaaggggactgtggtatgtgatgcatgttactattttttttattgattaatattaatttattagaatgttagttttgttaaagaagattgaactcacaaactatacggtatgtgatgcatgttattatgttagtaataattagctagtaaagcctatagaaactgttcaaaaggttgacttatataaggaatcgtgggatctatgcttattttcaatactaatcaacttcttttttatttggaaatgacttgtggagtgtgacacgattttgatacataggaaatggttgggcattttctgccacgggagccattgaagcaaaaaatgcaatagtgacaggaaaccttgttagcctttctgaacaagaaatcacagattgtgtctataaagccaacagttgtaacggtggataccactttcatgcatttgaatgggttatagaaaatggtgggattgccactgaagttgattatccttacacagctgaagatcatggtacatgcaaagccaataaggtatctgttaccttcttttgacaacttagcttgtgtatatataacccattaattactcttgcctttcatctttttgtttaatttgtgcacaccttttctggaagtagacacaaaacaaagtcacaattgacaattttggaggtctaataatatcaaatcatagtacacaaccagagacagacaatgcactgttgcgcgccacccttgagcaacctattagtgtggccatggacgcaagagattttcatttctacactggtgtaagtaattactatattatatcttaaatagttggggattattattattattattattattattgttgttgttgttgttgttgttgttgttgttgttatttttattcattgatttgtgcagggaatttatgatggaggaaactgttcaagtacgtatgggattaaccactttgttttaattgtgggttatggttcaatagatggtgtggattattggatagtaaaaaattcatttggaaaagattggggaatggatggatacatttggattcaaagaaatatcagtaacccaattggagtatgtgcgattaattttttcgtttcttggcccatcaaagagaaatcagaaacactggtgtctgctcgcgttaaagctgatcaaagagtggattactcttctctttgaaccgtgaaggtggtccaattaattaagtagctagtgcttgttttcttagagacaagcatcgcatgtatgattctgcgtgtgatcacgagtcttccatgctgtattaatgtgagaagacaaaaataaaatacgcaactgatttttcttcaaataatgtgaaagtcaataatagaacactgccactgttgcatgtgttttgagatatcctctgggcttcatgcctttctctttaccatatatgtttcatcgttcataggttctccagtgtatttccttttactcgactacgtgaaaggaatattaccgtttttttttctccactgggtagagtcgaaggggtttatttgtttgaaagatggcacgtacccaattaataatatcacaactacacaactacacatataaaagcatcaagacaccaatgagtcaagattaatatatatgttcgacggcaactatgtgtgtatgaagtttaggtaattaaacatatttactgtacgacctttttttaaggaagaaaagaaataggtgactgagtcgatgaaaataataaatgaaaatgtgataaataaaatacaaataaaaatatttaatttaagagaaattaaaaagaaataggtgattctcgatcacaatatggtctctattaatgtcaacaagacatgttattggtgatgaaattttgcacttatatttattaataaatataatctcgtagatatttaatgaaggaaacctttactcttttaatttggaggccttttaatttatccttgtttatagatcctctgtcatgagtttagtggttttgatcgtgatttaacactcacaaattacaaatatttattaatatacttctattttttctcatctctctttctattttattatatcatgaatcgaattaataactttatttccaaagagtgtttaataatcatttttcttcgaaaagtatacttcacatctatgacaataaatatttcaaaatattaaagtactaaaagagtttttatttattattaatataataaaaacactcgactacatagtgtgtgaattactgtttaatttaaatatagttatatatagggatgataaaatgaatcagatcaaaataatttattaattcattttgatctattaaaaatttatttaaatttttgtttcaatccaatccatttaacaaaaatttatctaattcattcattaaaaattatttcatggatgatccatccataaaaattataaatttaaataaaaagaggagagtaattaacttctgcataactgaatttataaaagttttttatataacttctctaaaaaaaaatatttgtaatttatgcatctatataagctaattttagtgtattaccttttttttctctctcttatttttttttctttatggaagcttattcaaataaacataattatggttgtatactgaggctaaaatttgaaaaaatattttgtatggaatgttccacagacgacataggacttcttctatgaaggtaggacaaaaatacgggcttttcattgttcgagaatcccctgcagtagaagaggtggcatgccatagtttaagaaggggacagagatcctaactagggctattcttagtggactagtcttttgcttttctccttttctagttgtggggcttaaggaggaaagatgtcaccgggcaggggaacgaaatctaatagtttggctgttgtgcgtacgaaacttgctttcaagcttgaaacttcttgtccatccatctggctttaaacataggatttgcgggacatcaaattaactaaagaaataaacatttcaaattatacaagcattaattgtataaaacagataagaatacacgtttaacttcaattgaatgtttttaaaaggggtaatataatacaagttgataatttacagaaatttcatttcacactagccttacagaaagaaacaaatcttaaagaaagaaagcaaactacaaatttgtaactcacaataatcaaaagaatacaaagttttaattagaaaaatattgttatttggtcaataaatctagaaaacagatacgtttaatatcaattgaatgtttttgaaaagagtacatacaagttgataattttatagaaatttcctttcgtattagtacgaaacttacagaaagagacagatgttaattaaagaaagaaaattatcttcaattttataacccacaataataaaaaaattaacttctaatttaaaattttttgttatttgctcattttgtgccaaccttaaactattcaagtcctatcagagggcgttaggcattataaataaatgccatttattttgggaagcctggttgggtgcaacgtgttattctgtgaacattagaggggatcatttgtagggtattaggttggatagctgatgttattatttgggcttcttcctggttagattgtatttatattttcatgtgcatataaataccgtttaaccttggaagggctatctcttctatatgggttttggtacccttctgtacttatattgttatatatcttatttgcctgataataaaaagtgcagtatgtacttttatgtaaacaaaaggtgttatatatatatatatatatatatagagagagagagagagagagagagagagagagagctagagtcataagtcattgtctatactattttattttatcttaaaatgatattcaagcgcactaattaaatgttacaaacagatagaatattacacgtttaacatcaattgaatgtttttaaaatggctacgggcaagttgattatattctatggaaaatccactgtgtattagcacaaaaattactgaaagtgataaatcttaaagaaagaaagagatctatcttcaatttgataacccacaacaatcaaaagcttaatttaaaaattaattcttgttattttggtgtgtgacactccctatagctatagctagattgtaggcctaatcacaattaaataccgcaaatgcaaaccaaaaacatatccaccacatatgtaattaggataataatcattattgtatcctaacaacgtaggaacttcatcagtcgttaccctctaatcatcatggctttccttttgttgcttctttcctcccctcttatgtctctcttcttcttcttcttcttcttctagttccaacatcccaagtgaccgttacatattcgaccttgacctagccaagtttaccacacaggaacatgtgtcaatactgttccaactatggaagaaggagcatggacgggtctaccagaaccaagaagaagaggcaaagagacttgacattttccaaaacaatttgaactatatagggacgtgaatgcaaacagaaaatgaccccactcctaggggcggatccagaaaataaattaaggaggggcactcaaacctttaagaaaatttttttatgtctgcatatttagtggtgaggttgcccccgaaaaaaatttttgtaaaaaaaatttaaatcaacattttatgtataaagttatgaattcgtttaaaattatattatatatataactaaaattatttaattaagaaaatttatctataattctatactaaaaatacaaaataacaattaaatttgataatacaagtaaagtgtattaataataaaaagactataaatagcaattatctaaattaaaattcaaaagcttattttgaaaatgtaatatgaaactgtaaaaagaaaaaatgtgaatacgaaaagtaaattagacccaaattcttatctcctctacttctaccattgcagttccttttctctttggcattgttctttctgccattattatgcctttttttttccactagccaccaacattattctctctgctccatatttaaggggggggcattgcccccccccaattatcaacctagatccgccattgcccactcccatcgtttggggttgaactagtttgctgacatcacacctgaagagttcagcaaaatatacttgcaagatcccaaggatgtgtcactgcccatcaacatgcatggccaacaaggaaataaagaagaaggaacaatattcttgcgaccatgcacctgcatcctgggattggagcaaaatgggtgtcatcgccgaagtaaagtaccaaggacaatgtggcatgtgtttttattaagaagccttctgttgaaaaaaattaatttagcttcttaattctcatttttagcaggaaaatacttattattcatctactttttcttccatccctttttcaccatatttttttgtctatctctatttattttttatatattgcatccattactttctctatctacatttttctttctttccatctctctctaattatttccaccaaatccatctcattttgtagtgtacgaatattatcattctttttaataagcctcttattcttatacaagatttaaaaatattcaataattttcattcaaatgatagaattcaacttgaatttttaacttatttttattgatcagtctcattttatcttttcacatacacaacaattcaaattttgacttgggaaaattatttttccaatgattaagcaaccttgtttgcagttatttatccaagcaacttatgtaagcactttaaagaattcattaatttgttctaatagcattctcaggtctcttaattttaacttttaagaaccaatataaacaattgcattagaactatactaaggctttgcttaaaacagttttgcatttttaatatttgtttgtctactaaatatatttgagagtttttacaaaagtaagaagataatctaattaacaataacattggttcaactttttatttatttggaaatgacttgtggagtgtacatgtgaaaccattttgataggaagtggttgggcattttctgccacgggagccattgaagcaaaaaatgcattttttaaatatgcaatagtgacaggaaacctttttttagcctttctgaacaagaaatcgtaggttgtgtcaataagagccgcggttgttacggtggatatcacttttatgcatacgaatgggttatagaaaatggtgggattgccactgaagttgattatccttatccagctaaaaatggtacttgcaaagccaataaggtctgtgaattgaatatgtacgattccataatccattccctctttcatttaattaccttttgacaatataactcattaactaacttactaatttaccgctttatctctgtgttttgcgcaccttttttctggaattagcaccaaacaaggttacaattgacggttttgatggtctaatactatcaaatcatactacaccatcagagacagaaaaagcactgttgtgcgccactgttgagcaaccaattagtgtggccttggactgagaagatatttttcctacactggagtaagtaattataactgtaatatcttagtatatatttgggagtttattattgttatatataaaaaataataattttattaattcattgatttgtgtagggcatatatgatggaggaaactgttcaagtcattatgggattaaccactttgttttaattgtgggttatggttcagtggatggtgtagattattggatagcaaaaaattcatggggaatggatggttacatttggatatatccaaagaaatacgggccataaagcaggagtatgtgggatgaacttttttgcttcttggccaaccaaagagaaatcagctgcaacactggtgtctgctcgcgttaaagctgatcaaagagtggattactctcctctttgaaccgtgaaggtccaattaattatatataacgagggcttgttttgttagagacaagcatcgtatatttgtatatgattctgtgtaataaaacacaactatattttctcataattcataaataaaatagaacactgctactgttgcatgtgtttcaatatgtgtgtgtataatgccctgtttagtttttcccgtttgctagctgtatatcgtcgaaaggttgatttgttttttaaagacgacacccaataatatcacaactacacataaaagcttcaagagtcaagcttagtcctgaagggagagatcaaatgacatgtaactttgatagagtaacagcaaaatccaaactattaatacatttttattataataaaagtaatgcaattgagcacgaaaatatttattcttttttctattttttaattcataaattatataaatgtagaaattaaggtaattagaacaagtatattttctaatttaaaataattaaatgttttaactacgctaattaagattttttaaaataaaataataattaagaatgttgccttaaattataaaatatatttctaactaatcaatatttcacgcttttaagttaccagaaagtatatttaactaattatctttaatagtgcaatctgtcattttaagctttaaatatatttaaccaatggttagttggttgagtaatatttgtgattgttataaacctcataatggttgagtttgattactatgaataataaaaaactaacattctctcttttctcaccagcagatcaaattcacaatccaaagatgcctataaatatttttcttttttttaatgcgtaatggctcaatacaaggccagtcaagatcggccttggccgaatgaacaaccctcaatcctcataataacatgacgtacaattataatggaaaactctcatataacacaattatgatttattcaggacgcacacattcgccttgattctcttgaaattgaactcgttatgtaccttttactgagttgggcgtgattctatctatgtttaggagaaaagaaaggataaaatgtcttcgtctgtggacatgattttgattgtcattttaggttcaggggaagaaggacgccaaggttttcttttttccagttttaaggttatcatgataacagtggagactatccaataattttacttaattaagactattatttatctgtaaacttaactaactatttttaataagattttttttctgttaatcattatttttcatctaaaaagatttaaacatggtattttacttaagagatttcttgcacgtttccttctcccttcactaatttggttaattagactaatttttttttctaaaactgaaaatgttgatataatttaaaagctaattaaaaaaacctctcaaaatacattgagttgtagcaggtcccattgtcttattactaaaactccaactaaaataacaaatagcacatgcaggtgcaaacaacactaacgctgatgaaggtgatgtgcctctagcttatgaggctcgctgcttatcaacgattcatcgttccccaagacgtgtacgcactttaaaaaatggacaaaacttcagttgattatagaacaataattttaacagtgcagacttttctgtaaacaaaagccagaattatatcacacatcatcttgaatgcagtgtccattatggaccacatttgagtgcaaggcctgcaatattgaatgatttttcgattttgcacgtgtgagtgagacaaaagtgcatgcaagtaaattaaggatactaatattcctttcaatttatatatgccctatttttttaatatatatatatatatatatatatatatatatatatatcactatatacatgcgttattattgctttatgctatatttttttggccctgctaattaagtaacctaaatgagtgtaactattgcatatgaaccaaatgaaggaaagactcatatgatctaaacctgagacaaataacaatcaaatgcggccaaatacctaaacttcagacacacattgccgtcggacatataaataaatatatagattatttttgagaaaaaaaaataatcaaaaactctaaaacttcttcaactttgaaataattaattaagctgataaaaatacgcttgaaacccaactgggtgcagtaagctgcaatttcacttgattaaattttaacaaaccgaaacaagtatggttatagtgaggctacaatttgaaaaatgccctacttcacattcacatcaaattaattataactaaataaataaaaaacatcgtgattcaagccctaaaagtcgaaatcagatagaatacacgtttaacgtcaattgaattttttaaaatgggtatatacaagtttaatttatatataatgaaaaatcattttgtgttagcacaaaacttacagaaagagataaattttaaataaagaaagagaattatatccaattttataatccaaaataatcaaaagatatctggctagactggctttggaactgtgcctgctgcataatgaaaattcatatcaaaataatacgaaagttctagtttaaaaataaaaaaagttgggaactgtcactccactcctgcatgtttgtaagccaaatcataagagtgttattatttagacattcctctactctagacaccccatttatatttttatttttcttcatatttattttctatcacattatattacttattatacttatattttttctcttttaattttctcttttctctcactaagcatttgggtgtccaaattaaatatatttttccaaatcacaattcaattacgtatcagaaattaatttaaaccaaatacataactacgtgggaacttcttcagtcattactagctagctcactaatcactatatatacgagatggtacaagtgaagtgaccatatcttaatttcaagccataaaaactttccaccaagttatgggtttccttgtgctggttcttttctccctcttaggtctctcttctagttccagcatatctcatcgttccatattggaccttgacctagctaagttcaccacacagaaacaggtgtcttcactgttccaactatggaagagtgcacacggacgggtctaccataaccaagaagaagaggcaacgagacttgagattttcaagaataacttgaactatatcagggacgtgaatgcaaacagaaaatcaccccactctcatcgtttggggttgaacaagtttgctgacatcactcctcaagagttcagcaaaaagtacttgcaagctcccaaggatgtgccacgacacatcaacatggccaacaaggaattgaagaaagaacaactttcttgtgaggatgcacctgaatactgggattggagcaaaaagggtgtcatcactgatgtcaagtaccaaggctcgtgtggtatgtgcatgaaaccattgtttttagtacgtaattactaatactaattattaacactaatatttttttctctctttgaaaatgacttgtggagtgtgaaaccattttgatagggagtgggtgggcattttctgccacgggagccattgaagcagcacatgcaatagcaacaggagaccttgttagcctttctgaacaagaactcgtagattgtgtggaagaaagcgaaggttgttacaatggatggcactatcaatctttcgaatgggttttagaacatggtgggattgccactgatgctgattatccttacagagctaaagagggtagatgcaaagccaataaggtctgtgaatacctaactgaatatgcatgcatgcaattccttttaattaatttaacccttcatctctttgttttgtgcacttttctttttctttctgggagtagatacaagacaaggttacaattgacggatatgaaactctaataatgtcagatgagagtacagaatcagagacagagaaagccttcttatgcgccatccttgagcaaccaattagtgtctccatagatgcaaaagattttcatctctacactggggtaagtaatatatattctgtgttgtcttaagtcagacaaaaaaaaactcataaattaataaaaaataataataattttgtaaaattaactttattaaataaatgaaaaaataatattagtattatattaaaaattaaagtgatatttatgagaaatattaataaaaataattaaaattatattgaaaagttaaatataatacttatgggacaaatatttttcctcaaatgtcacaggttctagaacaaagctactaattactagcagtaatatatacaatatcttactatttgggaaaatattatatcattattatactattattgttattgatttgtacagggaatttatgatggaggaaactgtacaagtccgtatgggattaatcactttgttttacttgtgggatatggttcagctgatggtgtagattactggatagcgaaaaattcatggggggaagattggggaaaagatggttacatttggatccaaagaaacacgggtaatttattaggagtgtgtgggatgaattatttcgcttcatacccaactaaggagaaatcagaaacaccagaaacactagtgtctgctggcgttaacaaagctcatagaagagtggatcactctcctctttgagccgttaaggttcaatcaacgagtgcttgttttcttagagacaagcatcggacgtatgtatgatatgattctgtgtgaccatagtcttccacgttgtactaatgtgaaaggcaaaaataaaacacagaacaagtttttcttcaaataatgtgaaggtagaaaatggaaccatgcctctgttgcatgtgatttaaaatattcgcagatggttttttctttgcttcaagcgttttcttcaacatgcatgcttcatcattgtatttttctttatagtagtgtgtatatatatatagcgcattgaattaactaaaaaaacatagttcaaggagtattttaatttgtatataaccaagtcaaataaaaaagaaaaatagaaacaagttacaggatctaaaaagcaatcagaaaaataaatatatattgatcactggaataaatttttgtttcacacaatttaaatagacttatggcttaccaaaaaagatgaccaacataagataaattttctcttctcaaaagtgaattaaaatagatgtatagataagagatgttaattattaggtaaatgcctgtataatcaatacaaacatacatttcatgccaaatttgatttgtcattggccaagataaagcgatgatcgactatctccgttccacaaatagcataacgtacaaaatatactctgcacctaaaaggctaaaacaatacttatctttcttacataagttaacacaggttacaacctaccaaacaaagatcaatttgatgctaagaaaatgtagaaacatatcacattctttaaaagaacgatgctgttagaaagattatattttttcatagaatgtttttgttcatgtatttatttgtgcgatgcttatgccaacagtaaaaatgacaacataaaattctccgtttacattggcgtaaataaataaaaaaaatgcactatgctttggttggttgacattaaagtgaatggaaataaaataaatgcaaagaaggaaaatgacatacaaattttggattgtatgttgataaaattgattttgaataaaattaattttaattaaaattaactttgaaatgatgtgatttatatctaaatattttataaaatcaaattatgagtaaaatttagtataaaattttggattcaatgcaaatgttatttaaaattatttcaatcctaaatcaattttgacctcataattaatttttaattcttctttagcgtgaaattaaatatatgaaaatgtatttaaattcaattaatctttttcaacttcaaaccaaagatgctctctctgatactgaaaaggaaacaatggggaacgggaaaaaatggaacttaaaaaaaaaaagtaatttgagagagaaaatgaaggagaaagaagttttcattaaaacaaaaaattcatcatcatattaaaaatgatataaatgttatttaataagaagttttcttattactttcgtttatttatgatcaaacaatagaaaaaatattttttctcttttttctttaaaaaaacaaaacttttctttaatataacaataatgcaatatagaaaattcatcctttttgttctcatttgcacttttattttatttttttattttgttgtttttttttatcattttttgatttatttgtttcttttggtaactataattaaaacatttggttttccagtgtaatctctcgcttttttttttaaggatatattttgtagaaattgaactcatatcttcttccataaactcaatatatcttgtcaattgaactacatccaatggttgaagaataatctatttaactaagtgattaagaacattgctttcatacggcggaagtcattagtttaaattcaatagtagataaagtataattagaacttattagacaccatttactctagtatctaataagtttaacacgattaaaatgaatttaaaaaacaaattatcttgctgaatagaattcattcaaaagaaacacgtggcccgttataaaaaaaatccaaactgaaataattatcttaaagcccaaacccgatcaatgggataaattaaaatccagtccatcaataacaaacacaaaagttggacccaaaaagaaaatcataggaatgagataacgcaaaagtccaaaagaaaaacatagttaataaaaaaaaaaggaataatttattctcgtcttcctttttcctttaatctcttcagcttattgtaaactcattgcaaacagagagcaacactgcaatttttttgcacaaaaaaattgcggtgtgtaaatgtgtactgctttttagttatcctggcacattgacataatggaggagactctttgtgacataggttagcagtttataatacctctggattctttgtttgcttgttttaacaaatttctgcaattcattcatcagtgtatgtagactagtatgaaccaaattatagcagcgttatattagactgtgaatattagttgtgaatttcaaggaatgttttttaatttcgtatgagagtagagtagatgtcaaattcaaaggttaatatgacaataaatttagtgactaatataaattaaaggacttgcaagttttcatatttaaccttaaactcttcaaaatagtctttgtatacatatatagactttaaactcttcaaagttatcgtagaagacttaatggacagattaacttaattgaatgacagactacactttgagagactatatattttgtttttcatttcattaatcgaagaattaatttatctacgtgatatacaagtctcctaagatataatatgttcactccaacactgattaaggaacagaattaagactccgtcatgtgctaagaatatttataatacctacaatgagactccaacacaagtcatgttagtccttatgttattatgttagaatagaatttccacactcaagttgataataacatttatcgtttttccttacatataagacgaagaaggttaccaactagataactactccattcaaccgtcactcaggatctccactaaggacgtggtgggtccttacattgtcgacctgtctcagctcctaaaccgtacagtataagactataagtataacatttttttaacaaaaaaaaaaaaaaaaagaatgcgagtgccgcgtgggggaatagaactcgtctcaactcatgaaggaaaatgttaatctcttaagtcagtcttatcgcataataaaacgaagttaacttggcatccaaatttggatgatcagagcaaatagaatatcaaagcccagctttggaccctccctcagtgcctcacatgatgcccactaacatctacatcagaacttatttaaagagcgggccacattatggatgtgacataactcaaattaacaggtaattaaatacttttaactgcatctcttcttttggcaaattctcgcaaggcttggctaatggctattaattaaaaagttccataacgcaacaagacatgcatatactaaatcatatcatcaatcacctctaaacttcctagctttccctaatagattaggacaaatcactttcttggatgtcattatcttatgaatttaacttcttttttttttttttttttacttaaagcctctttgaagtttgagctaccattctttacataacaaggaataaaacatacaccatccaatgtcaatttggcgacattcatgacaaaaataacgtgtttgtgagtttgtctgtgtcattcagtttcagttgagtctatttaaaagaaaactatgatatttgaagttgaaatcttaacgcttataatttataaaatttgaacagttaggaaaggagagcaacatctcttgtcgtatagtagtctactagtatagatattaggtatctttctgaggtacacaggtggtactgccataattttgatttgagctgtgtcattaaattttgcatggatcccatatgagtcattatagagtgacaatctgtgtagacaatacctaataatcattatctcattacctatctaagaaagtgattactggtgaagcttcggcgccccaaagagagttttgcactactgtacagataatgtttatgccttaccatcattacctcatcaatatctatatggtaatggtactaatggacagaatagaaaagtaggtgtacttgactttaattcaatgtataatgtatgatagatggcaaaatggtgaaattccatgtatgaaaagaaagaaaacgaaacggataaaagcattttggaagggttgctcttggagatgtggctagtagacaaacacattggccatagtcaaagcacttcacaaacctaaaagccattacacttcactttccaatgaaaaccacaatccacatgctcttgcttggggatattgaacgatcacgaactctcctacctcctctacgctgtaccccatttcccagcgctcatactcccatttcactccaaaccaaaacacgttctctttctctcattgactgaccctacttcaccacccttctcaaccaaactttagcgttaaataattaataattaatattgttcattcaggggtctacaagtgtcaacttttttattgagacacgtatgtcttttcatgacacattcaaaaggggtcctaagtttttgattgctgagaagtcccatcgtttaatataccattggtatcccaatctttcagtcctcccaacctaatattattgaacttaataaagggaagagagtattaactcgaggtatgagggtagggtccccaaattatgtatcaaaagccaaactacagggtgttatacaattattcacgccatgaattttctcccaacctagcaccgaaaatattcctcccacctactcaaaagcagcaaaccaaaaaataacaaatttcaaaaataaggcgaaatcttatatatatatatatatatatatatatatatatataattcttatttattatattagaatatttttatttctgtgagtttattaaccatattcttatctaaaacataatctgcacatttattattttctattaatttttatttaaattatctttgtttaatcataaacattctcttctagtaggctataaagatacaaataaaattcatatctcatgccttcatgagtttgaattcatttgtcaataggagagtttcattataaatatagtttatagatatccttataagtatttttggaatcgtaaggtctagcctcactttggtgagacggcaagacttaattcaatgaaatttttataagcaccctaaatatgtatacacatattttttatttatttatacattcatttagtagtaaaaaaacatcatgattccaggggttaacaacttatatttttcctttaaaagatggatcattttgatgcgcaattcatttacacgaccgaatttcgcacctctctaattaaagattagcaaaaccagagaaaggagcaaagataatctcaagtctaaaagaaatagtcaaatccgtttcctcccccacagtatattatttactcctcctcgagacaccaattcaaaaaaagggagggaagaaaaagccatgagaaactgcataaggtgctgcatctcttgcatcctcccatgtggggctctcgacgtgatccgcatagtgcactccaatggcagagtagaagaaatcagtggcaccatcaaggccagtgatgttatgaaggcacaccccaaacatgtcctcaagaagccgtgctcctccgcagcggatgccgccgaaggcggcgtcggcggtggggtccccaagatcgtggtggtgccacccgacgcagagctccaacgtgggaagatttacttcctcatgccactccctccttctcctccacaagagaagaaccagcagaggaagaagaagaagaaggaacacagagagagaacaaggaacaacaccaacgtgtccatgactatgtctatgactagcttgcttgcctctgatcgctacttgaatgatatactctcagagaaggtgtcaacgcaaagagacagaagaagagggcgtgttgctgtgtggaggcctcacttggagagcatttctgagtcaccttctgatatgtaacaattcttcttcttcttccttcacaaatcacaacctttgcctaagggtcatgtcatgtccatatagtttatattataatcctcatattttaggcttccaaccccattttttcaaaatatatagagagaaaataaataattcctcttcttttttttttaatgttttactctgcttctgcaaaggttgctgtgtacatagggttgtccatataatatgaggtttgtaattaaccagttggagagtttaagttatattagaccataattgagtatgttttcatatgcatcaaggttttataaaacggtctgcaacacaacacgtcaaggttttatggtttctgtggtagtaaaattttctgtatcggctacatttatctgaaattttctgtaatattaaagatcgcaacaaaactgtaacggtaatttaaaaccttggtttttgatagcaattctttttttttttttttggagtttttatggtcgagctacaattagtggggcatgaaattgatcagacggtgttataaatttgtaattttctggaagaggtgaaacaagcgaagaagtttgtaatgggtttcaattttttttgcctttaattgttgaaactcggaatttagaatagtacacggtacaaagataagctatgattgagatgcagatagaacgatcctactactgtgtcactgtaatatgtgtaattctgtattggatcataatggaaggtgattgcgacatgatagatattatttatgcttttgccagcacttgagtttttttatttaccattatttctattgattcacttatgaaaatgacacagtagttcgtcagtgtcagtcatcctttaaggagagaaggtgacataatgctacaatcactttctatacagtactgagctgtgattataatagaattaattcaagttgataacttctcctccttttttctgaagtgggaaaaaagaagaaattcttttggacccccaaatgggggaggacagattcattcatcagtgtctaatctatgcagtgcaaagccatgttgaacttcaccccactacaaacaagtgagggggaaaaaaaagaagtaaagggaaaggtgaggttggatgaagaaaaggccaaagagataaatttgtggtaaaaagaattgaaagttcccacattgctttcccattatattctaataatgcattaatgttatgctaagtttgcataaatgagcgggatatggctttagtttaagcatcttattcttttgggtatggttatgattgggaaatggtttggttagtggcagtggcatcatgcaaaggtattaacacaatagagtttgacctttgggatttgcaggatggcgtgagccttgagcaaagctctattctagtttatttctggttctgattctccttttcttatccaagagcatttatgtttttttttttttttttttacttgaatgttccaccatcagtggccaataaaatgtagacaaagtagttagtgtgtagattacaaaagttatgtagagtagtaagttaatgtgcagattaataatataaactttcttagttattgttattatatagtactggaaaacggtgtgcgacaattaaatctttgatccactaaaagaatttttcatgtttgtctcatgaaacgtaagtgttatcattgtggatcgggtgaaaataagcattttcttgttccaaaccagagaatttattactagaattatttatctggcagttgtcgtgctttttcttatatagaaataaattgacatggaaacaactaaataatgacaatgctctgatccgttaggcttaattaagtttctagttttttaattttttttagattttaattttttgttattcaaaaaaaattatgtaatttttagtcttttattaattaactgtcagcatttttagttcttctaaatatttttgcttattttttagtttttttatttttattgttaaaaattatattttattttgtcaatttttaatccttaatttattttatatttgaaattacttttttaacagaaaaaagaacgagagattaaaaatggacgaaattttttaaagagattaaaaatgatgatgaaaaattaatgaggactgaaaaagttattaaaaatattctgaaagattaaaattataatataaaaatttaaattaaaggattaaaaattaatcaatcccgttaattacatagaatttgagatcgaagaagtggaagagaaaaaagtatctcaaaaaagctaacaatatgctgtactctttaatatatattcttctaatcaaaccttctatacagtacattataaaataacttatatttttaccttctgaaaaagctaacaaatatatatttgaaatatagttggaattttgttataaaaatataaaaaaaatttagtttcatcacttattatttattgtgttattttttctctgatgtagttttgaataaattctaaccattagaaataatgtgttattaccatccttcgaagtatttttatgctgttttattaggaagagaaatagagaaaataaaaaaacaaagcgtaagataaaaaagaaaaaaaaaaaaaaaaactcctttcgcaagaagataaaaaaatgtgagacccactcaaaaattaaaattttaaccttgtccattaatctctgccactacctcacaagatttacacatattaataataaaaatgtatttttataagaaaactctattttctttcgcttcacttttttatccaacaaaatatgtgagacaaaactaatgttttgtttctattttactacttactcattttatcctttctaaaaatctactcaagtaaaatataaaaattaatctataaattaatatattaaacttaatcattaaaaaatataatgttttacttttaaatttaatgaataaaaaatataatgttttgcttttaaataaactgtaattaaaattaagaaaagttgaaaaactactcacagtgaaggagtttgattaagaccttaaattcttaaattcagagtttatatgtgtttctatagccaaaggcaaagccacctcattgatacataaccaattgccccttcaagaaataatatatcatactttaaagctataaggtgagaaagacaagcgtatattgtgtgcttttttttattcttataaagagcgtatagtgtgtgctttaaaaactcagactataggacttcttttatgtcataatcaagataaagactaatttctaatcttgtcacacatcttgtgagtaatgaatgaaataaaacatgttcatagaacaatttccggtatcatgccactaataatctataaatcatttttttaataaatactcccaccaactaaggagatcgatcacaccatggagttttgtttcttcgtaactcaaactagttaagttaaacttgattttgctttacactatgcatccatggtcagatttaacagttgtactaaatttaatggtggtatgaactaaacacaaactaaaatcaaaatttattgtctcttacgcacaaaaaaaagatacatttacgaaaacgaagaaaatatgaaaatttagcagccatgatcccattaagatcaagataactaactacattcctaatttcattacgtagtaagtcaagtacaaattttatatctatttttctctacattaatttttatatcaagtcctactcattaaatgtcctatagaaagaaaataaacataaacctatcacgtaaaatttgaatatgaaaacatccatttttcaaataaatttcacatcacttcactatgtgtctttcttattccctcttttctccaatagctgggaagaatgcaggatacgggataacaaaagaagagctcttaaggatttggcaactttttcaaagagggcgaccactaagattgggtggattcttataattaaataatcaaaatgaaaagctgaaaaaatatttttttcctcctctcttttgtgctctttgtggtgcagaatgtaaggaatcgaaaaaatacagaaaaatgcaatcatagatgcaagcggcgcctcacttttgcatcgataattattaagattgaacctaaaaggtctctgtctcattcaataatatatattgtgtacaccaataatatattttttaatcacccctataaaaaagaatacttttaatggataatcagatattaatttctttcgaggggtaaaaatcagttaaatgaattttatctttctcaattaaaatatttttaatttttttttacaaaacttaaatcatgaaatttcattcataataaattggaagataaaatatgttgataaactttgagtctaacatgaattgtggccacgtacttttacaagtggcctttaatgttcgcttgcctcctatcaaactgaatcctatagtttgggttttgtgcaaatttttacattgaagaataatgtatcctaacgcacaagcattttggtcaaaattgttaattttatctacaattaatttgtaatcagattaaaaatgaggagttaatcctagatcagccatccaagtaatagtcttcaggagtcccaacactttacatggttaggaatcaaattcttaataatatgttcaaaaacttagttatctgtggactgtacatagcgttgttgatgaattaatgtgtatctcataatatttaatatgaaatttatataactttgatgatttatgattgaatttaaaacattttcattgtgtaatgattaaaatatttttttattaaaggtgtttaaaaccaaattaaacaatttttaattattataaaacgaaccaaaataatcaaaatcaatcaaatccgaaattagagttgtcccaagttcttgttagtaatgatgaggcttatggaattggcttgaggtgtcggtgttggaacaaaacataatcaacatagaggaagagagcaatttgatagtatgaaaaacaaattggaagacacgaacgttccaggttttacatggggattgacgtgatttaaaggtaggacgacgtccaattcaggtgataacctgcctagaaaatttaatttatatgtcaaaagatctaattggagggataggatagggaacagggagtgatgacagatgattttttttatgcagactttcgaagtatctacaatttatcttcttacttaaaaaagagatatagcttagtccggagaaatggtgaaggaaaaagagagaaacgagaggtagtagtttgaatcctttacattttttaataaaattaataaattaacatttgataaaaaaaaaatcttgtttctcaaaaaggttaagtttgtgttgttatggtagagtattatataaaggaagaattttcttggggtattatatatgaattcttgaatctattgaaatgcgcttagtactctaatatgaactctgacaaataattgaacccccaaagatgtaatggattttgcattttcatgtgtcttctatactaatcaagttaatatagtaatttgtagagtaaatccttcttttaacccttgatacaagtcaagttctatcagtctcgtgttattacactccccttccccaaaagttatataaatagatgtgaatcctccgcagttttaaatgaaccataccgtgtacagttgttattaacttccctcttcaaaagttttgaattatcatattcattaattttattaataattaatttcagtcaaaaactgatcgagatacggagggaatattgagtttgtgctaatattactctgaattggttccaaaacagggtgtagagaaggttggaaattgtcctggcatgataattggctaatattactctgaaacattccttgtctagattatttcaaatttcaaaagataaaaatgtgtatcttgtagatacgggagagtggtgaaaaaatgaaatgacttttgggcttgtaaattgaggtggaggagttttttggtctaggaaaaacatacactaattattaaaggtgtttatgtaattatgtccccattaaattcaatctccctatttaaggaaagggcagatgcatgggtctggaagttaggcagctcaaatgttttctaattaagttggatctgtgtacagattccttcggaattagtaatctctaattaccgattttgatattttctaaagtttctggaaatgccttgtccctcaaaaggttcttacctgctcatgccaacttctcttagatatattgccaataaaaaggggattatttagaagaaatattgtcattagtagtcatggaactaaatgatatgcattatgtaaccatctttttctgcttgagtacagctcgtttagtggtatcatttgcgagtggtacataatgaaattttatttattgatttggttattttgatttgcttagtgttcaggatatcattaaggttgcaacttggtatcattaatgaaattccatcgagtatttaactaactgaatatctagattttgaatttgagatcactcattaaggtttttattttttttattgattattgatttgaaagtacattctttaagtagagtaagaaaatcaattatattcattcaaaaaaaattaaaaaataaaaaacataggttcaacttgtaagaaattgacacaggtttcatttttacaaaatacattcttgagaaaaaagataaagaactaaaatatttaaaaaaattagcctcatatttaaccaaaaagataaaattctgtaaggatatattgaaatcctattagagaactaaactatttttgtatgtatcgatattactttaggggtggataaactatcttaagtctccgttaattattaggatccaaaattataatgattggtgttttctaggttgatttgagaaagaatttggaagacaactaaggaagaacgccctcataataatgaataaggcgtcaagtaaaaggatattcttgtcagatcagtcaatgtaaaaattgagaagatgtgttcttgtgaattgtgatcacaccatgacaaatgcaacccatctatgagtgttagagaactaattaataactatctactatattgtaaataacctaatatatatatatatatatatatatatatatatatggattactaatgcactcattgttttttagtacgagtacattagcaattaacatcaaattttatgacaaaaaattaatatttgacttgactttaggaaattatgtatctaacctaacaaatgccaacaattaaataattataatcctacacctgactttaggaaattaaaataaaaactaaataacattataaattatatcttaatattctatgaccactctatagaatttttaagacacttgactttcttctttttttatttgtctctctagaaccatcttatcagagaactaaggcaccctaagtatatatgtacgtatctaaaagaaacaacaataagattacaggagcaaataagaatatcttaagcagaaatttacttagttgaggctaaatgttctttatatatttatgtctttttgtttatacatgaacctagctaaaatctcactcacaaaattctcttcaaagacaccagggaaatgctgaaagagtgagaggaattctcagcaaagcccaaaatgataactggttgttcgagctacaatgtgtacaatagctggtttagcctgaatttaacgaaacattcgcttaattttaaaatttatcctaaaattgataaaactatttaaaaaaatgagttaagaggtaataatttccgcataatctaattatagctcattattgggcatttgggctagtctaatggtaacaatccatactataagcccataaactataagccaaataacaggctaatcatatcaattatcaataatattccccaacggggtgaggaacaaatttttaagactgattcaattatgctaacaagctaaacaccaaattttgggtgttcccactgcttgtcagatcatgtttgaatccattgtggctaagcaataaagccaagatggctcaggcaaagcaatggttgaaaagaaagataatgggaaatttgatacagttccatatggtaaagctctaagaagacaaccatacccggctactacttcagcctatgtgggtcgacttaaggatctcaaatttcggcacaattatgtaggtactgaccaatccataagctaacataattggagttttttttttttttttctttatgtacttctggcttccggaatgaccataattggatcgtatggggttggtagtgtggctagacctatttagcctaagaagtgaccaaaagctattggacatagtgtttgccaacttctcaagagaatcaggtccagacaaaattccaaagcatattggtgacagtgtgggccttttattcgattatgaaagtgaattcacaagaaccagtaaactatgtgtgatagaggttgaggcaagataagcgagtgtgcttattaattatatttatgttatatggtatgatgttttggggtgttggtggctatgttacccaatcaactgcacttaaggagcaaaacattttcctgatggaagatcaaacgcaatgatttgtgttatagggagattccaacccgtgtcctgataactaccacttgagctactttgcagggacaaattgcttaaaaagttttgaattttacctttcgatctaagactatccattaatcaacatggtaataacacgaaaacaactttattagttcgctatatatttttattttattcgaagcatggaatggttaggtgctatggtacatatatcccttccataattggatgaatcctaaaattcggtaccttaattgtacgttctaataaaaaaaaaaaaaaaacactttctttttgagttttgagcctattgcctattgcctattgcccattgtgtttagaatgatctgatgatcccaagcgatgaaaatgtatgagagcttttgggaattaatgctacatggcctcttggaccattcatgtcagataatactctgccaattgctaattatgtgggttggaccactcggtataacgggcctaccaaaatgtgacagaaaacttatccaaacctttgcaaaatacagacatatttgcaagcgcatcaaacaaacccagatcctccaccctggcaccagttttcagactcttgaccacggccatcactagctactagtactagtgtatttggataacatgtaattcattctatcctacaaaatcatagtaatagtaatatcaataaaaaataaaagtaactatttattattttattttcactatcaaaaatcaagtaattttttcctccataaatttattccaaacatattatctctcgacttgtatttcagcgtcttctgtggcagtcacgtctgttgtttggtttgaatcgtatttcaagcagtcttttttttttatcttaatttagatgtttcttttcaaaggaaaaatatgcatcacacgtttaacatgtctgaaacaatgtaactgtttttttaaagtcaagtgaaatttaatgataataaaacttagaaaaaaacacagggtatataagtaatatatgaactgaaaatataagattgacttaacaataaaagatgaggaaaaagaaattgtgaatttcaaatattcagttaacaaaaattaacaaattaataattactaacattttatttataacatgagcattgaaagcatgctaccacacaattatacccttcccccacatgtaaatctaaaaaaccgaacaccccataaaattataatgactttcgtctccaaaaccaaacactttgcctaaaacaactgtatagaagcacagctacaaggaatcaaacatttaactaggaacaggcttgaaattatccaattcatcccatatatataagaattctaattcactgaaatactcagtgacatttagtgtatcttgatgcatataggatagatgttctctagcagatcaaagattttgagaatgtcccctttgcaaattcgatctatccatagatggattgcaacatcaagtcctaaatcaaacaatgaatccatgcaagaaccatcacatcttactaccatagtccaaactgcatggatcgaatttgacatcaatgaaagtatggaacaggaatactaccatagtccatagacattcttcaatttgttcttgtggccaaaagagccagttttattgttctatcccatgaatgatagtttctaccatttaatggagaaaaaacaagcacttgagatggactttcacttgcatggaagaaaagagggtttgatggattggtgagaaaattagaataactcttatttgccataattttagaggagatagtaacagaaaacgatggaaagaatcacaatgagaagaatatagattcatgcattaaatgtgacatcctgcacatgaaccagaaccataaactgagctataactgggcatgtatttagtttgtgatggtggtgtgaccgttcatgttgaaatatgaaaggacatggtatctaaaagtttgatgagtattctatttattgtatataattagtttatcatgttaactaattaatatctcaaccaaaaattgaagaataagtctaagtcgtaagagatttatcttgcatcgcttttcttcccgataatattggatataacttgtaacattaattaattaattatagaacttgttatttgcttcatccgctaatttcgtctattcttatatgtacatcaacttaaagaaaacttacataaaaaaaaaaaatcaacttaaagaaattttaattgtgaaacacctaagaaattttgaaataactcgatttactgtgctcttgaaagaatgaattccagtgtctcccgttggtaacgtactgggcaatcgatgatggagggtttgatggaaacgaatgaaaagaatttggaggaataagttaattagcagaaaatcctctttcctttgtgttaatttgaatctaccatatcttggaagctaaccaaactctttaaataaatggtttgtgatgtaactcttagtagctgattaattttatcaagacataattagaaatttatatatctttcgaaacctccatacatattgatttatttcattgcatgaatgatctgtgtagctttagtaatataaatatagagaaatggtgagcacaggtaccatgatcccatcacctgattgcccttatctgtatttgcgggatgtgtacgtagctcacgtggatatcatgtgaaactgttatctctgtctgccccttttatttaatctttcatttattaaaaaaaaaaaattggaacttttaagagacttgacttcaaatcctatttgaagacacaaactaacaaacaaaatcaagaaatgaaatgtctcaccttcttttactaatgatacgttatatgatttcttgatacaatgatacctacgtacggataatacaaacaagttattttcaacatttataaaattctattgcaaagggatttccaaagtttgtgagcgtggttgaagagatattatacttataactttaggtgttcttgaaatttttttactaatgataattgagattaaaaaacatgtttacatcaatataatatactactcatgaaagtataaattgagtagatttgatagatttaccgtttttcttttaattttttctacccgtgttaagtgagagttaagcataccttttttttcactgaagagttaagcacaagtaagtatttacaccttgacttattttaatattggcatatgaaaaaggaaccaagtaactaacccattgaactggccgtatgaattaataaatatcattcttgtttgggatacgtataccctgtaaagaaatgggacagcacaatcatcttactttctatgtaccatattttaacgaaagtaaacaacaaattaatgacacataaaataaaaggccgcaaagaaaagataaagaagaaagaccaggaagaaaaggaatggaaaattgaagtcatccaactatttaattcattcatacatagagaaaggagtagttcattttggatgaatatataattaattgcaatgagcagttaattatggccaaagatgcctaaatacatgttaacaccttgctttacttatctagcctgccacgcattattatactatatttgctttcacaatccaataacttgaatcatttaatttatatacgataaattaacaaagtaattaaaatataagttcaattctatccttttgaatattgtgaaacctatacaaattgaaggactaattatgggcactgcctgtcttcattgattactgtgacgcaacagcgtgaattttccactacgcagctaattaatggcagcattggatttggcaagcagagagccgttgtggcactttgttggaattatagtactactttataatagttgttggctcatatacaaatcatagttatttatacacaaaatacaagccatagttcaccacaacatgagtatcaccattttaaatttgtttcaaatgctcatgttcgaaataaatattcgatactgaatgaaaatatgatttattcttctttttcttgtcgtattcatgtattttttttttcatttttgtatttaaatgatgaaattgattcaaataaatcatcaatgtgaattttttattttatgttttcatccattcatatgaatttaatagctcatgataaatataagtatgctattattattattattattattatatcatttaaagattttatacttggattgagaatataatcataagttaatagtcttttcaaattttctaatatatttttattttttatatatttttctataattatatctgtttttaattttttaaaagtaattaatgttatttttacctctaaaatgagggtaaaattgaataagattatattaaaattttaaaataacgcaaataaatagaaatatttttaaaagaagtgagagtttaaaaaacattaaaaatagaattcaattatatgtaaaaataaatattggctaccagaatagttattgtttaatttattaaaggtgtttttttttattatgtatcaatgatgaaaaaaaagttaaaaaataattgtttgatgtaaatatttattatatttaaactttaaaagctatatgatattatttaaatgacttaattcaataaaaatatatttaatgttggtacaacatgtatagcacgcaatataaaaaaaaaaatgtatttaaataaatggtgagtttctactttctacttaccgattagggattatgcgtgattgtgtgtattggtggaaacaaggattcgaaaacacaaattaagaatatgtaggtctctcaaagatttcagagtgttactgtgttactataatgactcgggaataatagtagtataatgatcaatttggtagtactattataattagattcaaacgaatcaaatgacatttgttttgggtgaagtgaaagccaataaagattctagatgactgttccaagtcaaatctttcaccaaacgtttagatttatttgtcaactcttacggactcaacgaaagagactgttgatcatattttattcctcaagaatttggtgaaaatgccctaagttgttgtttttgttagcactgctgttaactgctccatgaatcgtgcattttttagaatgcatatgtttgactataatgtcgaattaaagcctcacaaaaaacttgcttatcatgattatgttattttttgttatccattttccacttagatagcccatatatcaagatctctttttttttttttttgctatatcaagtaatacatttacaattacatttaattactggatcgataaatttttaaaagacgtggattacaattcatccattggctaatatagcttaacaactccaaaaaagaaaggaaaaaacttcccttatctacatttatgatgtatggcaaaggacatatgaatttgtttgccccttactcttattaatgacaaatctctttctatcactttccttttcccgtttcctttactttattttctttgacaaaaataccatctttgtacttagatttatgtagcccttgccatgccattactccctctctctctccttattagtatctaattaattaccatgcaagaaaagattacagagtgtaacatgcagtcgccattactgagcagctcaagtaaatgacttcaactgctttcttataattcatttatgaatggctatctaggtacgtactactactacccttgaaaaatccatcaatttctcaatataagaattccatacaacattttcaatatcttttaattaattaatattctagattctagctatacacatcccattacataaaaacaaatttggatcttagcattaaatccttgaactaattaagactatggtgctatacatatcccaccacataaaacacattgtagatcttagcattaaatccctgaaattgaaacatcagaagccattccatccgtaattgtcacccgaagcaccgtatttttgcgatcataaacatcaccatctcgcattatccacttcacatacggataattctactacttcgccattctcaatttttgtttcattttatttttttcctttcataagttgaccccaataggatttcagaaacaaaattgaacatgttccgattcatgtctagagttagggtccctttgcgttttaccattttgaccaaacctcaaaaagtttgtggtacccacgtcgaaggttcggagccatagaaagaaagccacggtttggtcacacctcacagacccaaaccagtcattttatcacacaacattttccggacacgtaaggcattaaagaaaagacagagggtatttttggtattttaaatttccagccaatgttttctcagactatcgtttcggttcaagaatggcttgcagggttggcaatgtccttcttctcccttacctcaccgatccgtacacttaacctgctttctcactcttcgtcgcttctctttggcagttaagctgcttcaatccacacacccacctaatttctctctctaaaactaaaatctcccccccgcaaaaaaacaaaaaatccatttttttgttgttgttgttgatatctctttcttaattcgttcatttaatgcttctcgtcctacacgcacattcattggtttcagcagaagagttaacagctagaagggggtaaataaaagaggaaaaaaaaaagagaagagaactttgttttgggttttcactgtttgagtgagaggaaaatgcctctggtgaggttgcaggtgaggaatgagttcggtttggggcagcctgagttgtacagggagacaaacaaagaggaccctaaagctgtgttggatggtgtggctgtggctggtcttgttgggatcttgaggcaacttggtgatcttgccgagtatgttttctttgacatcatcatcatcatcttcttcttcttcttcttcttcttcttcttcttcttttttccatttgggtttgtttaaataggtgcaatttgcaatttttatacttatgggagttcttttggaaatgggcttggttaatttctgtagtttcgaggctctaatggggttgaaggttgggggttgctgagaatgttggttttagttgtaaccaaatatggctgagtttgttgtttagagagaatggtacttagccgttggaattgaggtctgttttttatttttcggattttgggccaagtttcaattgataaggagacaaaatgctctttgacttttgtttttggttgagctttgtgtagactcgtataagttgtgtacagctcgaccttggttgctatttggataatcactctaaatcattttctctctaagagtttgggtggttcacgaggtgcaatagtttcgaggaatggatttgtctaaaaatgctttcttgttctaactttgtgtgctgactcctgatttttcttctagaggttttctcttttaacttaactaatacttccatgtcatgctccagctaaacagctgtaaatatagtccgaagtagaaggaatacgactaacctgaatgccattgtggattttttctagttttcggatcgtcattactgatatatgccaccttcctcccgtctttcttactccttattttgatctgagttactattcaaaaacttatattttgatttaagttacaatgaaattgggctatggttgcggaagagttaaaattttaagttcttgtacttgtagagctttgttgttggtgttgttgttgttgttgttgttgttgttgttgttgtatttatagagcttgttggcaaggttggaactccaagcaatttgattatatattttgattttgatagagtagaacaaatgtgggatcttgtgtgttctttcttcaaaaccttatccttgctgaaccccatttggacaagttgttcttttgtgagaattagcgcttaaatagctagtaattattgttagttttgctagatgtaaagccttacttatggtgtgtgtttgttgttttggaaatatcccatattatgtttgcatatttcttaaaataaatcatgaaaattttaatgttaaaataaataatgatttcttgtattggattcaatttaatctctccaatgtccactgtgtactttcaacctattctgctatctgtttgtgtgtttggtatgtgtgctctgttatctaggctaaatataattacacagttactgataattgtgacatttactctatgattgttgaaaccttgtttaatatttgtgtggtgaaggcaatttaatccaagtagttctagttttcctgttatttgtgttgatattcatgaatgatgaaacttttttgaaattgtagttttgcagcagaggtttttcatggtctgcaagagcaagtaatgacaacagcttccaggagtcatagattgatggttcaggttcaaaacattgaagcttcactacctgccttggagaaggctgtattggcacaaacaagtcacatacatttagcttacacagctggtatggttcttttaggcaattatctcattctatgtgtggacttattggaaatattaattttttttttcagaatatgttaatttcatctctgaatgttattgcctcagaaagatggagttattgtatttttcttaatgagggtttatctttaccaaattttatttgaagggaattttgaaaaccacatagaatttctccaaaattatataaagggcggcctaatggggtcaggaggctatttctaagatttgaacatgtgccctgccaaaatatatcttcaaataatatttgtaccaaaaaaaagtgttatttttaaattaattcatcctgagtaatgtcacagaatgcaaatcattaccgttttacaagttgtgacataaacatatttatgccccgagtgaatcaaatacagtagcttttgagaagttattcccatgttaaatatatgattatatcacaaacttcttaaacttgtttctttgagtagaatcttgatataccaatcatcactaaacattaattgacacactagaatttgtatcaatgaagtaatgtgaagggctctcatttgtttgtctagtattgtgctgatcaggcagctaaatcatattgaagttaggttgttttcaatgaattttctttctatttcttttcattgttcatgatatccactttaatctgcttttgctctctcttttgcatttgttaaacggaaattgctctgagaaatctcatttgtctttgggtgtgccatagttaatatatagatagatctttgttagcatgcaagctattatgttgttattagacctctaaaacttttaggaaactggaagtactgtggttggttcagtattcatgtcttcaatatgttcaacgagtcaaggtattgtgatgaaataggggctgatatggtcatgatttactgtaaatatgatgaagattatatatcaaatcttgtgtgtacattgtgatttgtttgacatggaagctgatgtgtgaaagacactaaaaagcaaactcataatatatataattttgacagtaatgtttatctcagattacattcaacctgattgcagtcaagtggcattaagctagatttatgcactttttagatagcatatatctgtatattttacttcattttgcaatactacattatttaatgatcatgatttcaatgttcaaagattataggagttcttaatgaaaagcagtttcctttcaggttgtgaatggcatccacacatgaaagctgctcgaaatcatttcatttacaatgacttgcctcactttattatggattcatatgaagaatgccgtgatcctccacgtgtacacttgcttgataagtatgttaaatttccttccctgttttgtctttctgtttgagattagcaagattagttaggtactacttcttagactaatttccaaggtctagatgataaaaaggtacagtctagttcaaatttggactggtagccctggatcttgtacctgtcctatttggcatctctctctggtttggaaagagttgaatacagtcaactagtcctgcttaaatcaagtgtcctgtactggttaatgaaatattccatgtgtccatcagatttgatactggtggcctaggatcttgtttcaggagatattcagatccgaccttctttaaaagagtatctgcagattcagacgaatcttactctggaaaaactgaaaaagcaaggaaatctcataaaagcaaggtacaataatgatcctagcatttcaaggggaagattatttttaaccctgtttctttcctgtcatatgcatgcattgatttttttgcaaacaatttcttgatgcttacacaaaaaatgttggacagaagaaaagatcacgaaggaatggagacattttaaggggtgaacagaggcatagcactagtggaaggtattacatctatatatgtctatttaatcttggcgtatgttgttcattcaaaatcaacacttacatattatattgactacccagaatgcaatctatttcttctgctatcaatgggcaaacttcttcctcacaaacagcttccaccatagatatgacaatgaaatcagatctggaacattattcaaattcttttgattcaaaatctggtgctggctacattgaatgtgttttccatccaagtaattctatgcaatctgatgagccagattataaagaaccatcatctacaagattgaaacagaaagctgatactctgtcatcagtatctcatcataccgatgatactctgtcatcagtatctcatcatatagatgatagtatttcacatgattcgttggaaaagcaagttgcctctagttcatttggtgttacttgggatgaaaaggaagagatagtggaatctaagagtcaaacatgtgatagaaataaaactccagagaggcttgtggaaaagcatgactcaaatatgcatgtgaatgaggttgttaccataaccaacatcgactacaatcatgtcctatttactgaagcaaacaacctgaaaccagtccgcaatagggttcaaactgatgatattgatagtgaacctgataattatgtggatgctctcaacaccattgaatcagaatctgaaaatgatattgattatataacaaaacgagaggtgcagcagttatcttcacgtatcacttgtggaatgattgaaaatggagttactgaagctcctcctaatttaatggacaataatttatctgatgtcgtttcccagactgattatactattcccttaaatgaagaacaagggcatttagccgactcactgcaagaaaatcctgttcttgatcttttatcaaagccaaatgcatctaatttgggatatgtaagtccatctgatgatcttgatagagaaaatatgaccagagacactgcttccttaaacaaagaacaattcagggatttgcctgactctctgcaggatattcctcctctcacatcagagcctcgtgcatctaatttgggacctgtaagtccatcagatgttccttatagtgaagaaatgaccagagacaccatttgcttcaataaagaaatgttcgggaatttgcctgactcattggaaaaaatttctcctctacatcagagccacatgcatctaatttgggacttgggagtccatcagatgttccttatggtgaagaaatgaccagagatactgtttgcttcaacaaagaaacatttgggaatttgcccgacttgcaagaaattcctcctctcacagtagagccacatacatcaaatttgggacctgtgaatccatcaaattctccttattgtgaagaaatgaccacagataccgtttccttaaacaaagaaatgtttgcgaatttgcccaactcattgcaagaaactcctgctctaacattagagccgcatgcatctaatttggcatctgtgagtccatcagatatttctgttagcaaagaaatagccaagaatatagctgattctcatccctccaagactcctgccggtgtgcaggttcctcacacaagtgaaaattctgttttggataactcagtatgcactgatacctacattggttcttctactgttaatgatacagtgtcagcaccaattgagactgatatatcattttctggttccaaaaactctaatttaccagatgaggaagcaggtaagatcaacaacagtatctgcaaatctgaagagactcgtagagagtctttggctgatcattcagttaggttctggactaatggtggattattaggactcgagccatcaaaacctcctgactttaacaagtcaacttctttaggtcaagggcctttgatcacaaaaagtgaaacagatggtggttcacatcataattcaatgcaaaagagcaatggttataaagaggaacagggatcatcagaagaggttgctgagcagattctaaaggaaccaaattctagattctcaacatcaggccataatgatgaccaagcttgtgtctctgaaaaggccactggtaattctcagcacagtaatggatttggtcagactgagagggacagtttaggggaaatcagggtaattgcacctggaagtattctcccatcgacccctgacacgaaggacagtactgaacccaaccagggaaatggtgaaaactcatcgcgtgtgtttggacttagtcatagattactaataaatagctttcagcggaaagtttcttttgatgaaaaatctgaacattataattctctgaaatctgttatattggaccagagtggacaaaatggcattgtaggacaatcacttcctgagacaacaacctccaaagagaaagttggttctggatatcctataaagtcacttcctccttcacctccacttgaacatatgaaaatatccttccatcctgtcagtggactagagacctccaaattaaaactgagatttcctgatggcagtaatcatcatgaaagcgtaaaggatatgtttccttctttccagctggtccctgaagcttcccttcctctggatggttcagtttcccactctgatgatgatgacactttctgtagatcatctccatacatatcagatgatggtcgaagccctcactctgactataattctgatcagtgggaatctgatgaggatccagaaagcagtgaccaaggggtacatgattctccttgcagaaggtcatcaactgaatctgtgtccaatgatgataccaatgtaaaaggtggacatggtacatgtactatgaatggtgtggaacattctctgtccaggcctttacttgattttccaagttacgataatgttaatcctgcacttgagaaagaaagtaaaaaacattccaaatgcaataatgctgttatgtcacatagtcatgcagagcctgcacaaccaccacctcctcctcctcctcttcctccaacgcaatggcgagtctcaaaatcacagttggatatgacaaatgggacacagtattgtatgtctgtagatgctgaacatattggtgatcacagtcttccagattctactatcctccagcagcctaggctcacccaggttgagcaaatacaaattaatcacaatgatcatgaatcttatgacaacattatagataaattgaaggacaaggtaacatttggtcttacctttctcttgaactttgtatttatgcagccatggtagatattagaatttaacaatgtattaatctcattgagcatttcctgcagctggatcagcagaagttgaagggtcagaaggaagcaaaccagttgagaatgggaaaggagacagatgaaagagaagatttcctatatcaaatcagaacaaaagtatgtagtcatgttataatctccactatttaaggttaactaaacattttggtcctccacagatataagtgtcatcaacttcgtatttcattataaattataaatacgtcaaatggtcattaaatacttagttattttttagatctaattagtcctctaaattacaaattgatgacaaaaatcaatccagaacatgttctagcaacattcaaataaatcatgttaattgtagtcaacttttgcattgacttgccatatatttattggttcaggcattcaacctgaggcccacagtaacaggaaagtcaaatgataccactggttccacagcaaacgtcaaagttacagcaattttggagaaggcaaatgcaatccgtcaggtattggtcactcttcttttgttatctattactcttttccccaactgtgtttatatctaattagcatccataatggagaacctttcaggttgttgcgagtgatgatggtgaagatgatgataactggagtgatacatgacatgtttttcttttttaaaaaaaaaattatttcatacacgagcagtcctttatgttttttagcctcttgaagtgaagttgcttgaggctttgttgtatgtacacgtgtgaataaatcttgtttatctgttattaagtgtagtgcagtttctttcattgtcgtatgatgaattaatgtcttcgttagtttttgcttttgaatatatgggctaggaaatcaggttgaccctatgtattgtgagatcacaaatccaggccattgtttgtaaaaagttcctgaaaaaaaaatcataattccgagtacttgacttgatttcaatttattatctccctctcaacggcaagataggtccatagttggatctcgacccttatatgagaatgtttatgcgggaaagtaggtaaaaacaattcttaggaaattatcaatttcttgaaaatatttttctttagatacataccaaacttaggaaataaaagtattttttttataccaaacgtcctctaatacgtggtaaatgtggtaaaaaaaacgatcttcaactaatctaaagagtgtaccaataaaacaaaatattcttcatatttaataagaaatatttttataaaataataaaaagagaatattcaatatgatatgaactttttttttaaatgtaataccatacttaataaatattatccatatttatctttttgatagtatgaagaacttatgcactagtaatataaaataatatttcatgattaatgtatcttcaagatatccacggaataaaaaatacttttaagtaaattacattgagactctccttaatttttgagattgcgtacaacccccttttttttttatgcttaaagcaaaattcctcttggttacaaaaataaaataacagaatcctttgtaaggtttacgatgtagtaatgttttatcaaacaaatatggagagctaatataagaggaaaaaaaaagaagagatatggagagaaatttgatgaaaccatatatatatatatatatatatatatatatatatatatatatataatttgttcaatacttttaaaaatgataaaataagaatgtatttgtttttcaggtttaatatagtaaaaatataatgtacttgaaacgaataataaatgatactgtaaaactattttatattctgcacataattaataaattttttagttttatttttatttggaagactggaaataagatgaacttttcactttattcttcatttattttcttcaactttattttctctctctctacaaaatgcaccctaaatgatggcaattgtttaacaggttacccccacaaattcctgtcctcagtgccattggtaaatcaaatcttaattctgagataagggttgaattgctgcacaagctgaatttcagaagtatatttatgtgaaggttgaagatcctcaacttgcatcaaagaatcaatcaggttgttcctcatgttccatcgcgtcgatttgtggcttctgcagcagcaccattgtgtccaaggggaagttggtgaatttttcttctattgctccctagtttaaatttaaatttcacataggttaagatttagttacagtattatagttgttaattttaataatattctctaattaaaattagagttttatttactatacttagacaatgaaagttgctttgaaaggtcagcatgaaatctaaattttgactaagaaaatacctaccatactgcacctcatatattcttgcttaggttttcctctttgatttcatttcaggaaggcaatttgctgcatcttctttctcgctagccttacggcacttgtcttatttattatcgatatcatttgtaataaataaatgatatttggcaaaacttgcacataatattagtgaatataatattttatagatagctgaactttttaatttcttgcataaaggaaaatggaaaagaaaaagtactaatgaatgagttcgatttttgtcactagattagatcaacatgcaacatccaacttttccccttaatcccttattataattagaaatctatgactatgatattttgctcggacataactttgcttttaaaattgatgaaatactaaatagatacgtactgattgactttaaaagaatcctcacgaaaaagtgtatccttcatcgataaagaaagcaaattgatgcttcctaatcttcattataaaacagagtaatgagttggaaatgggatcactttccaaattaacaatatgaaaaatcctttagtaaaaaaatggcacataaaagtatcatataaatgatgcgtactaaaagggaacctgacacaactaaattttatatgatggaaaaggagttggcaaggccacaaacggtgcgtctatttctttttcttttaaaaaaataacttttcatgataatttatttattttttaaaaaaatgattacttactttccactttataaaatattattaaaattatcttacgtgattttttctgttcaattttttttgcaatgataatattttttattaaaatttccttttaatcaacaaaagttgttgaaatataagtgtgaatatgaaattttacattaaataaaaataaaaaattaaaatataagatgaatactcacaaacttaaatagtaaggttttgaattggtgtgatgttcggttgcttgtaaaaagtatttttaaaataaaaatacattaaagttttccaaaaatctgttggaacatgaaaagttggcttttttgcgtgaaaagtgctaccaaatgccattaggagcatgccactttaagaacaatgtatctacggaaaagaaaaaagcacgaaatatatttaaaattgattcgtgagtcgttcgtgtagaatatatatccaatctcattctcagagccagatagtttcttcaatttaatttccttcctcgttatgaaactcttctttattcattataataacaaattaaaactctccaagcttcaaatactttctataacgaaccttaaattgtaatatacatgttaagacgtctagttcaactgctttttatctgttgatgatattgacattatatatttagaggttaacatatagtatagagtttaattttttttatattattaatgtaaaaaatattacataaacatcttgtccgttagtaaatgaaatcagtaaatcattgaaagattattattttcccctttagtcttgtgtaggataaatatgatgacattttcaatctttaaatgacttatttattaacaaaatcttaaaggaaataatatgttaatgatttaaacttttgagggattaattagataattaaaattttatgaaatattaatgttaggatggattaaagagtcaaattacaattttctctaaataagttaaacttttttttaaaaatgttatatatacgtactcaatctgacccgattaaggatttgttaaagttaggtcaaattaatcttaataaaattatttttgaaatattaaatatttgtaataaaattatttgaatcattaaatgtaattaagacatatacttaaattaatttcagtattaatcttttttattaaaacatgtgttagtgtaaaagaatccaatcgggcaatagtttacatttcttggtggctgtgggaggatagcaacacccaaacaatgacttatctaaacaaataaggaatcatgctctagactctagactctagaccattcattacttaattatccgttattatcagctagcaaacatccttattttccaaactttgagtgaattgcaagtttgcatatgtcaagacatttagtcgtctcaaagaaaatgaattaatatatgtacaatattcgtttgtttctctttctgaattttttctttaaagaaactaacaaggaatatatagagagatcatcccttttggctagtatatataatatctatgagctggcttacatttgaaattaaatagattataagtagaatttaaatacaagaaattactttctctctcattgtatataattctctttcttttattcacatcacttatcaaatagccaacagtactagtacttttccttcgtatctttctcgtgtatattataagatctattgcataaatcaatatattatactccattcgcttttacactttgtaagcgatctacctggattgggccagtgttgtgttgtaacttgtatgtatacattttagcacttcatgggcatgacgtagactcctgatgtgtacaaaaagctcatccatagctttttctaatttctactaccccaacccaaaccctttttagcttttcttctttttctcttttatttagtgtaatttggcaacgcactttatattctacctacgtttggcgtttatcatatggactttctgccaaagacccatggcatggtttatgattgtactaactattgtgcacttttagctttattcccctttgtatatataaaaagcaccttcacaatttttcctcctccaccccaacctaaaccttcttcactcagaataatattctctctttcctcctctctctaaaattaatggctcgggtacaaagtggccaagctagtgaagggattaagctgtttggaacaacgattacgttgtatggaagagaaagaaaagaagataaaaaaaatagtgaagatgggacagaggagataaagagacctgataagatcataccatgcccaagatgcaagagcatggaaaccaagttttgctacttcaataactacaacgttaatcagcccagacatttctgtaagggctgtcagagatactggacggctggtggggcccttcgcaacgtgccagtaggagccggcaggcgaagggtcaaaccgctgtgccatgaccctgttggatttatggacggtggattcagatccaccgtccaacaacagtttgaaccggaggagaggctgactttggatgaatggcatgttgccaccgtggctcatggtgatttccggcagctttttccatctaaaagacggaggatgagctcaggttgtcaacgtcaaccttgttaagccttcacttctttcattcctttctctctccccttttttcttgtattaacatatatctcccttttgaggttttttaagtaattcttcttaaaaacttaggtatcaattatcattttaaatatagttttgttgttgtttctcaataaaaaaaaataaaacacaaggtataacagataattgatcaaaatataacacttataatcattgttacacgtgttgtatatttaatttattgaaagaaaaaaaaaacaccatttatttatatttatgatattacatgcatctatgttttatccttctatttgctagtctcttctttttcacatatatattctcaaaaaacttgagtgaaataagtaatcctttaataatctcatctaattcacacatctatagggtatttcaaaagaaaaatatgttcccgtgtaccaagcatttgtttgatattttgcttattattaagcatggataggacattgtgtgtgtaattttttatttaaaaagagaaaattaaaaaaaaaaaaaaaacttctatgtgcatggaactccgaaatttcccaacttcatgacccaagtaaagtgataattaatgatccaattatttgattgcgttcctggaaaataagctagcttttttgtatagtcaatattttggcattacatatcccctctgtatattatacatataaaatgggccaaaatatcttatagaattgcttgttactgcagctcagcatgaaagtcaaagaaaatttgttatcatccacgaaatcacagaacatccgaatcagatagaaacaaaggaggcttgaaaaggcagtgacaatctaaagtttatctgattatgaagatgtgaatgctcgaaaaaagacagcaaatgaaccaatcatgttttacaattggagacgtgaacggttcagattatttctcacctacatatatatatatatatatatatatatatatatatatatatatatatatatatatatatatatatacatgctctagttcacacataatctatatagaattaattcaagtacattaaatcctttgctttgacgtgtgatccgcaaaagctacactaattgattgatgtaaacgtaaacgctgaagaaatggtcaatgagaaagaaagggaaaagtttataaaagtaaatacgaaaacttgagagcaaattgtacttttattaattatttattttctctctgctttgaaaattaggggatttatccgtcttttgttcacatcttggttctagaagccggctaaaacgtttaatctacggtatcaattattaagtataagaaaataatttgaagttaaaataaaataaagactccaatttcgtgttttataataataagtgggcagatttattgttttattataataatgatatgtaattaatcggataagttgtaattaacatcaattttgtgagagtagcctcgataatcagtaatttatattccacttgtttcgttaattaaattccttttgtctgaatattactagcatgttaaaccgtttgaaatagattacactatatgttagtaactataaataaaaacgaaatcagaatctaaggtgaacaacacccatcctatcagctaataaaagaggtgctaacaggggaggacgttgttgcaaatgaacataagagtgctgcacactggctccagtaaatgtaatatgccatgtatcttttttagggtaaactatcttttagttcttaatttttttaaaattttatttttttgtctcttaacctttttttttactttcaatttttttttcatccttatagtccttaacaatgactaaaagtaaggacaaatttattataatttttttgtgttaattttttttataagcaaaaatttattaatcctgaaaagcttaattgggaactagatgtactcaaattaagactccaaaacagtgttaaatagtgttattttaatcagaaaaagaaaccttgttattttaagttcactcaacataatataatagtaaaaaccagctcactctccctccctccttttattgtgccatcgcctttgatgggagacatagcatgcttcgatcgacttaacatggttagagttttctgcttttaagaaacagaaattaaagcatgatgataatcaaatcattaagccgaactttttgaaatacgtacggcagcctgttttcgctgtcgtccatgtttacatcagatttttgtagccttaatatcgacatttggtgtaatagtatccgtgtgtgataatttcattttcatttgaaaggatgtaacatgattaaaggaattgtgattctcagaaattcacaatgaatacccgtaattttttttttatcaggaaagtttcatataattataacgggtatactataaaggtcgaacttagtacggtgctttaataattaatacaaaacataagatttaaagaccactaagggatatataatggaatgttaattaataaggttttttttataatatcattattttcataattatattttatttagttaaattgttttgccaaagacattcttcacaacaaaaatttctcttttccataacataatgaaactatatgttttgatctcctacaaattttaaagaacgacttgataaattacgaaagtggtaaaactctccctttcaaaaaaaaaaaaaaaaaactggttatctccggaaatatcattgactgaagaatgagaagactaaaaataattggttctatcggtaatcttttcttttactttccaacttggaatggtctgaaagacactagaaggttgagaatacacacatgacatgtccaatacgatattaaacattggaccagtcatccaaaccccagctagcaacaaaaaagcccacgacgctaggaaagtcccccatatataaataagtacgtacattatgcatgcacatttaacaaaatggttattaatgaatggttagaatggattccaatgatgagttgaatgttagttgttgttgttcacttgaagaagtctaagctcgctctttcaccaagccattgttgttgctgatgctgattctcttcaccagcttaacctcctcttggtgaattgaagtgtgcatggatatgtatggttttcattttgctaaattgttaacaagaacttatatgcaacatgtaccttggcatgtactcgctgaccctggtgaggaactgggcgtgccatgtgtcgcagtaaactctgccctcaaatcccaatagagaagccgaaccaaagaaggacaaaaaacaaagggctgaggctatgacgaaggtagaattgcccattgttaaatcctaatattcttggttcggatggagttatttttattaagaggatgaggattgtgttcattatgcattgggggtgatgattgtaaataacttctattgtctaatcatcacatatatatattagggtgcttgatatttgaacatctttatattttaagcacttcatgattcataaggaccttttatctttttatttttctctttctatcacatcatatcatttatcatatttacatttttctctatcaaggtgtcaaaaagcatttgggtgtctaaatatcttataatttggcatttttagtttacgcaatgcctgtgttttcgttcctgtttttcgggtttacgtacagtatgtctgcagtattgtcgtgaatgtacccataaagattgaacgtgatattaagctccctttaaaaaataaataaaatttgaagttgggatagtttatttaatcacaatcatatcattgggtaaatagtaaaagtccagtcaaccattaagaaaataaagtcgtaaattcacacttctcttttgaaacaatgattcgcataattttaaataaaaattatctatgtaaactgataaaagaatgcaaggtagcatcctcttagaaagaaagtcaaaatgaagaaattcactatgaagaaattcactaaattacagccaaacaccatgcaaatctcaactccagtctccattaacagaaagcacacgataaaaggctcacaaagccctatggtgattttctagagaccaactccatgttctattacaacatcctaatggtaaactatccagagagaaactagccttctcgtatgcactccacaaattccttggccaatacctgcttcacttcattgcaaaatgtaactttaaggtaaaaaagtaaaacccaaataccatcagctaaatgggtattataacctacctatgcatcgtcacctccagcagctcgggcagaatccaccttttgttcctctgctattaaaagaggccatatttaattaaccagggaaatcagagatactgaagttgggttggcaggaccacagaacaaagaaaaatagctaaaataaaatgagaagcaatagcctaatcgaaaacaacaccaaaataagtatagtacacagtaagacacaatcaaaatattacatcaccttttaatactcagcaaactcacctgatcctaaaaatactaaagcagtgggtatggcattcaggccactgtaagtctaacaatgtccaatacttgaatgtgtgccagttgggaggatatgcatgcttttacaatttgcattttggaaacccttttactttttctgacaccaggcagccaaattttcaagttttgtgtgcttctgacccaatatgggcaagcaagcaagaacacagcagccacaatcttcaccacccaagaaccaacctttgatggtttgagttttggttggagacccttcattttaaattatttggtatttactggtttaaactcattggatcaatcaaggctaaacctcttattgctcttaattttttaagttctgcttagctccaaatgtttttatatgctatttttatgtcttatgaaaatgataaatataaatgttttttatacatacaattttctttcatatcctgcggcacccatgtcccaatcttaaagataatgctgaatgcctatgtcatacaaatgtcatgtccaataaccctacccatgttaatgcttcccagttcccacactgatattagagtggaaacaacaactctgaccaaattgttatccaactataaagattaaacaatagaaaaattgtataaactcaattctaagtgcacaagttcatgaagaccatcgatctccgaaattaaatttaattgaatgaaattcatatgcaaacccccaatgattagcttgaaaactcagccatctagtcccagtaagaagagtcacatttaccactaatataactcattatgagaccaatcaaacggaaacaaataaaaaatagcaaatgagacaaatcacactgacaactgagctttaatgagattaaacccattacccctcccttttttcacattactttgacctccctacataagaaatcaggggagatctgtattaatggaagggcacatggtgtaacattttatacaaattaacagaggtttgtgtagagtctaaaaagggaagggtatcgagtgaaattctattaaacctcactacctcagaggatttgagtgtaatactgtaattaaccctaaaagttttcatgtatttttatttacattgcagacaaagtccagcaaacacattgacagagttcattgatttccattaatgaatacctccatcttcagggatgtcagaagtccacagggtgagattgtccctcagaagctgcataattagggtgctgtctttgtaagactcctcgctcagagtatccaactcagagattgcttcatcaaatgcctgcttagcaaggtgacaggccctgagatatgaagagtactgtgttaaatttgttaagcaggggccaactttggcacatagtacacaaagaggtgggcaattaaaaattaataaaataaaataaaagtcatacctttcaggagagttcaaaatttcataataaaagacagagaaattcaaagccaggcccaaacggatgggatgtgtgggtgctaactcagcctcggcagtagtggaagccaactgaaatatttatgaattgttcagataaacatgaacaagcggaaaaatactttggtaactaaacagccaaattcatatcagtgatgccttcatctaaatgaatgtcacaatgccacacatgtaaaactgatcatatgtggtcataagacatatataacgtataataagttgttatgcctgaagaataagcactaccctacatccctactccccccttttcctcggttaatcttttcctcattaacaagtacacaactttagtgataaagaaccattggaatcactccttcaaaattcatatcaccagtgaagagttatggctaacaaatcatctacaagttaacatcaacattaaaaatatattaaaattgatgttgaaggccttccaatgaaatgatttatattacaattacaataatagaatgttgacttgccaattaccttaaaaggtaaattaaaaaaggacacaggccaatatctttgcactttcgtccaggattcatttagcacaaagaaataccaataagcaagatttgtgactgataacaaaggaaagtgaaaacagaagcattttttcttctctggcttcagttagattggcatgcaaagcaaccatatagtccacactccacaacagataccatgaatcagaatcaccaggtttaaattaaaaccacatcagatgcaagaggtcaaaatacaagcagacctgatacgctttcatggaatgatcagcagcctcttttctctcatcaccggacttgaactccgcgaggtaccggtaatagtcccccttcctgcaaccaaaaaaaaaaggcttaaatcaacacacaaaaactctaaattccaactgaagaacaaaaaaatgacaactcagcactcacattttgtagaaaaagacagtaggttcaccagaagagctagagggaataaggtattcatcaataacagtcatgatatcactgcagatattggacaactcagactccaccttctgcatatactcctttatcctcttcacgctcacatcgttccctttagcttcttctttctgttcaatcgaggaaagaatcctccacgaagccctacgagcacccaccacgttcttgtacccaactgaaagaaggttccgctcctccaccgtcaattccacgtttagcttcgccacattcttcattgcttccaccatttctaacacagcataccaaacactcaaaaattctcacaattgtgctcctcgaaattcgaattcaaaatcaacaacgaaaattcaaccgtctaaaccgaaattaaggaacatgattatctaattgaacatctaggtcagcacagtgtggtgactctgaaatctcaacatggaaattaagagaatggattattattattataccttcatagcgttcggcttgttcggcgagcttggcgacgtagacgaagttttcgcgttccttggtggaggccatggaggatctgctactttctctctcctctcactttctcgctctagaaaatttgtgtgtgtactgtcactgtgtgcgttgtgttgtgggtataagaaagttgagagaagggttaggttgtggaggagagggggtattgccacgcgctctgaggagagtgttttccacgcgtttgtcttttggtgaagagtggggagtgagtgatggtcacgttgtgggattgaaagggaggcaaattgattggcgtttggtgggcattgaaatttcaaattcactttttttgtcttttgaataaggggggttgttgttcacacggaaacattaaaaatttatactgtatggtggaatggacaaaatttggttcattatggtcacgttcattgttgaccgttggaaaattttaaataatgtaatggtcaagatttatttcaatttgtacagcctgctacactcaaatttacgtgaaaatggaaaaaataatccctccattatattttggggatgagtttggttgaattttgtacatattttaggtcaaatccaaaccatattaactcaatctataatgaattggatcaggtctctataaggttcaaaaaacttatattgttttaattttaaaagaaaaaaaaatatatatatatatataagatgatttatgggtgattcgagtttgatattattccaaagatattatgttgtgtttaattaaagaagtgttatggagtttttagaatgttattatgatatgaagttgaaatgttgacatcatcaaatagttgatatgagtaccaatatttttattgtttaattttggtttctacattttataagagatatgatacatgtaaaataattcttataataatttatataacatcattttatgtgtctatctctttttattatatcatttattatatttcaaaaaaaattatcttctcattttttccctttatctctctttattataagatttattgtagttgttatatatgtactatttctcatttttcaaactataggattttggttctcatattaaactgacatccaatatttatacaaaaatgttaattttcataagtaaatcaaactcaaataattttattcaaataacttttgcattttctttaccaatatgtacaaatcaatgttacatcgtttgaatttaaatcctatgtattttttcattcatgtatttaattgaatcgtataattcttatctatgatacaaaattgcataaatttattcatgtatcagatacaaagtcatttaaaatttatcttaccatataaatcagtgggtagccaaatggtatcaaattgtaagcttcaaattatgaaatgtatgattctgataacagtcaaaacatgtagaagctcaaatatgttttgcaagtcatgttacacacaaaccatattgtttccattggtatgatggtgtatctttctaaaagctgcatgataatcactgttaagtaagaactaccgtaaggttaagtatgttaataataaaatattgtaattatattaatgactactgtaataaaagaatgttttctcatattgtattgtgtagttaggctgtgttaggtttagggagggaggagagaaatttgatgggttccatgtggaacccacccattttacactttacttcaaaaaaaattctttaatcttcatctcctctattttcattatctaaatcaaacacaggattaggcatgcccaggcaaagtggaattacatactagtacactagttacaagctagcagacaaaattgatggtgcttcttgctgtcttaagctgtcggccacatgagcaattactcctacaccagcattgtgaagccattcatttttcacctgaaatcagacaagcactcgtgttaaaaactctgtaccagtgataccatcatcatccgacagattaaatggatgcagtacatgaatgttgttatgagcaaagaaaggccagaatgctgagtgaaagttgacatcaacttttttccatcccaactgctgtaatccccgaatcatctcatctgttaaaaagattagtggctttagaggaatatcagtgactgaacagataattgatacacatcgtaattttaataagttactctgggcaataataatcaccttctacaatttcatgatattctacagtattctgtgtatttggcgcattttgtgctgcctcctttgcttttactgcttttggaggaaatttaggcccatcagaaggaactgggggacaatattccacatcaaccacgtgcttgtatctatctaaagattttcgaggaggctgccaatacaatagaaaatgttaataccatataaacatattcacattctttaactttcacaattcaagcgtttcccttttcttatattaaacaaaatctcctcctacttttcaaaacagaacctgcacccaaaaaaaaggattgcagcgctttcccctttacccaacatctatagtttcttttccacgcttgcaacacggaagctaacgaacaaactaggatgccagaattaacaccactcacaaatcacaacattttaattgcagtatcaattgaattgatccatcaattttattttactttattcgtttcaaagggatttaatgtagacattcaataacatcagtactgcgtagagcaactgatacagatacaactaagaaccactgccacatccatttcaggatacaggctttcatcttttgcggaaaggctgtgattctgcagtcataggaatttccaattaagtaattatgaaggcacaatagagattaggctactaaagaactgagttaacagtgcaaattataaaaccattctgataactgaaaatgtgaagaactgaagatcccaatcaacagtcaaactagtgaagttcttcaagtgaagtacaattttttttatcgacaaaatattaattgttagtttgtagctttttgttagcagaagggattgaaccgcgacctttccttccttcccttgtttcttaaccacccaaccaaccaaccttatatctctttaagtgaagtacagcagtaaacaaatatttttcaaagaattaaaaaaatgaaatatagtcacattttgatgggagacttaattctctcaaattttacgtatttgtttctttatcacaatgtcccacataaactttgatgtagtagatgcaagttcacttttaaacccttttctgttgaaatttaatacaatgatgatgataaaatctaatacatcattatcatattattatcgggagagggtacatcatattattcttgggagagggtaaggaaatttgatgctctgtaacagttctagtacacaaagtagtaaataataaaaaaaaaaaaaaataataataataataataataacaatctcttttatacttctattattttcattacttgatattattcatcgagacatgaacaaaatttatattagaactcctgataatatttcatacctatagaagatatccagttatcctattagcaattgtagaatttaaattacaacttaccatttaagtgataaatctaagagttaagacaagtaaaacagattataaatggaagacataaacacagttaggatgttaagcataattccaagcatcctacaagattttagtttagtcataatctaagtattaattattaatcattaaacttacatatgctgaatattggagatcagtaaccaacaaaaaataagacaatccaattggagaaatcatcatattcaccttactgagttcagtttccctccttatagaggatgtgcgccaaccaaccatgtctatatgaagttaaaaaattaccaaaattgaggagaaaagaaccataagtttatcattgatatgcctaacaagttgtaaaacagaaaaacatactgagaggatacgatcatatgaaacattagcataaatgatgcgacatctaaatgctccaagtgcagatctacagaaatataaactgtgtaagtattagattacttaattgaaaaagagggataaagactagtacaaatagattccttcacttacaaaaacttcccatcatcagaatcagaagccattctcaataggagaggcggtttgtcaggtttgccatcagtaaggaacaactgactacctgtctggccaacaaaaaaaggagctataggtgcagcaagcttttctaggattgggacacccaacagaaatggaagctgaaatatatgcacagtaaacagtcaaaactcttatggccggcaaattttcagttcaagttgagaaacacaaagagcatcaacaagacatataaacataggaggttggcggaaggatggtttgcattcattcatttgacttaaaaagtcctgtttattagcattattttctaatcacctttttcatgattgtaatataacatttctccagtaaaattaaaattttgttaggacctgtttggtgataatgcaaatcctattctagtattctttccatcggaactgctattagaagagttactggcattctctcctccttccactctttctatttaaaaatttcttctaaggctgtatgcctgtataaaaataaaaatctcaaaatataaatacaagcatgcataattcgatgtaaaaactaagactatgtataagaaactaatttaagaaagagaatagtcaagtcaaatctcagctcagaaaaatagaagggaaaacaaagaaactattagatggataaaaaaagcctcaaacttagtaagctttagcttgagggagtgtcatatcttgcattatcttcaaggtttagtttccctatttcctcattatctcttaattttagttaacaacatatttctttatctcacaatgatttgttcacctaattagccaggattatgattaattaattagtataaatatgagttagagcttcaagttttacaaacatatcaaacacatcaagacattgtaatatcttagttaatacttaatatcaaattattaattcagtgtttcattctcttttatctctcttcctcgctctatccctaagctcataatttcaacatacagcaccaagacaattccaagttttaaaaaagaatgacaacacaaatctgatatatagacatttcaaatggaggtcatcagctaatcgctttccagctccatcaatcccagaaaatgtcttagtgtaagtatttgatgaacttactgcaaacaacaaacaattgttaaggacttcagctagacaaataattttacattcacggatgaggcactcatgcaatacccaagaaaatcttcacagcattttatatatatatatatatatatatatatatatatatatatatatatatatcttaggaagcttaagcttacttctttccaaatgatacaaatagacttttttcagcattaacttgaaagaaagtgaaaagaacagttaaggctgttcagcacaagagtgagttaaattttgcatgtttacttaaacctgtaaagcagattatgtttgagctggttaaggtatctcagtcagttgcctccatagaatcatagatcattgaacatcccaaaagtaacgatttaatttaaagaaactaagaacactatgattcaacaatcaaacattagataaaaagctcttcgaaagtgagcttgtatgtaaaatacacaaacaagggtgcatccaccattgatttaatttcaactacatcacaatcttaacacactaaactaatttgaaccactttaaccctctaaaatttaagggtggatacacccttgtacagtttacaaacaagctcaatttacagacctagaggagcattatgcaatataacatagagaaccactagttaaaaatatctaaccataaattaaaaaggtttttccaaggcgccttttcaactctgcttctgcataagtccagtcccctgtgcggtatcaatcaaaacatcagtacaactttgtatgagactaaactacagaccaacataaagaagcggacagatgagacatatgataaacaaccatgtgcccaaattttgcaatgaaaccaacttgtaaaagtgtaaacaatgaaacgaatactttactttattcacattcataggctaaattgtgagagtatgaattgaatcagatttataattgacaggcaaactggaaaggtacccactaatcataaacaggatgaaaatcataatcctttccaactgaacttcaatatagtagctaactttaaaagcattaagcacgtaaacttcacttttcacccatactcccatatagctcaaaacaagcatcactcatattttaacacaaaataattcaaacaattttttattctctcaataaatatatcacatacctagccaagataccatgaacaagaacaaggagatgatcagggtcgttcttcaaattccctatgctagcaatagaatttccaagagtgacagtactcatagcttgagctctaaggccctggtgtctctgtccactgtttgtacctgcaaaaattcatctaccagccttaatgaaaattaaaacttaaacatatatttgcaccaatattaatactgttgttagaatattgggattattagtctttgtgtttgtaggcttagactagtactagtactagtacttgccgtaatcattagtaggtttataggagtattaggttgtagtactttatcacatctatcaaacttatattcattcagtaaacaaatatgcacaaccatctttctctcttttctctcctccctatcaaaaccttattccaacaatggtcttttacctagaaaactacaaaaagaaaatagacaaaagagtgacaaagaaagaggatggagaaagcaagccaagtaggaaataattgtaaaaaatgttgcccaatgcaaaaaggtttcccgacattatggagccttgaggcggcatatgtatgaatcttgttgaggaaaagatgatctggccctatagttttaatggataacaaacaaagcaaattgatgaataagaatattatgtgctaacatgttctctctaagcatacagggactaaaaattggcaatccatctgattgaaagatcatgaagatcatcctgagactatgttcaataaccgttggaagacttcattgtcctatgatcatttcaccctttaacagcaagtctgaagattatgtcgtcttgagaacattatagtcgaacaagagacaaaaagcatcaaggtcaaactctagtaacgcaacattcttgagcacaacgtctgatgcaaaaggagaaaaaacaatgtagcctttcagataatggaaagttctaccttctcaggtctcttgtcaactccagaggaacaaaagcaacttttgcaatctaaagatagagcaacaacaatcaaatcatcaaatgaacaataaacaaatacaatatttaaattttgtagaatctaagtaagcccatttatgaaaaagaattgatggcattggtgtaagccatccagcattggagtccatactaataggcaggaaagttacagttttaacctaccagaaactcttgaaacacattacagctaagaaaaacaacccaaaatcagcaaaactggctggctaagccactgggttatgattttgacataatctattggcctagacctggacaggagaattgggccacagatgcactatcacaaatggaggaaggggaattgatagctctcatagggccaattttgctggatgcagaaaaaattcaacaagcaatgaatattgatcctcacttgagtaaacttatcacttcatttcaggaaaaaacaaatgagaaaccagggtattctttagatcaggaatgcctattctataaggggagaattgttataacagctaactaagaatggacatcagttctgctacagtgctacctgaatttcattcaaacccagtaggggtcattcaggggcttataggagctataggcatttggaagcaaaactattttggcaaaggacgatggctatagtaactaaatttgtagtggaacaccctatctgctagcagaacaagtatcaagccgcatctccattctccagcacgtctactcaaaacctcacctataccaaaggctataatgggataatgtggggatggattttatcacaagactacctcaatctaaggggtatgatgcaatcctaattgttttggactggccatccaagtgtggtcacttcatcttattgaaacacccctttttggctcaaatggtggcttagttgtttgctaaggaggttgctcatctccatggagtgacaacctccatagtaagagatccggatccaccttttataaacaagttcttatctgaattattttgcctaaagggtactgctcttcaaatgatctcagcacatcaccctataacagatggtcaaactaaagtactaactagggactagagacttactcacactattttgcttatggtagcctaagaagtgggcaaattggttgcattgggctgagtactggtataatatctatcaactttcagattgctgctggttgcattcgatttgaactgacccacggcagaaaaccacccacactatctacctagggaatgcttggttgcatgtagccaatggaagaatgttttgcttatgcatggtgcttgactttacactctctccactgggaacacaagtgatttcttattggctaatgttaggcaaccaaacctgtattttgccttaattaaggacaataagttagtggtatgcaattgccaattgcacatataaaataagacatatagacccgtaatatcaactgatattctcaataaactactaaaatcaaatttatacttgaattcaagttaaatgccttctgttgcatttatcgagtctagggtgaaaagtccatatagtatcccaatcctgcatacaataccaacgaaaatagtatgttagtttttattacctagcttcacgccagtggggttcaaaggtttgacagggttgattgcagctattttactagtttttaaggttagataggtgtgatcaataagcttggaactcacagggtattaattgtcttattactaagattttcatacactcctctttagtttcagtcacaacctcttaactctggtataagtagtatgcgtatcctttcatgtgattccttctatcaatcaaaatagagtccctattcatagcatagacaaatgaagtttctagaactagatgaacgttgaaaacttccaaagtggtgcataactaccaacgagctagctagctgcccagtatcaaaatacaaaatcagctaataaataaattggtcttgaagtcacttcccaattttccattaatcaaagaaggtggaccatacagcgccttgggccagtaccaggtcacccaacatgcacagtgtaataccgattttgcccttctcaaaatccgtaagttgcatatcgacatacaccattagatttcttacggatcaccgatctttatgagtcatacggattggcaatccatatgactcatacggatcgccgatccgtatgattcatatgaattgacaatccatatgactcttacggattgccgatccatatgagggtaaaattggaaataaaaaatatgtaggtgtattagaaaaagcgctggtgtaggaagcagaactcaccctctagcccaacagtataaatctggcccactatgtaagtagcttaagaagggggatgtagtttactgcatcacttttttggcttccggaatggccaatcatccgaaaggtaaaaaaacattccggaaagggtgcaaagaagcaacttgaaggtacaggaagcaatagcctaagaaggattttcagtttttacactagtcctaagtagtattttttatttttccttgtgtctacacagaggtggacccccactgctctcccacgtgtaaaccaacctctcgtgtgcacacaagaacaggaggcgaagagtaaaatgacagaacgaaaattgaaataatcaacgctcgatgtttaattggccaatgaaacaaaaacgatcttaattaagagaaacgtaagttggagcactaacaaatccacaatcaaatcagtttaaaaaaaaaatagaagattaggaaattaagaagtaaggggaaataaaaaaaaaattaccagaagagaaagtagaactggagggtgaggaggaagaagctatatgggcttgttgtgaggctcccttgttgttgcgattggaaattctaggcgagtaggcacagcgcgattgaatgaagggtgccgttgccatatgtgtgatgtatgataataaatttatatagggaaaaccaatccttaattgaaggcacaagtgttgttatcttctggaccaaatcacaacgctgcacttttgagtcactcagaactcggaatgggcaatggattcgcgggtgggaacaagccatctgttaatttctgattcatgtaaacgacacgcaacgcaacggaagcagacatacagcgtggcgtcaccgcaaaatcaccactcacccgtggggttgggtttgctttgctttggcgcctttatttatttatttatttttgtaaataatcaaattgttccttaaggctttgtttgggagttaggaggggaggagaaggaaagagatttaaggggaagggaggggaaggaaagggaagaaaataagggaagtttctttctccttgtttgggagttaaaaatatattaagagaggaaaatagaaagttaataagaaatttttacaatttttttcttatttaaaaaattaatacattatatattttacactgattagggtaggatagtaattttattaatactgactggtataataataattttaattactttttcttctaaaaaccctccaaataggggggacaacaattttaaggctttggaggctttggaggagttttgaaaatcctcaaatcctttccctcaaaaattaaaactctcaaacaaaaagatgtctctacataaatttttcccttccctcccttcccctctaacattcctctcccacctaaaggtccgaggcattccttgaaggatggaaaattcatatttactattctctgaaaatatgcaaaacaagtagataaactggtcaatcacatattaattcttaggctgataaaatttataatttaatattatttattaaaaaatataatttattgtcaaatttgtctttaatagcttaaagataaaattaagtctaaacttaattttaaactcttttttaatcattatatatgaactgatcgagaaaagtcatatcgtgaatgattttctagttaattatgtatgcaattcaagttgacaagaaaagggacaacttatagttgtaagaattccaatattcaagtcaacatgaaatcttagataagatggttagagattaggcctacctagagtgcaaaactctagacttctatttatatataagataggtttagataatgtgacacttcttcatgataaatacatttatcttttggtggataataagaattatttgaataataccttactacttgatatagaagctatattgttaattttgttgcaaggatatatcggcttttcatgcaattgagctctaattgggaaacctagctaggataaaacaagtctagaactgtaatccccaagtgatcgagtagctcgtgatatcctaaggtacgtgttaacttatggagatgtattttgacttgggacctaaatcaatcaaccctataccagatatgatcaaatactgaatataactatctagctagcaaaaattcaaatcacatttctactagaataaaccgtggtttggtatttttccccactcaatttccacttcaagtatctatacatataaatgtgcaagggatatttattatggtattgccaatgcataatacaactttctaagtagcccacgtttattgacaggaaaaagtcaagaagttcatgcgataaatcaatgtgcttcacattatagagcaagcatgagggttgtcatcactgaacatggacatggccttctcatcaataattgctgcaccaattggcttgtggtagtagccaaagtcttcaccataactatagccatgcttgtaataattgtaagaagaggagggcttggcagaagcaaagtaattaccattgccgtaatggcgagccaaggcatggtattctgggttgtatggatacggccacagttctgccctcctaccagtcttcctcactgttttcaataccttcttttggtctgcccaacccatcacagttaccttttgcatcctcatgtctatatcaacatcatcaactcctgatgatacaattcgtttaaaccaataggtaagatggatgtagaatttgaacttgccacactacaacgataaatgtttgaagagcactaacataagacttgtatacacactattttataatttttttacaggaaaaaacgaattgggtccatttgaactcttgaattatataaaaccagttatatatatacatatatgtgtgtatttatacactaaattttagaaaattcattcaataataggtatatgcaatatattttatatcagtttcttttcaactataaatatttttattcctcaaagcttcacatataaaatcacacaatattagtactcttccataatgtcaaaattaataaatcgttgagccaacgctagctatgtgcaagattgaatacagaattaatttgaattttaatacacacacacaaatagggtctaattatacttttctttctatattaaagaagcaaaaagagagaaaaaaaatcgtcaattatgctcaatgacattatgttgtcaatgcgaaataaattaaatctgatatagcgattgatatgatacgtacgtggataaagtagaacttatatataatctgctatttttggtttttggtttcaccctctttcagtagaatggaaatctattgttttttaattttaagtttgttttgttttatttgtaaagtttatcaaatataaaatagaacttatgtatatgatcttctattccgttttagcacaattattactaaacacgaatataattatatgattttaataaaaacaatcgcacacaaagttaaggcttttatgtaccacgcaattttttgagagctttctttatcttggtctcgcaacctggacagtccatgtgcacacacatctctactatctacaaaacacaagaaaagaaaaatgaagaatagttaaacataaataaaccatatgaattattattaatacaaaggccacatgtagttgaatatatgtacaatgcatgcacgtaacataatgcagattttgtttgagcttagtcatctctaatactattgatgatttagtgtatttaacattttaatacgcagtagctagctcaatcgaacttgaaacctcttatttcaaattaataaagttgaatatcaatcaagagtatgcttgtgtaattaagggttttttttaacattttcagaagttgttacttctaacttcttataaaagtacttaaatacctttttctttaagatttttttaaatttatataattattacaatttcttaagcatgtcttttaattaaaagattcaaaataaatgttaacatacggtcccgccttaagcttataatcaaggaagatatagaacctatttacaccttgataatgaaaataaaaaggaaatatattgtagtcatgtgtgcatgatgatgtgcaaaagataataacaaggaagttcacaagaagacagtagagagacataattcaagagcagtggcaaaataacaaaatagtgtttctaaattctaaccgtcattatttcctaaagattgcaatgagcttctagctataaggatgaaagacagcaagattatttgttggtggcaagattgatgaacctttatattgtttgcgtattatatatagtcaggaaaaccagcaagattgagaatggaacataattaagaatataaatatacttatattcacgcgtagtcccaggggatggattttctttctcttttaataatttgttgctaataaacaaaacttgaatgtgtagacaaattggaaactgaacagcaaatgctcagaaattgggaggagcgccgttgatagaaacaaaccttttatagcgcagtagtgtatatactatatagagagaaaagctatggacggcgaaatatatgtcaccagtcaccaaaaagaaaaagacacacacatatacatacatatatatttttatatatattataacatattaacatgaacgccattttaacattttaatggaaccttatcacgtatgaatttgattgaaaatactacaattttttaactattttgcaacttcaaaatggcactgcgtggtctttttaatttttattgagtttcttcgtaggtgttacttttatagaagctgactatgaaactagctacgacagcatgatatatatttctaagtgacaagctccaaaattgaagtttagaagttaatgattaattattaataaacaaatcaaagggagctgccgtgtttgtgacttccttgcacatattatgaaaagaaatctgctgagaagatcatgtgttaaaaatatatgtgaaaacactagttgatatagctgacgaagtctcttctactagaaatattaatatgacaattttttagtacgcatgtattgcattttcaaaacttaaaaataattattaaccatattttcattataattaaattattgtacttctatgtttattattttcactaaacatattatttctattattgggatttaaataaattagaattatcatttttactatatttagaggataaatatttttcaatcaagaatatatgattattctcatcctcccccacccccaccacacaaaaaaaatgtcttttccatattataaaaaacatcttttattcctattaatttatttaataatttaataaaaaaaactttataatgatgctaacattaggtacgttggtttgagtataactgtattcaaattgtttcctcttgaatttaaatataatagataaaaaaataattgttgacaaaataagttatgagcatttcgcacttataacataataacaaaaaaaaaaattatgatgagtgtgattcaaacattattcttgtggagcaagtgaaccaaaatatagcacgcatacagatcttttcatacacatgataagtggtgttaaaattttctttctattttttcttataattattaaattaaaatattgcacttataacataatactttttaaccttttaaaataaagataaaagacctaaaataacattggaaaaattatcaagaaaatctcaatgaattcattgtttgatgagatctttaaccaaattcaacgctaattgtagttgtacttccgtcttccactaatttccagtgtattttcaaatttgatttttaataaaaaaaacgttgtacttatttttacctttaaccattagatttaacaagacaccaacaaaatactaattaaaggaaaaacttgcaacaaataagaaagaaaaaagttacacaaacacccaaacagtgtttatccctccattagccacccctttaaatatattattttattatttcaactaccacccgtttattatttcaggtgttgggtgggggtatgatacacgtatgggtgtacgtgtatcaatgctcaataagaaatatggttgaaaaaaaaatacttcccacctatggaaaaaaattacaaaacttgatgtctgaatgctgtctgagataggattacttattctagttttggacatctccacaagtttctcaatgacatccatgctcaaatggaattatactattctgctccagccgcatccaatcctatattatatcactaatacaatgtttgtatgcaaattcccgcttcagtcgcatgattaattaaacttaaaaatgatcagctccattggtgtttagctgccaaaaagggctacaacacacccaacaaattattcaatatgctcaaagcttgaattcaacacaaaatgtccaaattaccatgggggaactacaacccgtaggatttctgcaatttctgaacctggttgaggaaaatccatgtcatctgcataagcaattaatacaatcatatatcagaacataaacttaacaaaccccttgaaggtaacattaattcaaataaacaaaagcaaaggaatcattatagaataataccatgacatgaggagcaatcctaacacaatagacagggaatccggtgtaaaatttgaacggtcctcctgctttgaaggttttgatagcacaatcaacagagccagtgtatggatattttccatcagcatcaggttgcatcttctggatctgggtcttcacatagtcaaatggcaaactgcaagctgctgcgaaaaatccagaaacggaacttgcacctaaagaagaacaaatgttagttggtaacagtgagaataaaatctttggcattatattaacctatgtagcttatggcacaatccatatgaaatattagatttcccttacaaaactttaactcagacaaggaattatgacatgtgtaatattatgcaagcttccataatttcttaaaacaacaaagagcaatcaagtctcgcaatttgttcaaaaaaatagaaatagaaagaaacatatctgcttactgcttagacattgtacgagagccaaattgcataatacttattaagaatgagatgctaaacttagaccattttcaatgcttggctaaattagtcatccacttgaagagtttgcccaaatcaacattggtgcattaacccgaaaatcctaccattaacatggttagtttcaaaagagtaaactactctgccaataacatacagaaatattgcaattggtctctcttattttccctgaattgcataaacttttcaaaaatgcactgatatttgtcttctaccgcatactagaagtgactaattgataagaatcagttgtaaaaaaaaggagacatcaacaataaattcagttcctacatgatagaaaacagaacaaggaaagactatggacctgtttgattcccttctcacaggtttatttttaaaactgttttataaaacaattccacactgagcaattaatttctcatctaaaatctatgaagttatgaaaattgtttcccaaacaagtcttttagaaagcaaaaagcagaaacagctgtgagatttttctcattcccttcttttttcttcaagcactctgttcaagtgctcagaggacaaacttctagaaaatagaaatgtgctcaggggtcaaacaaaatttagaaaacataaatctgtttttgtaaacagtaaaaacaaggccaactattgtatctgttggcaatttttgagcttttggcaaataaaatagtggatgtggaagacaacccaactattgtaaggtttgactaaatcattttgtttcagtgtttttaagtctacaaggggatcgatgggagtaaagcatagacttctgaaacatcagcagaaaattttaaataaggtgcactaaaaataatttgggcaaaatctttagtaaggtgtagtacagttgagcatacttgtctcacaaataccatcacaatgtataaagctaaagccaacaaatacaaataaaataatttgacagtagtaaaatggttacttacctagaacagtagcagcttcaccaagaccaacagaatccctgaagaactcaacactttgatcataagatgcaagcatgcccatgttcaatgccatggctcttacaacagtaggcccagcacctttccaaagtgccaaaaccccttcatcagcagtaattcgatagagtgcatggaaggcattagtgtaatttcggcgctgagcagcaggtaatgttgcatcagcctgcatccgaatgagtgccaaatctgctggactaccaacagttgctccgatagcaccagcagtcagcccacatagagctttctgatagagtggcaggggcttcccatcattagcctcaatagctttggccgtcaagattctaaaaagcattaaaaccattaagttagtcacaatcacacaaaacaattccttagaaaccatgaaagatgataagctttccagttatcaaagctatcatattataaacaatggaaaacagcaaaggaatagcagaaagccttagaaattaagactacaaaatttctacttttgattaatcaagagtgatgaacatagacgtaacaactcacttaaatgatccaagacgggcagtggtgtatgtagcctgcctgagtaatccagcagatagaccctacaagaaatgatacattttagacaccattagataataaaacgcatgtccaaaactcaaactggaataaaacagtcactcatcaataagaaaccccttcataactcataatccaaagcaacaacgtctacaaaaatccacttccacttgcagatctatagccaggtaattaaaacaagtgaaacaaacacaacacacaacatctggccataccaaaacccataacaaattggaatcatcaatacaccaaaaatcatcccaccaataaagcaaggatccataattagagaaaatgaaacaacataaaaaacaagagcatgggaagagatgtaaaaaccttatagaaggcagcaacaccctcattcttaagcatggtggaagtgacctgcgcagctgatccttgcccaagttgaatcctcacctacaccaccaaaaccatcaaaccccacaacacacaaaaacagagatcgtacacaaaaacccacagatctgaatccagcaacaaaaatcgaacagacccagaagtccatttggaggaatagatacaaaaaggacggacaggtaaaaacttgacgtcaccttgatcatatcgatgggttgaatgacgcaagtggcgagcatgccggagactccgccattgacgaaaggcttgatggtggaccacacgccggaagcagcaggcttggccttcttctcgtctcccattgttgtgttgttagtgagatagaaaaaagggtttagcgaagaagaaaaacagagggagaaggagaaggaagtgcactagtggtggtgcgtgctcttgggagctgagagtaggtattgggcgagacctaaagagagagaccacacactacttagaagttagaagcgcatttatatgttgtaaacctcgcctatgttgttgttgttcttgttctctccctcccacaacaaatgagatagaattaatgtggcatttctttttttgttattaaccttggcattcctgtaatttacgaaactagttttcggccaatgagatccatgttcgtcatttattttatttatttactcttttttattggagataatcgtgatccttgccacataaaagtgactgcttattttctagcaggatgtaattattttaaggtaatatttggtataagaactatttttgtgcgttatcagtgtacaaaattttatattctcaattaattagaaactattattgttacgatggtcaataaattttatatagtaatttgtaaattgataaaaatataaaaagaaaaattacactacccatgtataaacgatttacttgacatctagaaagcgtttagtacaaaatcaaattttagtttttttaaatgtttgtttttcatgtttgatttgtttttttttaaaataacatttttatgagaaattgtttggctacattttccataaaatatttcaatctaacttttctaagttaaaaaaataagttttatcacaataaaatatcatgttactcttataaaataatttaatttaatgttgtaaaaaattaaagtttgcggtaaaaataatgttgatcttttattttctataagaatatttatgattaactaaacaaatttaattgtttttaggacttataattcttaagaatgatatttttgaatatgaaaaaaaatttaattttaccaaatgcctccttacataaaaataatatgagaataattttttagtttaataaatacatattatcaaagtaaaaaaaatcttatattgtaaactaattaaaataattaattaattttaaaatacttattattaaaataaataaagttacatatatggtaatttataattggatgtactactttcatgttttataaagaaaaataaaagtacctttcaggcataaaacgtttttgagaatactaatttgtgaataaatgagaatgacaaattcttatttttattggtgataataattttttgtgatattttgttcgtcaaaatactaaattttctcatgataattaattataaacctattattcatatgaaagataagtaataattagatttaatttctgtaaacaaaagtagatatatttcatattttttaaaaatatatttattgatgatgccacctaattgaaacaagtagaagtttaaaaaatatggaatgcattttagtttttagttgttgccaatagccttttgtgatatttatatacttaattatataagcaagtttaagttatttttaaataaaaatgtttatatttgacattttcagtggtcttaatttatgatgccaaaaaaaatatttgataattttttgaatcagcactatgttatattggtgtaaattactacaccgatccgtttgataatttcttactacgttattaacaagagatatataaatatgacatttattcgttaaaagtatgcttgtaatatattttagttagatttcaaatatcttccaaagccactgaaattatatgtagtattagatatcacatcctttttttctgaagattagttatcatatccttagggatagaaacgaattttgggtgcgacggtctaataagtctaattgacgatagcctcttaaaaatctatattcaaacattttaaggcagtagattcttcaatattgaagacctgtctgataggatggtacatatgttttatattttaaaattgttatgtatggtaattaaaggttattaacttttataatattatcttaatagtcataccttagattattttttattaattcacaatataaaaaatttcatactaataatatatgaaatatgattcctcatggtggctcataccgcagttttggttacgtaatatgaaaattacaattgtaaacaagttggtgcatatgatgtgcggttctttctgtattagacgtgtatatctatctatctatctatatctagagatatctatctagatatagatagatagatatacacgaaagaattgcatatatatatatatatatatatatatatatatatatatattgtatgataaaacggaaaaggaagaatgctctggagtctggcctctccatcaagtgtgaagtggggttggtttctttgggatcttggaacgaatgagctttacgtaggtctagtaaaaactataaagtaagcaaggaccatcgcagcacatgtccatggggatgtcaattccttatcttttgctttagttgcgataaaacgagagatacacccccttgcctttgttttcagtatgtcaaaattttaaaatcgattttgatgatcaaattaattgcaaatgaaaatcggtaatctatagaccggatgatgtatccaagaaagcttatggtcgataatatagcaaattaacaactataatactctactcatcgatcatattcattatattaagaaattctagctcaagtgattaaataaaataagtaaattattgatttattgtaaattttttaataattattttttattcctactaataaaaaaaatcttctccactatagtagtattttattagcaattaccgattaaatattggcatggagctttccaaatttgcatgcatttgctatgcataataatcatgtgaacgacaataggatacggattataagtagagaccgacccaggtttaagccaatggggcaattgcccccctaaaataataagttctcttaatatgttctatcagaaaatcaaaatttaaaaactctccattcatccttaattttataaaataaataaaatttataatgtcatttttcccctcctatcatttttttctggttcagttcctgattacaagagtaaaataaggaatgcatgaaggacatttgctgtatctattatctaatgttggtgctccacacgaggacatgtgattccatgagaggtgccaacttgtggaattggttggttctgctgtggatataaaactcgtggaagctcaaaaataccaatttctcccttaggatttgtcgttgaatggcgattatcacatcaaacttttgtccccttcccacctttttgcactcctttgtgttttaatgtgaaaagcttggtttcgttcggtctttaattaaggacaaaaaataaataaacatgtttcaaattttaattatatacaaggttttaaagagaatgaaatgtatcttattctaaagccaaatgagtctcaaggtaaaacatttaagattcaatcttcgcgatatatgtaacaccaaatttggatctagacgggcattgcaacttgtaaaccacacccatcactctgttggcgaaggtggcagcataacaacacttttttatgtttgaatttatatttttttaatgaagacgttgtatatttttaataatttgttatgaatgattaagaagatgtaaacaaaagtattaaataaagatcacattgttttccaatgttttaaatttatttgttaaagattctttttgaacgaaaattggcgtaaaagaaagagaataaattgtatgtttcctttaaagcctgcttagaatagaatccaaaacaaataagccactccttgtttgtttttattaatattattttttagttccataaacatcaccatattcagttatatgcatcgcttgaaagccaagaggaccaccccaccaaggaatacgaatgattatgatttatgaccaatgagtggagctagagtcgaacgtttcttgtgaatggctattcacaaaatataattctacaattttaaaaaaccaaaaattctgagtttaacttccatacttgtgcagaaacttctacattattaatcgatgaaaaatatgctacatgtgacgtttaaaacaattgttgtaaaaataataaatttatcatatatgatattttttatgattaaatgataacataattttatattattagtgtatagaccatttactcaagggacttcgaactccatagctaatgcgtagaagataaaacaatgaatatgtatactcactattccacttaaaatttctaaatttggtagtgctcgattgttttaacttttattcagtactttatattttttatacataaaacaattgctgtcaattttgtttgtttcattacaaagacacgcaatcttcaggttgtccaagggctatatgacattcttgaagattaataacgagtatacaaggccttatcatctatccacgcaggcttctttgcattgtaatagaaaaatgcaatcatctgaaccagctcatccgcagttcggagttctgcaaaggtacaagtaacagtgcatcattataaaagaagagcctagacaaagagaatgtgcatttctttgtaccaaccaaacaaaactctggtatacataaaaaaagtgaagagaaagatcaatgatctcacctttctccctgtacacgaccctgtgaccccttaaaaataaaatttgaggacattctctaactttcagggcataagccaaatctctctcgatattgatatctatcttaaccgcctataaataggaaattcaatatgttacacggtattctaaaatagtatcacttgtaacatttgtatagtgataattaaataacagaaaatataattttataaatctaacaagtggttaatcagaaggaagatttgcattgatggaaagcaacatcattcttttcagtttaggcatgtataaatagatgaaagtgcagttttatcacatgaaatagaaaaatgatcgtacccggggaggcaaccgatctttagctctccaatatacctttactgctttctctaactctttcaaatttttccagttatcagatgccctgtggaaaaaacaaaatcaaacaccaaactagaggctaaaattagctataaataactaacattatttgaaatcgctaccaacgtatcattcattatatatccgatgtggcattttctatattcaatttttacaaacaaaaagaaacatttaattaaatacagaatttcttatcgaaatacaatttttttatgcatttccacactcatgtgcattatcacgtgcctctgaataaaccaaaattatcttctgtgaagaaatgacatcttaaaagaagtaggtatagcaaaccattgccagcagaaaacctttcaaaaaattgaattttgtgtatagaagaagaaactccattagagacgagaatcaaattataaactaaaaatggatacatacaatttctcacttctgaaagaaagttcagttttacttctataatttcaatcggggaaaaagaaaatcaaatcaaatgtgaaaactgttttcttgggccccaattcaaatgcatgtggagaaaaagtatccaaagttaaccaaccagcaagttgtcccaccccatgtttccaaatgctgtctatgataagggaagtataggtgctgagcgctattaggtttatcagtactcagagaagttaaaaaaggaagcttctaaaaaagatgaagaacataacttaagaagtttgattcattttctcccatgtccattttattttcttctcttaagagtgctgttgagaagtttttaccatctcattcagttttaccatttgttccatcccactcttgtcttaagtattaccaataattctattctctttagctccagcaaatccatacccaaaaagcatttcaagtaaaacccaaaacagtagaaattacctgttatagcgttcaaagacaaggacaattaaagggctgggatggaaagcaaaactctcccactccaaacagttgatctcttgcacccagttgtcatcaatctccccttcccagtcaatttcatacccatcttctcccaccacattcttgattggatgctgctcaaaatactcggaagctcttattccccacccaacatctgcatccaaaggccaacttttactctcttcctcaatcaccatcttatttcttaagccttcaccgccatcttcctcttcatcatcattgacatcgtccttatcaccactttcagatttagaactgtcatcatccctctccttcattatgttctcatgattctccaaagcatccttgttttgttcccgaattgcagcaaacgtgcgctcgagcgaatcgcgtacaaaatcttccactgccacggcttcacttctgcgaccacgcttcggcttcctgggaatcgtagtggggaatgtctctgctgaacttttatcaccattgctggataccacatctttagattggccacttctgcttcttgccttaggccttgctctttggttcgaactagcttcaggttccggaggttcaggattgggttttgaatgagactttctagaaacagagcatgatatggactttacaatgcggtggctagatacaggggaataatgagaaaagctgtgagcacattccaacataggattttgaatgttaagtgatgacaatggatgcaaactagcatcacaaaaaggtgagaagggtctaggtaagacagtggtttgaagaaacaacattttcataacttcacaacgttgtcaacggaaattcatctatttatcttgaatgaggagtctctctctctgttcagcagcgtcacacaggagaagagtgtcagaacattatcgagcaaagaaacagagaagttaggaaaacattaaattaaaagaaatggaaactaatggttggattattttatcaaacagctggtgctcaggagtcaaaacacacgggataacccaaagtttaactaaatgaacctttactttctttgttttggggttccgaaatagtgagcgctatccactgaaacgagttaagtaggggtgtgtatgtgtgtagttgcctttcttctcctcgtcactctgtcacagtgtcacttctggtaactacggtactctctgagttttgaatggtgcaggaagaaaatctctttcatgatttgtgttttttttgtcaaggctgccaagtggactttactattcgcaacccctcattgctttttcaacccccaagagtttgtatctctgttattgtgtagttgagggtctatacacaaccaaaacaaattttttctgttgtgtaatactttttttgcaccctctactaatctttaatagtacactaaaacttcatttttttaacttggtagatattttttagtcaccaataacctccgatgtctttttctattttaattacctagcttgtctttagtacggcgtcattaatttttgcataattttgtaatattgatctgaaattacttaaattagaaacatgcgatatcacatctcaaatgtttacttctaaatctctttcctcttgtttcttgctaaaaagtcgatgcacataatctttttactttaactcaagggaaaaacttttgctaacaatgtccatctttggaactaaagttttgagttaacctctttcttcaattcctcaataaaaaatatatcatcttttaaaagcatgcattaaaaaaattcatgtaaaaaaatgtataagtaattaataatttaacctaactaaaaatattgaataatgataaaatcatgtatctatggaaaaaaaatgtcttcattttaaagaaaagaaagactttatttttattgtataaaggtgaattgcgtatagagcattgaaaatcacccagatatacgtattttttgctacatgtacttaaaaatatttatattcttacatctcttatattttcacccaccaccggtagtacttcttttcttagcttttgcctttgattacacaccaaggacttcagctaataaatagcctatgctatattacagtgaaaatctgcataccaattccaaggactatctatcatgttcatccctcaaaccaaataatccttcacttatttttccacatgaagatgctgaatgttgggagtctgctaggcgctgatcttttgagaattaatggtttcactaaagtctgctctgaactgatagctcacgcttcatttgatccctcattactctcctcagtattttgttggaagatgttcgaggaaagtctggcacaattttaacaaggcttacctgttatgtaatgaaaagagtttgtgaatgtattagtgaactgtatcgtatcatcccaagtcatgtcagttttcacaaattaataaaccacaatcaattcaatattgtttaaaaccaactaagagtcagaccttaaacaaagggttaaggttgctttgaatagctttagtgaatttcatctttagagtttctgcacttgaattgtatccttcctttaaaactacaaatataaccagttgttctgggcctctatttgcaatcgcaacaccaatggcagctgtctccaaaatgcattcatccgctccatcacagacacgctcaatttctacagaacttgtctgcatatcagaaacagaaatttcaaggttaaaagttaaaacgagtccaggaatggcaaaataagagcaacaatcatgtgagttttagaatatctgatatatctatgatcagttagagagtattacttactaagttgtacttgtagatcatggacatgaaagctatgatagaattcttacaccatatgtgtaagaatggaagataaagcattcttaaatgattttaagaatttctgaagaacatcagttaagagtatcttccattcttaccaagtttatgcagaccatggacatgaaagatatagtattctcacactattaagtctaacatgcagacctatccttcaaaagcttcatcccccatcctaggaccatcatttcacattacttcacccatagtaattcccccttctagttctacactgactggagtgattagttaaattttcttttcttaacagaaagttattacagttgttttcagtgtttctaattgttgccaagctggaatggattgttaagctggaacgattgtagcacatagtcaagtgtagcagtgttggttatggtttatctttttttgtttctttttttcttgtaatttatgttgcacctttacaaatggaaagttgatcagatatcgtgaatcaaggaatgaaaaattttctcttttttattttttttctacactcttccgttttttctttggtcatcagagctatattcttctactgcttccctggttgatagctttgattactatcagaatcttcgaaattcctgattagcttctaattcagctgtttccatgtaataatgatacctttattccaccaagattcatggtgtcatcagccctcccttgcacaatgatatatccgtcaactgttctttttattatatctccatgcctcctaagaatctgttaataaatttacaatgatagacaattagacatgacaaattataaccatagtaatagaatgagtagttaaaattacaaatttagtttattctattattatgtagtttacaaagaagggattatttaaaaatctttaatcgaggtcatacggatttacagtattttggacatcaaaagcttgcatgggtcttggcggcatttgataaccaactataaaacagacaaagttcagaatgaaagatgttcctatattttcactctaattagttttaattttcagtttgtaatttgttaattgtgcatgaagacaagtgcttatgaaacagggccatcaaaaaaagcctctagcatataagtaatcacaacatacttccagatcagaggagaaatggtatccttcacacatgaaagaattaatatttgaagatagttgtatctaagtgtgaaaaccattctaagcatattaattgaagttctaccttccccttataaatgggcattcccttaaagtaaaccttctcatgatcagcattaagcaatctgtcagatgctcccagagagagagggaataagcccacttccccaacacaagcaacatcatctggctgtcatattaggcaaagagatcaaataaattagaaaacctaaattacaatttatctaagcccatagatatgaagataagatggttaaatttattggatagttaatagtttggacatctgctagtgaaaatgcaaacaactcaattgggaagagtatgaaatcttaaaagaattgaagagaggagaagaatagacagagccacactgcaaacaacaaaattgcacccagatatggtatgatgtaatgctgtcacaagtggcagcataagtaaataaaaatcatcaccaaagaactcaaactatccagaaaattttcttacataaggaactccattttcgtcaaaaatgacaaaaccagttgtcattgatgctgtgctaaatgctccaaaagcttgaggctgcaacggacttcctgcaatgtagctagatgcaagctcagtgcctccacacaattcaacaattggactgtaataagcttttgaagaaagccatagatcatcatcaacatttgatgtttctccagaggaacaaaatgttctgcatataaccatagttcagttcatttttcttagtagcaacttgattatttacactactgacagatattactttatctttgtccaatccaagccctccatacattgcgtactcttccaagcttttactaagcttggaactgttcccaaaatggtgacacctgcatcctgaacaattgtagttcaataaggttgtgctttggtgcaaagtatcaaactctattgatgcagaatacaatacaacatcaaccatggcaattatgatgtcactaattactaatcagcatttacattaaggtgtgtggtcccaactttttaggtgattaaatatagaaaagatgtaaaaaaataataatataagattttggggaatttacctgaacaaattttccaaaatcacgaccttgaggagacccatggtacaaagccagagttgcaccagttagaaagcaatgatacaatactgttggtccaatcacccatcctaagtttgtaggccagcaatacacatctccaggtttaatatcaatggcagcccatccatcagcagcacttcgtattggtgcaagttgagtccaaggaatagcttttggatcccctgatgaaagtcaaaatataaccagaaaatcagtacaatggtattttctatctgatatattctaagagaggatctttacctgtggttccagaagagaatagtatattagtgatagaatcaactgattgatagcttggagagtaatgatctgacctgccaagagttaaatgttaagatgagagaaagcacaagaaaaaaatgcaacttctctttctttttctgtctccttttttctctcttccatttctgggatctaaagaagtgattattttagtcaccaaaaatgaccatttgtttatattatgatattctttaatgatgacattgcagtatgaattacctggcagaagagagaaaacttttccatgacaagtcttgttctcttaattgtactcctacatcttcacccatcacagggagcacaataactttacatgtagccgcctcaatgactcgactgcaaggagaaacatggtctatgtgcttaaagaacagccataaatctatttaacaaacatacaaacatgagcactaccaaggttgacacatttcatctttacaaggcttggacagcaaagcaatctgagagggcatttaagtcagtataagttggggaatcagtatatattaaagtgaaccaagtaaagggagagctggcttctacctttggtgcatctcactccacagttaattacttttgttaccattaaagaggtctgtttagatataatttagagattataactagcaccaggaacaataatcaacatatcagaaagcatgcatgtaagatattgaactaattcatgtttattattacaagtactcatataagaaatgagacattgcaagtagaataattaaattcaagcaggatttgggagatgtgataggaagaggttagatggaatgctacacaaacatcagcatgaagaagagtaaagtatttatgatatagaattttgagttagcatctgagttgttaatgtgcaaaagacttattatgattgggaatttgggtttaacatgaattttctatttataacagaaaaataaattcattgatgaaaccagtcatttgtgacactatttttctcacatacacaaaaaaataagtgaagagaaaatgagaaaaaggaaacagggttccagaaaaacatgtcctgaaatacaacatagctttgatgatttaacatcacttactttcagattaactcttatattctaacactgggatttttctgatacaaaataaatagaatatcagtaatcccaacacttcatttttccatcatttcgaccatggcattgaatttaaaatcagaaacattaagtaaaaacacagtattgaaacattaatcaaaggacggatcaacagatgaatatgaaataacctaactacaatgaaggttaagttgccaattgttccaaaagttaagtataacaggaaataagcttgacgtgtgcattacacttagcatgcctaccataatctgaacagataaattagacacaggcatcagaacccttggctaatttaaaatacaattttagtatttagaagttaaactgctgaaaatgtagctatgggtgtaatgataacaattgtttacctgtacaaagggaatttcctgccacctcttgctatgaaatcctgaaaacaaaataaagttgagtaaaatacaacaatcttaatttgttactaaaataattggagattcatagaaattaagtctaatattgcacaataccgggaattaaaccagagattacagaaacggaacattaaagtaactaggctagcacttcaagggactagcctcctcccaattcccactcttccctgtttttaacagatttcaaatattcctcaatgctaactattcctcttcccctctgccagttgtctagcagttacaacttacaaaaaattccctcgcttcacttgctcatgtgatcattaatccagtaaggccctacctgtccctttatatttctactcattcgcatcggctgtagtaataggtatttatcagatattgattgtataaatgcttgtatctaatccaatgctataaatttgaagcttctaatatatgcaaaaggagtttttaacaacacaagatgcatgcttctgaagataatatttgtgttcagttccaggcatttaaatttgaaaccttcaagaaatgcctaatatagatgcttaagcttccaagggaacttgaaaggacagtatttattctccaacataataaagatttagtaacgttagcattgcttcaagcatattaaatagtattatttgcacaaatgataagtaagaaagaacagagacattccaaatattgaatggttccatttcaatcaacagtagcttgctttacaattgaaacatcacctgtgtgaaaataccctttgctttggaaacacggagtcgagttgcaatttcttttggtgcaaagctatccgctattgagaccacagcacatcctgctaggacaatggctaaatagattattacggcattggctgtcatttgcatgtcaattgcaattgcatctccccttgagaatgtggcatctattgctttggctaccaacctggaaatcatatggcaacaacaggaagaaaaaaaaatcatcatataaagtaagacacaagtaggaaaagagccgaaacaaagaatatcaaaatgatatacattaacacaaaatcaacagtgcaaaactcaatgcaatgatgcaattgaaaaatatctcttaaatgatttaaataactgacttagcacaagttacaatttaaagaaaaatcaagagatcagactacctataattaacataacttttgtggaaaaacgagagtgtaacttgaatggcttacatcacttggtgccggagttgtttaagcgtgatatgattaacctcggaatcatcgaaaccttcatctctccaaacgatggctaaagtgtcatctgttttgtgggggtgtgaactgggttgcaaacagcaatcggcaatgttgaggacagaaccggggagccaagtcccaccatgtttagaagggtcggaagtatctaaaatgcacttgggaggttcaacaaaggaaactgaaagttccttgagaataagggaccagtaaagctgcacaaacaaatgatacacgttgaaaacacaatactagaataaaaaagggaattagaggtgggagggtagtaggcttacctgagggtgttgaacagaaaacttgtgaaatagaggataactagtaatagggtctttgtaggaagctcctaaaaggtcaggggcatgggtttccatgagacggcccaggttggtgtgtttggattgctctctgaaatcaaaaagcaaaaaatgaaagatgaattagcgtttgtgttgaggtagtggtaagtgataaggcatagtaagagagagatacagagaagggaagcaatagagtgggagggaagcatgttgagagtgataaacagagtagtagagaagctgatgcaaggagtgagggtaagatggtttgagcagtctccgagtgacaatttggcgccatatgtgtgaaggagactgaaactcagagaggatatccctcaaagcatggtataattcattgccttctgacactgttaagcctcctgcattcaccaaatcctccactcccaaatcccgcacgctcttccccatctctctctctctgtgtctccgcagcagtttccaacttgaaagttaaaggcttttgatgggtggttgttgagcttcagttcccaaagttgactacggagtgcgctcgctcacgtcacctaactctttttgatgggtggttgttaggctttaaaatattttttatttaaatttattatcaccaataaaaaagtcattgaaaaaataaaattaaaattaaataaaaatattttaaaaataatatcattaaatatgacaaaaataattaaatttatttatatttaaattcaacgtataacatcattttttacttataagaagtagtattaactttctaagtataaacatgaaagacattacttcctttattagtttatttctatttataagaattagtcaaataatttttttatcctttattacaagattttatttcattcctattatatattaattatttttttattaaaatatcatgaattatttctttctctctcctatagaaattgaaaaaatatattataatcataaactaataaattatgtcttataattaatcacagtgggagtattagattagcatcgaacgccattttaaatagaaacacgagcatactatgaatctcacgaaatacaagtataattagtcttgtttattattaagagaaatttctttagaattaccacgaactgacaatttcagaaggaaaaaaaaaaaaaaaagagtcgccaattattttatttaactatgaaaaattgaagaacttttttttagatgggaaaaattaaagaacttaaagaataatctataaatcagattcgtatttagagatctatatatatagtagagatgatggaaaaaaaaatatttcactgtatcccttatacttttacccaaatatagttatcctaagtgaatttgccaatataataggtgtttgtctcaaattataccatgattttttcaagcaacaaactatccatagtttgctcaagtcaggaggcatatgcatgcaaacttgttccactaaatcaaaatacacatgcattatgcaaaccatatttcgtgttgaaaagaaaagtctatctagaaaaagacaaaaaaataatcaactcaaatatgttaatatataataaataaggtaggagtttaactttctacaccagctaattttctaatacacccagcatgcacaatgtaatatcaattttgcccttttcaaaatccgtaagttacataccgacatacaccatttaattcttacggatcgtcgatccgtatgactcctacggattatcgatccgtagaagtcatatggattgtcaatccatatgagtcatatggattattgatccgtaagagtcctattgattgtcaatccatatgactcatatgaattgccgattcatatgagggtaaagttgaaaataaaaaaaaatatgttaggtgtattagaaaaaacactgatgtaggaagttaaactcataagctagctggttggtatttatttccaaatgctcgaaataataagttaacagattctagatttttaattccaaccctaaaatcaaataataagtttgaaataataatgtcacaattaaataacatagttatcgcaacttttcgaaatcatgtccatataatcgagtccattttactaaaaaaatcttatcaatttcgtacagattatttctgtataaaatattcttgcaactttgcttatgacattagcaaaacatatggtttttcctgtgaaaataaaactataagaaactttgaattttccagcagattttttacagatctatatccacaagaaactcaccaagtttcctatggatttttcacaataactatttgcagaaaaatccaccccacccaaatgtcaattcagtaccattttcaatgcatgtcaaggctctttcgaaaatagttctaaatttcatacttctcaaatacatgatcattcttgctgttcatagatatcatcaaactgtgtcaaatagcatccataactcaataactttggaatccctaaaagtaacaatgtttgacgtgtttcctgaaatttggttaaataaacaaacttaataaaacaaaataaataaaatcaagaactatgaaaataatttacagcatgtcatgattatcattatccacttacaattatgacgaatcaattaaggcactctctggaacagcgagcaaggaggagataagcttgttactacgtacttctattaactatcattctcatttacataaatattggaacattatatataagatgtaagccaaccaaagggcacttgtatcccattcacttggcaaatcggacagtccactctgcagcaatatcatcatgttttgctttgtctcccaaatacaagtgagcaatgccagggacaacagcataattatctgcaacaatgataacatctttacactccaagatcataaatcataaatgcctacttgttatattgattgaaagtgttggcatcactaatattacatggttggaaaggagatttctactaccacaacattttttacaaattaggaaagagataggaagagaagagaagtatgggatagataagatgagtcgcatgatgaagaaagatagaaagaaaaaattagttgttaaaagtattgtaagaagttgatgtaggaataatttcttgttttcaaagatttccataggaaacaatgaaaacaaaacaaattttaaaagtgtcattgtttcctatacaaatcttttaaaaaaagaaaccaagcaataacaaggtaacattttttttaattatttgtaaaaacaagaaataaaacagaaaatgtattcccaaatcaaacaaccccctaagttaattgaatccaaagcgacaaaagacataaaccattagttggtgtcctgttaaaacgtgcttcttctccaaaacaaggcacataacaagatctgcctctactgctgtatttgaaagcaaaaggctgaagaatagaactaacatgcaaaccatcatcaacccctatttatataaacaaaatggaaaaaataagaggtgggaagaacttacaaggatcaggatttgccaaaattgatctaacagctagtagcaccttagtaattgttagcgctggactccaatcatccttcaacattcccacactaacacggccatcagggtctacattgcagtggtaaatgcgtgttttgaatactacctgcaagctcaattatttaatttaagacggtaaaaaacaatgaaagtacttcaaccgctctacattttctggtttgtctgcatatcttggaatacatatcaaaattgttaaatacaataacacaccatctagtagttatatatcttggaaagaaaaagtgacacaaacattcgattatgtattttccaagaattacacttcatatccttatttgcacaagggtgttgcatagttgaatggtccttataatcaatttgcttttcctgaagggacactaccctagtcttgactttaagtaagcccgtgaggaaactcatccaaaaagactagtctattattctgattcttatagtacaggtatgcatttccctaatcgctccttttcaggttacctttgacatcaattatgactcaaaccccaaacgagagtccatcccaaaagactagcctatttgggcggagagcctcatggctcaagtgtcagattgagcccttatactgaatgtgaaacataacaatcagacaaagacaagtccatggccttgcaaaattgaattaataagctgatggagcaagtcatatgtactgtctgcttgaatgacctaggtgcttggtaagacatgacatggtccaaacatgtagtcataaaacaaacaaatatgagcgaaatacacgtgaaattgaaacaacttacacaaaaaaatatgaaatggattagttgaaagaagtgtatgtgagagatgtacctcgggaggcttgaagggataatcaattgggaatttgatgtcaaggaaaaatatgccaccttggtagggtgttcctgcaagcaaagaagaaacctattataaacatgatattcatagtgatagtaatggtaatagtaatagaatagggttacgcagctaccaggggttccaataatggtggcaatccagtgatagaggttatcgcccttggggccagcagagcaatcaggaggagggtcgttgttgagttcgaccatttccctctgaatcctctttcccgatgccgcgaggttgtgggtacccatgacgatgttgatgaactccacgatgattttcctccacttcctgatatcatcatcactctcctattcccacaagccaaggacccaaaggtttcatttcatccactcacttagcttcctattatttttacatcattaaatttcatttaaattcataataaaaaagcattattttttaaatgtttaaaatcctttttaaatatattgttaataattttttttagcaaaatatcatgctagtgttattgtacaattatattttttttggttaaataaatcatgatagttcattataaactaaactacaattttagtccttaaaatcgtaaaatattatcataaaaatccttaaaattaaaaaaatgtcaaacgaattctcgaaattgaaatttgttagtcacatattcatcctaacactagctttgttagagagactacaatgaaagtaaattataaaattaatagattataaagatagttacttgtatatgtccagattaaaatgacaataattttaattttaagtatatattaaacatttttctaatttcatagactattataacaacatctcataatttcaagaagtaaaattataatttactcgattattatatatggctttggaatttggatatcttaaagaaattcttttaataaattcagtgaatggctgatgatactttctttatcatattttaaatattaattaattaaaaatagaagaacatttttttttacattaacataagaataatttagagtggttaaatatttataaaaaaaaataccaattgtcttggtttgtgctttaggaaaatctaaccaaaaggagtttgactgacacccttaatgctatttaacaacattatctcattcatctctctacacctcaaatcaaaccgctttatgaagtggagactcaaaagtgttccatcttatcccaaaaaagacatcctcttgtagcaaatataatagagcctcatcagtcacatccaatctataacactcttttaccatcaaatctcactcgtagttgtatctcatggtcatctaatgcagaaatctcaccagtagcactggtgtatcgcatgtcatgctgagttattagatgggcagcaatactctcacatatgtaaaatcctacttacattgttactaaaacgactgaattcatagaaatggataggcaggagagctagttcgatcagcaagaaaacttgtagttgcacgtaacttttgaacgacatccataaatatagcatattgaaccttgagatcccaatacaaatagaaatttaaaaaagtagccatagaatggtggaaccaaaagttgcttgtggctaataacaattcctcaacctgaatgacatatatataacaagagttcttaaatcagtgaaggcaagaagcgattttcgctgtgtttgtttcatgtcaattgaactgccctggaaactatctaactttactattcctgatatttccaagttcttgtccaaattttgcttccatgcagttgcagatgttagcctccgtcttgaacaaacaagcctaaaaggtattgagttgaactgtaacacctaatcagtgctagccttcttctcaatacttgagttgctaagtattactacaccaattattataagtatggcacctgcaaaccactgtggaacagtttatgcatcagaaaatgcatgaatcaataaggtgaatgcgtaagaggcaaataaccggggccatgagttctttggtggtttagtcatttagcattagcactgtaagcatcagtaacagacagaaaaaccaagtggtcctctactctgttagtgctaaaaagcagaacaacattaaggatcatcagtttggcgccccttgaaaatgaaaacccaaagataaacttgatgtgcaaaattgtatcaaagacacaaaaaaaaaaaaaaaactcatcccggattccttcagctcaatttaaggtgacaccaaaattactatccccacaattaaaaaactccgaagcactttggaagttaacctgattacttcttataatccaaaagcaattccagttgatgggaagagtgtttggtttccaagatcaaacgaaagatataatagttcaaaaatgttgaaattgaagagtctaaaatcattaacaagaatcaataataaaacatatagttttggagatggtttaaaatgatcatgtgggttagatggttaagagagaagaaacgggggaaaaaggcaaggatttgattcctctgctaacaaaaactaacattctaacatttgctaataaaaaaaaaaatgagatgcaaatggagtaacctccagacaagttaaaagtataaaaatgaaccaaagttgagagggtgtattaattggaagcgatagtcataacaacattatgatcagagaaagtatacctggaaagagagtgattcgtgaaagaagaagaaaccggctaaaccggaagagataaaattggtagcgaaattggtgacagttgcctgaagagaggagagagctttaaggctgttgacataacaagcccacatggtgacattgaacaataacaccatcccgtacctgacaaactaataaataaatatatatatatatatatatatatatatatatatatatctaatctaagattcaattaaaggaaagagaaattacagtaatatgaaaattagaaggcgaatctgaatgtaacctaacctaacctggtgaagagggagcttaacggaaatggctgcaagagcggcgttgaatccagcagatactgcccacgcgtacccatttctgttgcctccctccatgctccgattcgatcgcatcacaattcacaatcagacaaattacttgttattttcgcttcagcttttgactgttgcacggtagtggtgttggtttcccaaaggctgtttgttgttgctgcactaatcttgtcagagacgcttactgaaaattactatcaaaataaaatacttatatgaaaaatgctgactagtacagttaagaaatttaaaaaaattatattaaaatgcataaaattatattatttataagatttttattaacatacacaaaattgtattgattataatttttttgacattgattagcaagaccctacttcaattacttatttatgaaaataaattaatatatcaagttttattttccattttacaataatttataaatttaaattaaagaataaaagcctttgacctttctattagtcaattatttttttatccaaattagaagtatttgagacacttattaagtagtagtattttatttcttatttaatatattagtttagtttgtgcaatcaacatcaacattaataatacctttaactcaagttaattatggttagtgatagataaattcaatgataaataaaaaataagacaaagaaagagaaagacacagaggaagaaaaagtgaaaagaaaacaaaagatatgaaaaataaactaacataaaagaggggtgaaaggaggaggaaaaaataaagagacaaagaactaaaaaaaaaacaaggaaaaaacatagaaatattaacgcgtttaactctcctaagtttcggtcgacttctacctctatctttctttgtgttgagctcttggtaacaaactcttgtttttacataatcatccagtggtcgtcttgtgtccaaaccaccttaatctatactccctcatcttttcacacaccgatattactcctacctttcgtcgaatatattcatttcttatcttatccattttcgtataaacacacatccaccttacaatccttatttctgctaaccctattttatgcacatgttgcttatgtgcttgtcagcattccacatcataaaacattgtcggtcttacaattattctatagaattttccttttagcttaaggggaattttgcggttacacaaaaactctgatgcactccttcatttagtccactctgatatgattctattatttaaattttcatcaacttcaccacctttttgcaaaattgatctcaagtatctaaaaacatcttttttgggtacctcttgaccacgtagttgcactgtgtcttgatcatcatctcttacccgcaaaaactcacacttcatgtactccgtcttgctcttgcttattatgaatcatttagactccaaagtgtttctctacaattccagttttctattaacatcatatttgatctcatcaataagcataatatcatctgcaaaaaagcatacattacgacactttttcttaaatatcttttgtcagttcatctatcactaaggtaaagagataaggactaaaagctgaaccttagtaaacacctaccgtgataggaaaataccttgatgttccattacaagcttctacacatgtggtagccccatcatacatatccttgattgcattaacatactttaatgctacatttttcttctcaattgtctaccataagacttttcttgggacgttatcatacgttttctcaagatctatgaatcctatatgtaagtctttattcttcttcctatacttttccattaattgtcgcatcaagaaaataacttccatggtatatctttttggcataaattcaaattgatttaaggaaacattggtctccctccttaggcgttgttcaataactctctcctacaacttcatagtatgactcacgagcttgatgcctttatagttagaataattatgaatatttttcttatttttgtaaataagcacaaacatatttttcttataagcatcagacatcttatttgtttgaagaattttattaaaaatattgatcaaccattttattgtcacatcactcaagtttctccacacttcaatatggacgtaatcgggtcccaaagttttattattattcatcctctttaaagtctccttaacttcatgtgtattaattatgcatacaaatcttctactataaaaaatatcttccaaatccacctcactcttgtcgtcattctcattaaaaaatttactaaagtagtttaaacatcttttacttacatcttcattccttaccaaaagtttttttttattttcattcttgatacatctatcttgaataatatctttactcttcttatccctcttttttcaaatttgtaaataaatttttcactatccttgcttccaagatttttataaaaaaaaatattgattttatatgattaattttgtaaataaataaatcggccataaataggtaattcacgactgttgttcggaaaggagaagcagcaaacagaaaggaaacaaagattgatgaaaatagcctactaaaaaacattgagactcaattacccgcactgaatgccttgtaagctgccatcattgagttagaaaaaaaattcataaaaaataattaccaattttaaattagactttaaagaagacaacatgaatattaatattattttatggtaaagaaaaattattcacccgtatgttcgtacttacaaactcttcgtagttccatccatataaatatatagtataagctactgaatatttcatagatctcatgctaatttttcttaattgttcaactgaacacaccttttcttattaatagttcaaataaattgtatgctactctaattttttatgatcacaacaagtgcataatttgttggttcgagaagctggcagtcatttcttaagggccccgtattaggttagtctcctctgatggctaaagcactacattaaataactatcttaaaagtgtgataaattacaatgaccccaaatgcagaagatgggacatctctgaagaataaattggacccaagaaaagctagatacaaaatcgataggaccacattacacgaatcattgaattgcaatttaaagagcatcgaccttgtggtcataacaccgccagagccaaaaatacaccaatagctgatatcaaatagttaaggctagacacttgcatgttcatactcgcaccaaaggggcctgaaggtccaagtgccattggaggtaaactcaatccaccagtgctcgagttagaactgctgtcaaaatattccatgatcatataagaaatttaaaaggtcacaattactacttctaagtctaataaatcaaggatgtataaagattaagattctataccttccagcaaatatacaggatgaagaacctgcaacaaagtacacagaattaattggttaagtaactaaacgatgtaatgtaactaatatttttttgactaaacatgatcttcaggttcaaatcaaaaacaaactgcaactgctttcttgccctgctaatatgccaaatagggacatgatcaccaaccaaagacactacgaatccattattttatcatccagccatgttttgtgggaggaattagatgtatttattcaaattcaacttttagtgaagccatagatgtgtcattgtgtaatttgaaaagcacattggtatatgcttataacttgaatagtttttataactgtaattgctttctaacaacgaccaatgactttcaaatatatgatttactctccaggggctgttttcctgtttctaacaaggagggattgtgggaaatttcctacaacagttagtacgcaatttgaaataaaaaatggttacatgagtaatagtccaaagaaataacttgaagtgttacaagcgtcccatatcagaatatcaaggttaaaacagaaataagaagtcatatcgacttactaggatccttggtagtaattgtagcggtaccatcaaagtcacaagttccaccactgctatgctttctctgataataatcattataagcataagaggcatggcttttcacattattggggagataacatggctgcccctgttgaattgcagcacaatttgctcctccttgtccacatgcccagctcagtccagattgcagcttatcggtgtctgctccatctttagccacacaaaaaactgctgaagaatttccagcaatcggatcggaagcaccaaacctcaatggataaacagtactaccattggtataaaagatgccccaacttttttctgatacaggcccattcctcttgtcttcattaaacaattcatatatgtatgtattaatggctatgtttggctgactaggagaacctgaatcattcatgacccgctgaatcatattattaatgtagagctcagcgttttcttcagtagcatctggttcattagctccaccaaacgacggccagccagtctctgtgacaacaatgggtatattattgaaatttaaggcttctatagagtagtaggtagcatccaccatagcatcaaacatactgttataacgaaatagagtgtttgggtcaacaatttgcttcatggaaggaagaggttggaaaagagcatattcaatagggaaaataccatctcctttagtgtatccataataagggtaggcatttaacatgtaggaggaatttgtgttcttcagaaactgaaggagttgatagatagtagagttccatgaagagttaaaggtggcagtggaaggaggaaaaggcttagggataatgtccatagactggggagttgaaactttgacccggaagttaaggtttgcagcaaccagggctttgtgaagagaattcatggcaggaaccagaacaggggcgacatttgggatagtggaaagaacctcactgccaactgctattcctgtgatattggtggacgggacataagcaacaacatttttattaatccaggctgcagctgctgacggagattctccaatcctcagtacctcctcattggtgacaccaacaattacttcaatgctagtgtttgaaagagcttgtagtaagtgtgcgttagcatcatacagacgcacatgagtaatttgattagcttgtagaatgtcaactatatttgaagcagatggcagatcagaagcatcagtgccaatgtttacccccacaaaggcacctacaagttaaacaatttgatctagcatcaagccatcaactcaaaaagataatagacagtcaatgtcatactcatacatccacatccctaattgcttccccttgtggtaatcataacaggtatagaaaaataaacaggctgcccaacgtacaagacatatggtcattataattatgtaagaaaagcaatagttttgactgtaaaatacttgcttgcaactatcaaacccaatccaataatacatgaaacacctcatcaattgtacttaataaataataaatgcacatgcaagcacaagagactcggtccactcggcagtcagcttgcagcactagtgactttacagtcagaatctgatagacaatgaaaagtaccaaagcataaggagtccaggaggaggcaacataaactacataaatccaatctgacaaagccaatgccatttccaggataagtttcactctatttaggccaattttttttatgaatgcatgactattggcaaggctgtcacctatcagcaatttcattttaatacacttttgatccaaatttaattgacacacggtgtaactgcaaaagcagtctagactatacagtatgtagactgatcgtgagaacaaagaaatttgaaaactcaatttcagatattcaccacaaatatggaaaaaaaagaaggtataaattacctaatgtagtggtaagcacagcaatagtgagcaacaaaactctcgcaagccatgttttaagcttcatcacatccaatatcacctgagtgaatcagcaatttcagcccaatgttgctgtccagcaaagccttagctgaaaacttgagcaataaacacgaaatcacattttgagcaataaatgaccaacataacacagacagataattaaacgaagtccactagttggatgaaacattaatgaacaatatctactcttacataaaattgatgttcacagaaatcaaatctagtaagaacagtgccatattcaacaagctttccaaataggtagtacatggtacacctcaaggcccagttaaaacaaaaataaataaataaatactaaaagatttgccgtttatagacatttttcttaaaatggagaagagagagaagcgtgatttcctcttttagtacaaaaaaaagcataataacctaaccctcatagaggggtttagaaagaaaggaatagaagcgcggactgtgcacctgatctttcttaaaaaccccgaaagagcttgtgttgagtagctactcttctgttgtgggtataatgaacactgaacactagctgagagaggtggaacgcgcagaaaagaaagtgcattcaccacaccaacacgtagcaaaagctaaaaccctgaaagcggaaaccgttgaattgagagatttttaggttgcaatgtgaaggtgttgggaaaaggaaggaatgtgaaagagttggcgaagaaagggagaggcaacaacagtgtgcaaagtctcactcactttactgtcccaaacactgcccagtaaagttattacaaccggacaacatcacatctgcatcattcccgtgcgtgaataaatgcaactttcaatttctttattcataattcctaaataatgcattccccataaagttttttcactgcttttataatttaaaagtaaattttttttggttaataatataaaaattgatactgcttgtctattaaaaactccttatatttttgggtgcaacctagagatacatgatacttttatttgaactccagctattttttttttcataaaaaaaatggtattcatccaaaaaatactctaactattttcttgtcctacgtcaattcattttgaaataaggtgatattttctgtgatgattctaagaaattatttgattgtgaggaggaaagaaaggagaataggtgagaaaaaataaataaaagaaatatgattaaattagatgagggtagaatgaattttttgaattaaggttagttgataagaaataaaataagggaaaataaatatatctactgagtaaatgaccattttaatcttattattccttttattaaaacaggatatttacaacgcggagcactaagccccctcgccactgcactacaaatcacctgcaaaattagatatgcaaccaatataactagatgaatcttattataaatatttatcaaaacgccacaacatgtccccacacttgcaaaacacaaaaacacttttcctattccaccaggtaagtagagcataatatagtaaaatatcgaaaatttcttctccaatctacaagctgatagatgtgccaaagttgttgagatcgaggaagttgcgaaaatcttttcctctatatgtttgatgatatattccaattagtggtggttttaacctcacataaattatattttaaaatttaaattataaaattaaattttgacaactaaaaatgactacaaaattattaattatttaatattattatagagaagggctaaaaatgtatttttcaatttaaagaactaaaaaaaaacaacttttaatttaaagggttaaaataggtatattttcatatttaagagattaaaaatatatttaagtcaataaatttatatcaaaattgtttgaaggatgacaaatatttcattaggtcataattatttaaagaactaaaaaaatattttctacacacaaaaaattactcaaatttcaaaatatgaaaaatataaaagaaagtcacaaaatgaaaagaaaatattttagaaaaaaattactttactgagtttactctaaaaaaaggaataagtgaaagtattgaatgatctgggccaattaaaacttatcactgtttacttggttggacttctttactcctaagcccggtttggcccaacccatttacctttacctccatccaaacaaaccctatccaaaaaaccctagaatagacgcactccgttatggtgagataaaaaccctagacgccgcagcgcctatatatactactactctattcccaccctcatctcaagacacttaagagaaaatggcggtacctctactctcgaagaagatcgtgaagaagagggtcaagaagttcaagaggcctcagagtgacaggaaaatttccgtcaaggtagtatacattttagcctcttcattctgattaatttaagatgtatcgtttggatgagtaattttgtgattttacactttgttttgtgttgcatatagctgttgagcttttttatttttattttcggtttagttaattgtttgatatgcgtttcgtcgtagtagcttgctgctttttaaggatatgatgatattactttgtcgccccagtcttaatttgcaccacaaggtgtaagatggtgattgacattttatctgattctgctgtattatttcaacctgttatttttttgtcaattttatttgaatttgcttctttaagtctcaattgttttggaccgatgggataggaggataaatttgacacccagtcttactatattttttatatgtgatgagagatcgactatctgatcccatatatgatttgtgttgtacttttgttggtgctttgtttggtttttattgatgttgatttgtttcctgtttgccacagttttcctttgttttttgttttaatttgagcatgggatttgatggtaactttttggacacccagtcttacttgctccattggtgcactctggtgaaaattaattgtctgatcctttaattaatatgcattgattggcttgcctagtaatttcttttcaatctgaataaatttccacttaaatttgttatttgtatattatgaaatgcgattgtaaagagatatgatgatctttatccatcaattctgcaatagaatgatgattactaacatgcactaccatctgatctctgccatccttttcatacggttgagtaattttgtttgattatttagtgattataacttattatctttaagttgcttaaattaagaatttatttgttaatttatttgcccatggtatctgatgtccagactttggactcttgtctagctgtagcttgacatctcgttttaagggcatatatagaatttttacaggccttgcgacacagttggctttctttactactataagctttctgttactattttcctgtttacatctcttgaatacctttatgttgatctcaaaaatcgttttcattttattaatacttttcttgcacatgtagttaagaatactttttgttttaccagaaaatagtctgatctgcaatctgtgatgacatttcaataatgtgctgattgtctgtgattattatcctaatatcaccatctttcggctgagattgcagatcaaattgttcttgtctatgaaattattatactagggtctataactaataaccttctatttttttattcaacagacaaactggcgtaggccaaagggtatagattcccgtgttaggagaaagttcaagggatgcactctgatgccaaacattggttatggttcagacaagaagacccgccactatcttcctaatggttttaagaaatttgttgttcacaatgtgaaggacttggaactgctcatgatgcacaacaggtgaacgttgtgtcccaattagtatttcaattctgatcattttgcatctaatgtttcctgaccactttatttgtctttattttaggacttactgtgctgagattgcccacaatatatccacaagaaagagaaaagatatagttgagagagccgcgcaacttgatgttgttgtgacaaacaaaacggccagattacgcagccaggaggatgaatagtctgaatgactgaaagtcacttatttgtagtgatcctagtgacactcttgacattgggttttgatctttttttcattcttctataaattgtagcatgatatacaattaacatggtttctctttccctcacttgccgtctcaaattcaatttgttcttgatttgggtttttggtgcttattgacctttcagataatagtacgttatcagctaaataatttatataaactggaacgagtattatcaactttaccccatttgataaaaacgatacatgtatttaagccaaacaatgttaaaggataaagcaaagtatggtgagtgaataaaatacgttcattgataaagcaaaattcgagtatttaagccatagtacgttaaagcttttgtccgttatattagctcaatttcaaatttgcagtttgcttattgagaaccaacttgattatgatgtttctctttcatgccgtcgtatcttgccttgacccttgccatgccaacatctttaggatcgaaaataaaagaaaccttatctttcgttgtttcttttgttataataattctatcgcatcttaacgcaatagttgtttggggcacacgaatgcaatggtttgaaaaatactagaaagcactgtgtagtgaggaggttaacaccaactatgtgtgtcgtactggacatcatgcataaaatctgtttggattgttgtttttaaggtatgtgaagttaatcagaaaatcagagtacaactaatcactatcataaaatcagaaaagtgaagttatcaaacgagcagaatttaaacacgaatgatgaggaaggaatctcgaccaatttcattttctaaaacacggctatgtctctaatttgaaaatttttgtttctgcagaaacatgaactagaggtggcaccaaattagaggtgccacacattaaaaggaatacatttagattaatttgtaatctcaataaaacatacctttgtggtgatgttgacaagtcatgtgcaaggaaaaaaagattcatccaaccaacggtttcatatagattgcctaaaaaagatcctcaaggtataagaatgaactcaaagtagtgtcatcagtggaccgtggcatggagtgaagtctgcgactaaaatgggtattcctaggagtcaaaaaggataagttattccaaatacataaatacagaagtgaaggaaatatagatagatgaagttagaacttagaattggggtacacaaattagggttatgcagaacttttacgtaggattgaggtcaaaaagttatgttggaagttcatcagggcaacaatgtatttaaagacggaataatgtgactatgtgagcattcattgaatatattttagtatttcactatactatataacttggaaaatttataaagcagagccattacccaaatctgaaggtcatagacaaatagagtcttaaaggcttcagcaaaaactcttcttaattttcaatttggtattcaaatgagaaaagagaatgaaagaatacgagaatggatttttagcagcttgagtcaacagaaaggaaagagggtagaaagggattctatagtatgtatacaaaatcatgataatcaacataaatcatcaatataataaaagaacaagcaagtacaataccaagctcatatctaacccaatggtatgaatctgaaactgaatccaaaagcaaggcccgagtgtaccatgtattctgaaaaagcatccaaatcagtagtgccaacctgatcagcatgtattaactccatccttgcaatctttagtcaaattatagaacgtttccacgcatgtctttccacggtaaaagacctctgtatccactgcaactttcatgtacccatcaaactcaacaggctttccattgttgataagtgtggtctcgttataccactcacttgtatttccccacagctccttatagtcatcaagcaaatgcaccttgtaatttgacctcaacttatcaaagtaattataataaggctcattggtggcaatgtacaaatgcctccaaggctgaaccatccctttaagcttctcaacaagaacatccggcgacgtatcataatccaaatgaggccacaactccttgttctgggctttctctccccgaaccacatgaacggcgtcaaaatcccagtccaaccttccactaatctcagtaacaatattcatcaacctcttggatttccacacagcatgccaaggcctctgaatattcttagcagcctcaccttcacaaaccctataccaataattttcaggctcaggcgcatcaaactgcctccatataatcgtactcttatccttcttaagctgcataggagtcaccttgtgattgacaaccttcctaacaggaatcttcttcttcaaatgcgttttatcccacttcttccaatccctcaaaaactcaccttcctccacaatcgaagccgtctccttcaaatgctcgaaatcgaagtagtacctaaaatccttcccctcctcatccttgttactagggttataagttgaagccaaacaaacactcaaatccataacaaaagtcctgtttaaaaacatagcttcccccaatccacacaagaaactccacaaataatgattcattcccttgcagtaatccccacctctcgagtaatacaaatacttcccattcctaaaattagtctccgatcccaaagtcggaatcgtgtcattgatctcatcatcgcgggctgaagcccgcggcggcagggtccgaccacccctggcggcgccggagcgcgtcatattccggcgagcattggcgccagagtgccagccgccggcgtgcaccaccttgtacctgcagtcgtcggtgacagcgatcttgaagcggcgaaagtcgcggtacttgcgccaggagcgctcgcgcttgttccggaagcgccacgcgacgtcgcactcgccggcgacggagccgttcaccggaggctggtagtcgaagaaggcaatggacttgaacgcgcggaggttgaatctctgaatagcaatacgaacgcgagggttggagcagtttagggttccgtcgcaggcggggggagaaggaagcgccgcgtcggtggagtcggcggtggaattaacggtggacttggcaatttgctgttcggttttctcgatgacggcttcggtgacggccgcggatgagggtggcggaggtgggaggggagggtcttgcggcgagggagcgaggtcttcgccggttttgaggacggaggagtcgattcggaaagtggcgttttgtgattgggtgaagaggttagttagggctggggtggactcgagccatgggtctgggggctggtaggttatggctatgacggtgaagattaagacagagaagacgaagacggagaagaagaggttgctaatgagtttgatgatgttttgggctatgggttcggttctgctactgttgctggagtttgagtccttcattttttgagatctgaaggtgaggaagagaaagaggtggcggtgttagtttatgggctacaggttaggggtgatggcgacggaggatctgaatctgatgccgagtcattcagtgctgtgtaatgttagagtgttacttacttcacttcacttgtcataaaaaccaagattaaatgttacttttgtttactatgttcattggttttttatttttatttttttttaaaaaaattgttacaataaattttaaaagttttattttaatgttttagattaaaataatgacagtcatgaaaccaaaaatggaagcaaaactcaaaattttcattgcaacatgagatcctaaatttcttatcaccttcaaaatctaatgtttataatgtatgttattactatattatattgtttatcttctggttgttatgaaatttgtagaaaaaatgacaaaagttaaaaaaatagataattaatacatatcattttgtaatcgtcattattttaattacttatttttaaaaattaatgacacattaattttagtagcagaaataaaaaaaaattatcaaaataaaatttttaaaatttaatacaccaacataaaacaagtataataaaccaaatggcacaaagccataaaagaaaacataaaacttcacttcactttttttttcctatttgttgttgccttttcttcgttcacacattagttattcaggttagttactcgttatgtccgaaaataactgttatcctagttattttaacaaaaaaaactaataaataaatgaaacaaaataatattaattttacaaaactaatattattaagtagataaaagagaataatattagtattagattcaaaaactaatgtgatatttattagagttattggtgaaaaatgataataaatattaaattaaaaaatcaaataaaacacttattttaggattctttttctttctaaatgtaacttattttaggaccaagagaatatattttaccaatttactaacttttatggagctttatcaattactactataattattttgattcctggtccttagagaaattattttaaaaaattcatattacataagttaaatatttattttatataattaaatttacaataaatcaatattttaatttaaattattttataaataaatttaataataaataattttttaaaaatatataaactatattttaatttagaataaatatactatttattatataattttaaccgatagatgtgttataataaatgtgttagaaaatatatattagtgagacttctcattttaagtagtgtttttatttgactaatacaataaaaaattgattaaaacatattgataatgtaaaagttttttcactactatttaattatatattattcgtataataaatttgtggattttttttaattattttaaaagtcatatttaagatggtttctaattgattaattgtgtaagttttaccctaataatatgaaattaatcttaaactaggttttaaaatacgtaaatcaatgtattttgtgtgttttatatttatattttttataaatatgaattttcaattatgaagcttcttaagagaactttgaatcatgaagttaattttgaaaatttcttattgacaaatactaatattggactggtttgttcagacttaaaaaaatagttttaagataagcatataggatctgtttatcaaaataagcaaaaattaaatttttttaagcaaaaataatttatacaaacaatttaaaaaaacaaaaaaaagtacttattttattaaaataaatatttttccaagaaataagtttaaacaaactcaccgtccaactaatttacaggtgtctctgtgttttgttaagaactacaagtactaacttataatagccatatcattatctatctgtttgtgtgttagtgtctatacatatataaaagggaaaagatcacaaactttacgttcataactagatgcaatatttctacaattctactcattttatgtcggacaatgtaaattagatttacatgagattgatatcaacctatttgtcctctgtatgaagaggttgtgaatacttgtcatagatgaattaacttttaaaatttaaaaagtcaaataaagtgccagtgactttattctagtggaccttcactatagtctatacacatatttagacatgaagaactatggaaaacacatttcagcggaaggcatgctcgtagtcatgataacggaagtttttgtatatgaagtgagctaaccaccgtgacagtgcaaatgatagtactgctaaggcaaccattgaatttctttttgccactgacattgtaccatgcttcatgacggcaacaatcccaattgaagcaacagatatgatctgcagcattacttcaaccgcattcaggctcttataagcagaattgcaactcttgcaattcaccacatgggaccagtacctgctcaaattaatttgtaatcaacaatcccaaaacaaaatttttcaaaaatttattagtacatatgcaagcatgttagtgaaacctcgttagatatagagatgcaacattgaaacccaaattacgacataaattcgtttttgtgattacttgcctttgttcaattatttaggaaaaaaaaatatatactcaaagtcagaggtatcaagctgcttttgtgaaacacacattaaagcatggaatttctctctgctgattacgttgtagttacaggagtacagaacaactttttctttctccattggctaagaattttagattgataaaattcttgattatggtggacttcattaaagatttatgcttgatttaatatagaatttggtcccttaaagcaacaaaacaacttgtgttgctttagtccttgaaagtgcctatctacacaaattgatcattgaatgtgtcaacttgttaacaattttacccttttaagcttgtaaataattctatccctccaaagactaatctgtatagatttttcagggacctaagcaacacaagttgccacttccgaggaccaaaacgaatactaactctttgtaactcttccctgaattaaaggaaatggccaatctatttataactatattgaaacttccatgttcaagagcaatcttaaatgagtacctgtctaaaagctgttctctcggaggtgttggaggaagagctccactatattttcctctccaatcaacctgaccatctgcatacttccttagccatgttctataaccaataacaagggcgtctgactttgttggcacaaaacaggctttgtgccaattgtttggtccaatatcctttagtttatgttcctatcagaagaatttaacaaacaaatatgaggaatcaaattaaattgttttccagggacatattacttttctatggagacattaaaactgaagaaaataaaacagaccagacaacaagaaagaaaggtaccaaattttagttacatgtagaacataataccagtggcaactggatgctgaaacataaattattaagattttgcatcaatgttaagtgatattattcacctttctaagagatattctgtcataaaatctgaagcacatgtggaattatatagcagcagattataataagaattattttttagccattattgggacaaaatcccccaacaattagactaacagaaaattaatttaggttggaaatatgaacgtgcagttgacagtttacatttaacctgaaaactctatccgttcacccaaggctaagaaaaattcgtttgagctaatcaagttagaagaatataaattttcagcaagcctaatctgtaatactgactgaaactcgggtaaccaatctatcataatttaagagattaatataaaaaatcaattaaaaaatttaacctgtacacaaatgcaaggaaaagttaacctggcaactactatgaataaaattttcattgcaaatggccttataagttaatcaggacaaagacaagctgaataatctaatccattgaaaaaaattccacagttatcaaattttatattgttatgatgtaacagtagcaatataaaacctgttaaggtggtttgggcatgtacaaagaaggcctccaaaggtgctagttagaagagtaaattgtatgatttttagattagggaaaaggagaagagggaaaccaaaaaggacgttggaggaaatcaccaaaggagatctaaggcttaataatagttctgaaactttgattttaattttgtcgaatgacgttatgtgattcatgtaactgacctcacctagtgggataagactttgtttttgttgtacacttgtagtagtaacaactaatatcattcatttattgttttttattagaaaaagagagatataaatcataagattaaagtaggaaaaatgaaatggaagagtaccctgagttatctgtgataaaaaagtaccactcaaacaaaattttactacacaactataaaacttgtgatgttatatggaacaaaatgttgggtggtaaaaaacaaacgagagaataaactcaatgtagcagaattgagagttagactctttgcatatgcaagggtaaaactgagtacaatatctctctcccttcccttagcatagcgaggaacctctcgacaatgaggtacgtagtttttttagcagaaatgagaatgttgagttggatgagatgacatactagacaagataggattataatagtattgggggaaaacttggggtagcacctattgtagaaaagatcatacaatcttgtcttaggtagtttggtcatgtatgagaagacctatagaagcccaataaggagagtatatcagatgggtagttagaggtagaggaagcccaataaaaatagtttgtctgtttgtgtataaatatcatttacaacaaaacactatcatcgtttaattcatgcagctaataccacctagtgggaaaaaatgttgctcctctttatgatagctttattcagcagaacttacaatagtttgaagaggaaaaagtagagtgatggaaccaattagttgataggataaataataacaggcgttacctcaacatggaggagatataaatctgaatccagaatcaggttttgtcccacatgaaatatccatcgtggtacaattttgtccatccacaatccaaagtttcttgggaagcaccatatcaatctgcttttaccaggactaaccggaacacaaacgaagattaaacacattttcttcttagctgatgatttctgcattaagtgtaacacaaattatacccttagaaatactgcctgcatattgtttctgatctaaaaatagcatctactcaatattttacgttagtttcaccagatgaggcaggttgatctggaggatacacataaaaaatgcatggtggcataaatttgcttttggcccaagcctgatctgctgaaaaaccattgatatctaacttttcaatagacatgtcaagtggcctgcccccttctctatcagctttcactgttattaagctctacatatgtaagtgtcatatataagtaaatagaaatttaattaagttaaaaaagatataccttatatgcctaccttttggttgctgagtacgcattagtccatagtgtgcatatggaacatgtgcagggtccataagattttccatcagtacttcatacctaaaattgcatattcattttgttagaaagatcaaagatacactaagtggggaatgtggttttcgcccccaggatgcaaattctatgcataacgtcatgcttgtgttttcatcttccagaatcagctaaataattagaccaattaccaatcacaaaaaaataaagaaaaaaataatagttcagtagcttcaggtaaaagaaagtgagccacgtacagatgtgtagttctacaacacaggaaagatcttaatagtctaaaatcatacccataaggaatgtctctgtttcccattaatttagtatacgatggatcatccatttctggtatgaatgggggtctttttcttgtaataatatctttgtattgaggatcagtatttggccagaaccacaagatatcattctgcacagtacttgggtaagcagctacacatgcttttttggacgtatgtacctacacattttttttagcaaactttaatgagcatcagattgtcccattgtatgaagaaacttggaagcatttaaaatttttgaaaataaaattggttaaaggaaactccaactttgggtcatatgtgacttacctcctgagtttcataagggtcacaaaacctgctcattatttactaaatgggcaaaagaccccattcaacaaagtaccaacatacattcatctggctaatggataaagtataaaaaaactcaaattttgagttgggtgtgatttacctgagtttctaaaagggttaaaaaaattcaggtgtaggagtcatgtactgacttacccaattggacctcacaaagcacaaaactaaaccatgtactataactgactatgtaccaagttggatttgcttttttgaaacatgagaagttttgtattgtgtcagttgcttaacttttgtattctgtaagttgtctatatactattaactgagtatgaatgttgtacgttgactttcctaagtacaagtcaacttctggtcatggtaagtggataagtcgacttatgtaagactagattgtcacacatcaagtaaagaatagatggaaactcttaaacttgggaggtgtaactcataccttttccattaagaaagccatgaaaaacaaattacaagtctacaacataacttcacatcaacaaaaagaggaggaagaggtggccatgagtgacatgcataggggtcaagagtagtttgaagcattggtgagatctagaaccaatgaacttagagagaaagtacgccaccagccactcacaagccactaatgttccacgcatcaacataatatgatctcaccttcaatattgcacgtttcagaacatgaaatcatgatgacaagctaaaattcatggccaggaaatgagtaaatggtacatgcaaatcataatcttttgattgaaaaaaaggctgaaaagtctgcattttcatatgcgttctggctacttactacacaggaaatgaaacatacaaaaaaaatagtgaatttgggagccatattacaacaacatgcattaactacaaattatgaccaagagtaattaccggagggccatcagggagtgcctgaggaatgagctggcattctcctttgccattgaaacaccaaccatggtacacacactgcaacctgccccattgatcaatccttccatcagacaagggtgctaatctatgaggacaagcatcatcgtgaacctgccaagcaccctcattcctatcccaccacacaaccacatcaattcccagcaccctcttcccatgtggcttcctcttgtcaaggtcacaaattggcatcaaagggtaccactgagagtaccagtcaaatttctctgcatgactttcaaattctggctcaacctcaggttggttactggattctgtcaatggagtgggtgacaaggcagttaaaagcttggattttgaactgcccctgagaaaaaccaatgaaactggtgaagccactaggttgctcaagaatatagatttcctaaatgactttgatgtttcatgtgctgttgggatgtgaagtgccccaacagaaaaagcacacacagcttccatgttcctttctgctaaccaaaaggaacaagagtacaacaagagaggagagtggcaacacacaatgaacaccccaaagttatatgcttcaactcaaaactagaggctcacgttttacgttcatttttatctgatgctcaaatttaaggggaagtccatgtgattccagttgtcaccatcaaccaagtgattttggctttgtaataaggaccttatcgctttgtggcatttcatgaaatgatcacaaagccacgtgggtgattaggagcttggagctatgaatggacaagaacaaacgaaggactgtaatcaaatcacctctatggtaaaaactaaaaacttacaaaataaactgcagaattctgatacgattttttccaaattgactactacttgccgtttaggcccgtggaaaaagtttaaccaaccaaaatgcttgttgttctttcgaattttattttattttctttcatattaattttttattttaaaaatatagacaaaagaaacccggctgggatactagttccagttcctttacagcccattccaaattgctccaccctcttattttgggcctttgatcctcctcaatcaattgaaagtaaagaaaaaagaaagagaaaaaaaagaacattaaaataaaacaagagattctgcagcttccatgatcctctgatgatcccgtgtgagtgttgatgagaaaacaaaggatagagggatatctgtttcagtttgaaacttcaacatctcttcttcacagtcttagttctttctagtttatctcttctgttgttgttagaacgacccaacacaacattacacatttcacacagatctggtccctttttggtcactgtcaacagaaccatcccttctttcaccaccgccaggtaccaatttcttctcgttttcctcaattacttcattcacaatttacacctgatagtgatgccccaactcgttactcctcttcccattatttttgtggttgtatgcatctgcgctctcctcaccgacactatactattcttaatattcatttgggtctcgccctattctttttctccctttctgtccctctttttttcgctcaaagttttggtttttaaatttgtcctggttgaatattttcaaggaacttatggggtaattagttgctgttggatcagtttttttttttttttttcctcttttcgttctctttatcagttttgcttttgataactgtgtgtgcatcttttctgatttttagtctcatgggttatgccaaaatgtcatctttttttttttttgttatgcaatggcagtgatgataacatgaagaaagaatcagatatggagggtgatcttcaaaggtctctatctttgcgcctaaatcgtagaggagatcgaagtagtcaaaattctgctaaaggttaggaaggactgttatacactgttttggttcttttatctgctgagaaatatctcttttgtttctttactagattatataacagtgaaggaaatagttactttggccttggcaaataaaatctgtttgttggtgatgcagattttgaggtgggtttcttttcttcagggagggtacctcaagattaccccatgaagatcgtttggaagaaagggtttgttcggttggttcttgtagcagggatcttgtggatgttattaattcttcttgcattgttgttccatatatggtcttgtcaaacttccgtctcctttttatcaggttagtaaagtttttaataaatttcgttacttttttgaaatcttcttaagtttatctcttgttgataactactacttaattgtaataagtaataacatagacacttcatctaactgtatattctcaatgtgatattttgagaattgggttgaagggaataaatctcgttgctttatattttaacttgatcttcgtagctgcctgtgcccgttgattttagttgttcctggtactagaaaaccaacatgtacaggaagtttcttgcaattcatagatgatggcttttaaaaagaacagtttggaaattcatttttcactatagataaggttaagtcttatgtctctttctctttcatactcataagttcaactcgtagcttaattctttagaagtatttactgtggaattagaaggttagcaactctttattttctagttgaaataagaatagtataatatttctaggcatagagggaaagctctgacgcttggtgaccagttggtcataggtttgaattctgaaacaaactctttgcatatgcaaggataaggctgtatacaatagtcctctcccatactttcgtatagaagccttctggtgcgggggtacgttagttagtataatatatcttagtacagaaaattgaatttaatgtgatgttttcttgttaattattgtttttctttgatggtatttgtaaggggaactaggacttcacttgtcttaattttatctatattaagttagttgaaactaactttgtaaatacaaatatctacaatctgattagtgaatatagatgcaaagttgctatgattagaatttacaaatgtaggatgataacttgatgggaggttctgttaggtagacatacttcaagaaatgcttgttcattataaacattttgtcttttattttattttttccaccaaaattgtcaacatttctgaaaatatagcaattttctgcttgacctgcagctatgtgtaacaaagatagcaaggtttacaacatgttaggcaatatgggacttgtatcaaaacctcacagtaagattttggtggttttgcttccatcccttctttttgaacttcaccaaatgataactgtgtgtttgatattggtgctgcctatgttcgttaggatgtccaattcctctttccaatgaccctgataaaatagttatcccaactggaacaactcccaacaaaattctcaaaaatctgtcatatgttatggaagatgaggttccacatagtgaagctcagtcatctcctctatttggaggccatccaagttggaaacaaagggaggaaagtttcaaactaaaatcaaatatgaaggtagattagttagcatgatttgctcaagttcattttaatctcaattgcttcacaattttgcaagattgcgtcgtagttgccataatcaacaagtcatgttttcccatgtgctctgcccattaggtgcattgtggattcattcgaggtggtggtgctgaaatgaatcatgtagacatcaaatatgtcaagaaatgcaaatttgttgttgcatctggcatttttgatggctatgatttacctcatcaaccatcaaatataagccttcgctcaaaggagcttttttgctttcttatggtggtggatgaggtatctctgaaattcatgagggaaaatggtactgtcaaagaagacggagctggtggaaaatgggtgggaatatggcgacttattcttcttaagcatcctccttatgatgaaccaagaaggaatgggaaggttcccaaaattttaacccacaggttgttccctcaagcacagtatagtatttggattgatggtaaaatggagctgatagtagatccactgctaatccttgataggtacttatatctgtttaaatgttttatccctaattttatgataacatcaacactttaaatctttgtttttttggatagatatttaaactgccatccttttcttactcaagagagcttagaaggataggagggaaaggcatttgataattttgaatttgatacatttcatgtactgatcagtcacttacactaaaaacattatggggcactctgtttgaaggactcaatttaatggatttttttgctttcccatttttctcttacatagtctttatatatttacaatcatgaagttgatgcattatagaagcaaagtattggtttggtagggacttgcttgtcacgtgtttctggattttcttttgggataacagttgattgtatcatgttaggtttctatgttgccccttgtgatgtagttttgacactaacctcccctcgtctcttctcaaacaaatgaaaatggtacttgaaactgataaggctaaaactttctagcagaatggatagcttttttcttgattcctggagttacttcccttgcgtttatttgcacatgacactttcataccctgtgttgtgtaacggcatatttaattccttttgaaagcactaattcatacaattatacataccacgagggatattaatgtaaaaatataaaacgggataactttgaatgaatattctatttcaaccagcaggagaaaccacactgaaactattgttataaactcacccattgaagtttcatgttaagagcatacttactacatctgtattgttgaaaaaactgctgatcatgtctgtgcaagcctttctgtgacttgtgatgactgtaaccttgtaaaactaccttaattatgcagatacctatggcgaggcaagcatacgtttgccattgctcaacacaagcatcaccgtagtatatatgaggaggctgattcaaacaagaggcgaaagtgatatgctcgaccccttattgatctccacattaaaatctattattatgagggaatgaagccatggaattcaaataaaaagaccaatagtggtaagacaggaaacaagacctctggttttatattttatttctacggtttgatttcaacaattttggtaagaggaaacatattgttttgtcacatttctgttaattttctaattttgttcatatttgttccatatacaacaataacaacaatagccgtatttcaatagatgatgttgactacatgtatcacatgatgttactgggctctttaaaaacagatttctgagggatattatgagctgtataattatgtaaccgttaaccattgtattttttactctaattataaatgaaactatctgctgtatagttaagacacatggattcattcaaatgttctcttgttcctctctaatgataatgtttggtgatgcgtattgttaacaataatatatgatgtttcagatgtaccagagggagctgtcatcattcgggaacatactgccataaataacttatttagctgcttgtggttcaatgaggttcacctcttcactcccagagatcaactgagttttggctatgttgcatacagattgggggacgcgttcaaattctttatgtttcccaactgtgaatacaattcactgtttgtgttgcatcctcacacaagagagcactcttctcccatagaatgggttaaacagttggatgaacttaagaaaggcaatttaaaagaaagtaggggaggactaggcttgtttaccccttatcctggggatcttgattctgttgttctgccaaatgtaacaagaacatcaaaagcaggctgacattttgattattgttttaacatattcattttgttatgtattttttttcaagaacttcttgatgcttattttgtttaatcttaatgaaagtaaagataaggcgcctttatatcgttccacgagcctttgagacataacttctgagttgtttggtaatagtattagtatggtagaatagatccatttgcatcttttccatctaatactcttcattaatcttcatttcttagtgttgttaaagtagtatagcttaaatgattttaggatatttgctagtccactgacatttgatattgctcctgattgtatcaatgtcttgattattaatgaatgatataagtattttgcagtgtaaaaaaaaggttcaatattcttgtcatagtctaatattttttgttttaatcttcagtaaaaaaaaaaatgcaaatgagaggaaatcaactgatctcgcctctctggtctctaaagataactagagtgtcccatacgaaatatttaagagaaacaaatttattttcctttttcttttccacgacactttacatgctccatttcatgcttttttcccctcagcacaggagctagttcgatggtcccttgttgccttttattgttgtgttggtgcttattatactattggtcggtggtctcctacctcttagatttgttcttgttgtattgtgctttgtgttgtttagttgaagaataaagcatcttatcacatttttagaataagggaaaatgtgttgtctgttcaagtattctcgacgagattaggaaaatgtttaccaaattattgttggaaaataaaaaaataaaaagaacctagggcgtttagaagacacaggaaatgaagatgctaatacaaaggggaaaatagactcgtcattaaatgaagatgctaaaagataatgaatgatatctttcaagaaataagcaaatgcatacatggtggaactgcacattaccatttaatttgctcggatcttaagttctatctttgttgtcattaattaatgttaaaaagaaaattaatctggtaaaaaaatgttaaaagatattaaagaatagatagatattccaaaccacctacttattataaggtaagattttctttatgaataaaacaaatgataacaaataaaaaaagtttaaaaaaatacaggtgagcgagatatgagattgcagtttgacatgtgatggtaggacaaaaaagaaagagatatcacttgctaattttcttattgacaattcaggtaaaaatattttcttaaaatctattgaaattaatgcaattaaaggtatcaagccaatgtttgaattattagatacatggtacaagaaattggatatgacaacgtaatgcaagatatgaaaattgaaaaatgatgcttctaatcttgtggtaataaaaagaaaaaatgttagaaaaatagtctatccctaaaatttagatgaaaaacaaacaaaaataattagaaaaatattttgtggttgctttgagcatgcaaggaatcattaaattcaaataaaacgattgcatttaaccaaatcctccaataaaacgaagttaaatgatagtttgaagtatccccataatggatagcagaagtaaacatttgtaattatatgaaacagaagtatctattgccattcatcattggtggttgtttgtcgaccatctttgatcacgccagcgtaattgacgaccaggaaaccttccacttccagatgaagaaatgttgctctggggattagtctgagtaccttgtgaggcccgaggcatccttgttgaagatgtgacctctgcactgaggtctctataaaactgatgctcattgcgaggcattctaaaagatgacatatttgttctccatctagcagtacgatttgcctctgcctcaagattaagggatgataaatatggaaaattggttctcactctactcctagcaattctctccagttgatgcattgaaggtaaattggatctccatcgagctgattgatttgtctgtgtatcatttgataccctgtgtgttgtaccagaccttctgtcatataatggcactctgtgtcttgaattagtcaaaaaactagccatacggttaacatcttcaatagagataaatatttcatacaagaacgaggacatcaagtcagcaagacccccagtcaaaatggtatctctattgtaatctgcaacagaacttgaatggattgagctaaaaagatcttccaagcccctttcttgttccatccttatccaatcacactgtcgcgagggatccacctctgatggtcgaacagaaggatgttcagacctagcatgcttcctgagttctggatatgtcccctggaattcacatgtttcagaagaacaactccttagtttagaattcatataccttcgagcaggctccaaaaccatatatccatatatttctccacggcaaaaagggcaaatgagctttgattgtaactggctcccacattgagtggggtgccgagactctgactgaatttctctactgtgagagactctgcctgtgacaggaatttcttgcagtacttctgatgagagatgagaagcaaaggacttacaaaactggtcaaggcagttggagtggcggtaactggtattgcacatgtaagtaagacaacccttctcataggaagaacatttcaaaagaacactattatgagggggttccatgcaaataggacatctagcttcctcccattcttttatttcatcagctgatcccaacaaatttataggtttatgcagctcaatgtttttggagttggatgggtaaggatatggtctattacaatcagtagacggggacttcaatcttctaactttaggcattttgaaattcaagatgctgctaaaaacaagatctgccttatttcaagcaaccaaaattaaacggattacgtaatgaaatagaaattctctgcctctttatcctgacacaatttgtatacaagaaaagagtaactgattcttgtatctattcacaaatattgaggttttgaagatttcattaacctagcaatctagcatagttgacgattgcataaaaagtttataaatttaaaagaaatgagaaggcacaggaagcactagaacataatgcagaattgagtttctagtaatcatggatcaagaagttcaagctgttaatttttcttataaatagaatttagatatcaacaatttatacatgcctatataattctgacatattccataaacaggaataaatagtacattaaaaattataaacataacatgcactttctttggacacttttattgacaattacaaaatttcaaattaattaaaacagatggaagaacttcattttgattaataaatacttaaaatctaatggcattgtgtcacctgaaggagacatataagcactagaaaaaaacatcaatccacaaggaaaaaacccataaacattcctgtatttcacccataaatctttttgccttgtaaggaggggtaagttcaattttttattaaaatagcaaagtgtacttaaatattttgagatttgatatgtactacagatatctactgctgctgcaagtctcaacaaaagcctgaaaacttaatttcacaaggtactcacatgcatgacacaaggtaatgaaggtatttatctgtggggaagaaaaccaaaactcaaaacatattagacagctatcaactttcactttgctagtgacagaataataaactcaaaacaaaaggaaaatatagatcactgtttattaaaaaaaaaaaaaaaaaaaacataaacaatactcagcatttaaaaagaaaaacctctgcagacccctataaaactattattagatataatattatatttggaatgatctagttattgatctatcatagcaaacacaggaaaaagctatcaacgccaacaaggaaaggctgtgaaactaaacatgtgttggaaattcaagtttgttcaaagttccacattagttaagaatgggctagatgaaggtaacataagggaacagaccaatatacccaattccctaaggttttgggtgaaaatgtgatgccaagttcactcttgtagttcattgctaggcccaatggtgcaggtcttctttgctttcaggctcccctggaccccaacaagatgctgtatcaattttggctggttcctctcttagaggcttttccttgcctttacaacctctctacagtgcatgacacacccataaaaaaaagtattttattcagagtcatattttatcttgagattttcagtttgatagatgcttgagttatagagaaactggtccgtgtagatgaagttaaaggcaaaagctccctacaggcactggggatttttaatacctcaaagcaagaggtgccacaaacccttaactacattaagtgaattaaaacccctttagtctttattggattctataaatttctcacttctcactcaaccaactctagtaggaaagtttgaactttggattctgcttacctgtaaaataattttgtttaacttcggacactctagtctcttaaccccccaaaagttcactcttgaaaaatacagacagaaatggataactctctctaaggtcaagtcctttgttttgaggcaacagtactcaacaggattaatacaagtgatttgctgcataagtgggaggcatcgatcgctctttatcagacacgcatgttctcccaaacaatttactctttcaacataagaaggttacttccaatgaaacaccatttttctaatttttagggcccttggcaatcactgggtgcgtctattccttctacttcggagtagttttaggttttttgctataaagaattaggcatataaataaacaagtgccgtctttaacaatcagcccctaatagtctaacacctccaagaacaaagcaacggcttaaaaatcttgtccttcacaatgcagtacaccttacgaagaaacagaatttgacaaaaaaaaaaaacgctttcaaaaatgtttcacgattgcatgcagtgttgcaattgaattgatcactaatcaggaagttatttaaacacacacacacacacaaacaacacagcaatttgtttagcagaaagcatgaaaccaagcgatgacctaatttgtttaggcagcaagacaaataaattggatattgaacgagaacgtgatgaggaaaaagaataataattgaaagagggagaatacaagaattagggttaacctggaaagtggcgcagtgggattgcaacgaatagagatgaggatttgcgatcaacacgagcaaaataaaaaagggctggttggttggttcgttattggaattgagggattcgatgtaaattgagttcaatcgtagtcttccgtcgctatatcctcagtttcgcttaaatttcatctgctggctccctcttttttaatcacaaaaatattcttaattatttaacttacattacatcgtactcaatcttaaatataatttaataatttaataaaaaaatacttttatcttcttcttaacttaaaaatatttaaagactattatttctttttattctttctgtaattaaaaataaattcatctttttgttggatgtaaactcacattattgatacacactattaacactttttcttcttcttcaatttttcattcatatattcattcacaatttcacttacaagttcatttacattttcactcacatataggtttcaaaactcatcatttgttatattaacatacatatgaatataaactgaattttaattcttaacaaacattttcagcatgtcatgatcagtcttaaggggaaaaaatttaccactaacaatagaacaaaaccataaaataagagggtgacatgatgacaagtattagtcattagcaatgttggtcacacaattatgtgcatcaaacattccaaacttatcatgatcaacattacatatttcacttagttcatctcgttagtccgtaaagtggaccaaaatattcacgttgtctagtttaggactcatgtattccagttcattcattgtgttcatgtggtctcaaacatcaacactattttaatcaacaataataaacaatcagttcatccattgtgtttcttgtggtcccaaacatcaacatcattttatcaacaataataaataaatgattttgaaaattataagtggtcccaaaatggtcccccattgaaatcccattcattaataggcaataataaacaatcaatattaaataaataaccttaaaaagtaacatatatacaaggtcaagtgtcacagacaaacataactctagcatgaacagaaatcatggaacagaaagagaaacacagcgctcgtgaatgtcgaaagaagacaaatgaagatgtttgtgaagatagaacgggaagaggaacaatagagaactcgtgaactagaagagaaatactaaagaactcgcaaacggtaaagaggagtggaacgtgaacatcgtgagaggaaaagaaactcgcactctggacgatgaagaaaaactcaccaacaagtagaagatgaatagtactcatgaatgatgaaaaggaataagacttgaaccatgaattctgaaactaattgggaagggataatttgggttttacaattaaaatgtaaagacaatttcgtcttctcacatattttaatttaccttagttaactacattaataatggggtaaaagtaatgtgaaaaaagagagggtgtcaaactaaatttgagcaaaacacatggggtacaaatgtaatttactctttgatctttgtccttatctttataaaataaagataaataaataaatattatataatcttatttaaaaaatattttgacaaactaagtaatataatgaaactatagtgattaattttttattttgtgacattaatatgggagtttaatataactacattaacattgtaaacttgttttatattatcattcaatcataaattattttaagataattatttttaaaattaataaatttattatgcataataagttaagattaaataactacaaaaatattttatgttgttagtgcatatataattccttttctcttaatataatgaagaaaaaaatattaaataacttatgtttgaaatcgaaaaaagtaccaatttatccaaaaagaaaaaaatgtacaaataaacatgtaattttttttattaaatccaaaataatacataacaaaaaaacatacctataaacatgcatttttacctcttgtaacaaaatatatacatataagcatgcattaaacaaataataataataatttaaaattaatatacatgtcaaaatataataagaaaaattatagccttatatcaagtttagcatcttacccaaaaaaataaataatgcaaacacataacaaaaggaaaaaaaaaaaaaaaaggttagggtcatgagcatggcaaaaaccatcacgtaatggcagtgatattcgtggattagattgaattaattttggaaaaaaaaatcattcaattcaatttttttattttcttaatttatcattcaaatgatttaatttcaacttttaatccaatccaatccaatttaaagtgttttggattagattgattttcaattataatcatacttttatttattttttagaaaaacattaaataaaatataagatatataataaatataataaaaaataatttaaaatatcaaacatctatttatgtgttattgtataactaataatagaatatttaagcatcttcctcaaataatcagtaaaacatttttaattaattataaatttcataaattgatataatttctatgataattttataaatttataagatataaaaataaatgatattataaatgtatgaataaaaatatatacatatgcataagttaaatttgaatcaatttttaaaatcaaatccaaaatccaatttgatttaataaaaaacatcgattttcaactttgttgatccttcaattttttacttttttggattaattttttcgatccttattggattggatcgtttatatacacccgtatgtaataatgtcttctcatttatttttttcaaaatgctaactttgatatattataaaaatttctttatatattgttgtgtcgatatgtttacgtatgtactgcattaaatttgacacattgtaactatttatttttatcactcatttatgtgtatatttttaggcaagacattaagtttgatatattgtaataaattttcttattatacattgacatctgtattaattttagtttattaatttattttttactcaatatgtattttccattttgcataaattaaaattataataaaaatgcaagtataaacacattagtgtctatgtttttaattagtataattaaatttatgataaaataaatattgtcaaagaagcttattcatttgttatcttttttatttattttttcttatcaattagaagcgtactaattaaaattttcctagtttggtcgtttcttctttttctcttatgttcttaaaaataaataaataattcatggactcttctcaatttaatatagtctgcatatcccctaaattactgggcttgtctaatcatgaaaaatgtttttcaacttcagattagctaatttgacttataggtaacccctacaatttttgttattggccattacaaacgtgagaaaatattatcttaccctccccccttctttcccttcaccttcttttcaccccattcaacccataaccaccacatcacgcagcgcgccaccacctttgtccagctttgaacccagcaaccctgataccattgcaacatcgtcatgcaccgctcattgccccaacagtagatctgtgcacgtgaccccttggcaaaaccaccaccacatagttgcaacatcgtgcgaacccttgaccttgcacctctgtccataatgctacgcattctcgttgtcaccgtgaccaaacacctttgatctacaccaatctagacccatcgacctagatattccccaccattcatcacccctacgtgcaaaggaaaaagaagaaagaaatgggcaatgaaagcttagttatgtttttgggttaaaaaaaaatagattcacaattccgttattatttttttcaccccctcataaagtaacaaaactatgatttcattatacaacataccacgaaatggtgttttagttgtttttattttcacacttgttcagaaaacaacataaacacaatttttctataaaattacaaatgtataatagaatcatatttatgtgaaaagaatattttagagaaaaaaaaaggcgtcaaccctttgatagaaaccgataacaaaaggagttgggtttaactagttaaatatctcgttttctatctatacatgcaatgaaaccaactatacctattatatatattttttttccacaatatataggtatatgtgggaagtctcattttgataacgtaaacttagatattacttttaagacaaaaattatcaatcttattataatatatatatatatatatatattaatttgtgattagatgataatataatatatattttaattaaattcatatataagtttaatcattgaatatctcactttttttatctaaaattaagtgccaaatttaatactatatatacatcacgccaatattgacaaattagggggagccaaattttggttctcaatcaaagaaagcaatcattaatacagggttgcgaattgagtacatgtttagcataaagtaattaataattgttattttgtttatatgcttgaaaatttgtgctaacggaaaatcaaatacgctttgaatccgtgataactatcagcaatagcattatttgtccaccaccattgatttgaagttagttcattctataagatagtagtgcttcattcaaatttatccttattttctcattttatatacctattttaaaagagataaatccaaatttgttgatcatatcctctaacagtgaaatttgaccgaaaaaaggccacgagataccaaaacatcagaaaagaaaaattgaactactatttttaatagctaaaaagtagtaataagggaaccagagaaatcaatgttcagagaatatgcaccacaaaagaagattgccacgagtctaaaagaaaattcattttcatcataatatttcaatatattcaatctaatatattaattaaatcttacatattgacccgtctacaacacgggctatccttgctagttaagtttgaacagaaagattaacgtgcaccaagcaatgcaaggaaaaagatagtcacttttcatcataatggttgcaattatatttcatcattttgcacatactaatggatagatagatagtgtcatgcacagcatggaatgcgaagcttaataagcccaactagacaataccaatttgaacagtgggttttatattatttttttcaaaacattataataagccaatcttaaatatataaatacttcccgatttcaattagcatatgaagattttgggactttgtcaactaaattgctgaaaaaatcgaatattaatgaagtcattaagcactttgtacataaactcttatgattagttctcgatcattcttctgttttcaggataaattctacctattgtgcctcataaaaataacaaatgggttggtggattattatcttatcttcataaagattttgataagaatttatgttatattgttaaagattttctttattccccaaactaaatacaaataaaaataaacaaattagcaaaaacaagattcataagagggcaaaagaacctaaataatatttcttttctaaactaggatgtccgattcttctcctctcaattttgagcgcgtggccaccggtttcgcctcaatcggacatcccaatcaaaagttatgatttttcaaagtttatatttacatcgcgccacttgtgcctgaaacacgccccatgcaagcgcgtctggctgcaccattttggtaaataagtttgaaacagccctatattggtaaataattggaaaaaaatattatttaaatttttttgccttcatcaaatagacctttggtttccctgaaaaattaaaccattgtagatatttaagtccaaatatgtcctcagccgcataacaaaaaataatgtggattagacttaaatttcagtgagaaaaggataatataaacctgcatcatcaataaaccttcaatatattaactataaatagatatatttgaattgaacccatgaacttgttgcatggtggaagatcaaatgtttcctttgtattgggaggataaataaatcccaaaataattttacacttctgagttttgatcctataatactatacatgagtgaaaaaaaaatgcctgtgtgcatcaatggaaagaataacaaaaatacatatattaattggttacctattgacacaaaaaagaataaaacaatggagaatcctattcactcatgaactatgaataactggtatcactgatgatcctctgatcaaaggggagcattctgatcttgaactattggactcacctctatgaggcatgtgaagtggttcaattgttaagtccccagacagacttgctacatttgaaagactagagctcaacaaagtggtgcttctaggagcaaaggatgatttagagcgggatccacttcttggagacagattaacttgctccaaagctcggaactgaagctcacaagggtagtctctcacacagccaatgcgtggccccgctccggttgtccatttgcaagacaactgcttccccagttgatatgatttcatttctttatgtgaattgattctttttagtatggactcttgtggaatggtttctacatcattgtcatcagataagtttttctctgaatttgtatggtccagctctggtacaaatgcttgttttgtttcttgagattccatttggatactcacacagctttggtcactcccttctatctcattttctagtccttcaaacacatgacccctttttggtatttctagattgctcagttctcttccaagaatttgaaattgccttgtgcaaggtgccatcagtgcagaagacctctcggtttcgatcaaattggccttctctgctgcaactgagccttcaataatggtctcttcaatctccaggccattcatgttctcagtgaagtcctcttcagatgagtggcttctaagatgaccactacttcttagagaaagcaagtcatcagcctcatcaactggatccatctgcatataacaaaatgaatttcctcagaatatattgtttcacatcttgtaattacagatctaaattataaaccattacaaacaatactaaagtaatgtaaagcaatggttctaagtatctataccttgacatctgaaaggctcacattgttctcctgaaggaatgaaataaattccttaaaattttcttctgtcggacgataatgaccactgtgaggccaaacagcctgttgaaaagaaacaacaaactcattttctgagcatataaaataaaaataaaaaaaaagtagtcatctatggctataagaatccagtaaaagagtaatatatttacaagccttatgccagatttgtaccttcaagacaccattttcaatcactagtctcccagcagaagatgtggctcctccagccaagaagctagaatgctgaaatgaaccttttgtcttcttgccaacatacaatgtcttagatgtgctaaggacaaaaatccacttggcatgtgcatcttctccagtgttaaggagctctcctgtctgcttgtagaagaactttccatcttccacaataacttcataagccagcctttccatctgtaagaacataaaatgaaaacagttaataacaattgaaatcaaagaatctccagcaaatttgtctatcaagagatgtttgtataaattgcggaaaccttaccggaccaagatatttaatgcactgctgttgaagtttggaacgagggcacttctcaagatttacttcttttccttctcctatatctaacctgcaatttcaaagaagcttaatttcaaacacatgtgacttaagatctatataggagaaatataagttgtaactcagaaatatattttacaaagaatgttaccagtagaaaaagggttctctgctctgacactgaagccacctatcgtaatagaagtgtagattatgtccatagcgatggcgtgggtcaatctatcacacagtaaaaaaaactcagtaagtaaaaattgatgaatgactaacagaccgatacataagcagaaaaaaaaaagctagagcagccatgtttgactaaccgcttcaagccagtgctgtaaagcaagtttttgagctttatcatcttttgataaaccttttccaacctgcaatgacagagcaaattttaattcagtttcttgcagcttgaaagtttgaactagcaaggtagagcatagtagttattgaaggtattaaccttcaataatcaccattattacccttccaaagctaattatgttaaagtaccttagcagctctagttctggctctagaccaacgcgaaaccgcggtttcatgtttctcaatctcaaagaaagatatggagctgcgcttgagttcagcaaaatccaagagcttccacctataaaattaaagattaaaacatgtcaaaaacacatgaaattttgtaaagaaggaaagagattctcaggcaaataaaaaaagtaccagctttgttcaacaagaattgcacaatctgctagctttcttctagtgcgaaagctcttgtatactttctgcaatttaagtgctgcaatgtgtttggggctgtttggatttagaagtgctgattggatggtttccacttgacactctgacttaaaaggaagataatccatttctttgctctttttgctagtccttgagataggcatgttttcctctttgtcaaatgacaaagtgttggttgagataatgttatcaatgtcctttcttttgaagctcacagatgcctctattgtcatctttccagaacctagagatttaaggatggtgggttctaaatcttcgttcttgaaactgaccgatcgcattggagttttgatttcatcattgccaaagttgatggattttacaacaacggagtctaagccatcttccacatcattgtacttggcaaatggacatgagaaggaaatccccatatgacagcaaaaccaatctgcagaaacttgtgcaatccgtggtcctgaaaattgcaaagtcaatattaaagtacaagatgatgaatttttcatgtgtcaaactggatggaatacgtacatcaatgctaagaacaataattcgaaatacaaaggttccaaagccatcaaattcagaccgtactcacatcacaaccacacaatttacatcaagataaatgaatgttggaaataaaaaaaaatagaaaaataaaattcttaagacccattttttagaatgcattgttctatttattatcatctaggcatgaacagcagcaccgtaatcctcatcgaactgatcaacaagaactcaaattctatgctgcagcaaaaccatcagaaacaaaaggatcacggatccgcaaaacccattagctaaactcccatttttaaagaaaaatccaagaaaacagtctcatatccatgaaaggagaacctgaaacacagtaccaaggaaatcccatttcattctcttaaacagattccaaacaaaccaaacaacagaaatcaaaatatcacagataatcccagttaaagaagagcaaggatctaaaaaataatcaccaaaacatgaataaaaaaatcatatttctttttcttcacggatatttagttagattgggtagaatagcatagcattcaaacattcagcacagtatgcaatatgcagaaatggatatacatatcatttattccataaaaagaaacaaacatattaaaatagattcttaaaagcaaaaggaaaatgaagagtgagttgatgaagggtggtagagtacctgaagattcgaaaaccaggaaggagaaaagagaagaatctgtaatggggttgatgagatgagaaaatcttaatggaacactgttactttgagttaatggtaagatatgatatgatatgatagtgtttgaaatgttggtgcaggaaaattgaactaagtagctaacttgcacttattaacaaagttaatgggatcctttgctattaatcacttaacatatttatacatgttaggaggagaagaataagatatgaagagaaagtgtgagataggaagtagagagagaaagaaacagtgtttccactttccaaccatgtggagtcgaacaagtatactcaaattccttttttttttttcttctgttttggttttgggattattttccctttatttttataaagaccatggtttggtatgtggcttctttaccaacagacccatgacatgacctgtacccttattttaatttcttttctttttttagaaactcaaattgttgattttattagttgtgaacttgtactcagtttttatgtatcgtttaaatttgaagtgagataatagttacaaaaaaatttaatttttagccttatttaaataataataatttcattatatgtactactaaattcacttctgacttatgtgtatgtccttaaaatcctttcaacagaaggttagattcatttgtcgcaaaaattaactaaaataaaatattaatacaaaaataaaaatgtcaaattaaactttcactctaaatacaataagagtagtgttaatctgcactcacactggcggatgcacgtggagggtgtgagggcaattatctcataagaattttttttttatttgtatatgcataataaaaaaaattgaccccaccaaaaaataggtattgtcttataagataactttttctaaaaaaatgaatctataaaatatagaaataaaattttcttttttaaaaaatgattgtggggcaattatccttttaatttccaggtttaattactatgtttgttatttaatttattttttcaatttgatcatttaatttattttttgattaaatttagttccatgattttagatggtactaataaattaggtgtttgtttttcgataaattaacaaattttattttaatctttaataaaattatttttgtgtttgagttccaaataaaacaaaaatatatattttttaatttttattattttgttttaatcctttatatatatatatattcatttttatctctataatatatatagatcatttgttattagtccttatcaaatgtttttcaaaagatttaatataaaatgaagaaattttgtaaggaataaaataaaaaaatagatatatattaaaaggactaaaacaaaataaacaaaactaaaaataaaattttaggtttatcagatatttaataaaaaattattaaagacgtaagatctgctaatttatttagaactaaaatcatatttaaattttttaaatcaaattaaaaaatttaaaaacaaattaaaattatttattttcctcactgataaaaatttctgcatccacactttctccactccaagagcatttgttaaagaatatgaaacataaaaacatctgataaattaagaatttgaaaaaatattactatcattttttacgtttacaaatgttcatttgttgatatttatttaattataaaatgaaatagaacttggtgaactttttctttcacgcgtacgcgtagcgcttaaatttggattcttcaaattatatataaaaaaagaattgggctagtcaaagagataaaattagtaaataaatcatattgtcgaaaagtactttgtatattcttggagttcaagtgtcgatccaatatcttaagcaatgtctctgtgtttggaaagtaggtatgagaaatgagataatctcttttaaaaaaaaatattactatttaactcatgttactttatatataaaaagaaaaatgagataatttcattcggtaaaaacaaaacaaaaactttgcactaacttatacaagtcttatctgtctacaacattacttaactgtttccgtaaattatcacttttaatatttcgttttttattttcaatactatttaacacatattactttataaaatgaaaatatttttatatgtatataaaaatgagaaaaaaatatataataaattaacttttatcccatgcaattaaatgtaaaatacaaattcatttttatagtgagactatcaaaattaaatgatgttaacttattttgttaattactatgaattaaattttttcgcttatatttgattttggagtatatttcggtctatcttatttagactttttttgtcaattaaacgtacacttttttgactgtccaattaagaaaataagcttcataatgttagtaaatttatatttgaagcattaagtgaacattaataatatttttttaaaataaaatcacattctttaacaatgaactttcaaggagaaatattataaatattattattttgtagatatccatcatttattagatttaatttgatctattagaatatggatatgatttaattactctttgtaatttaaaaggatattttataaaatcagagtttcttaattaatttttcttgtaattatcttttatttatttatattttttctctgaatttttctttctactttatatacgttttttctttcatctgcattctttgtataacattcacaaatagtttatttataaattattattgttaattattgatatgttttttagtattatattgtaacaattagtgtgtctattttattttttgggcgttttatgagttaatgtacataaaaaaataaaaaaagttatttgatttgacttgcggggatttttcttttataacatattaacctccaatgaaattgtggataattttctaggaaataatcctcgctttctagttcctcctttctatgaggggtcattttcatgaccatgtcttgaagtaaacttcaatccgttccaagtgagaacgagattgactttagcaaaatcaaccattaattccaaactgcttatgtcatctcagataattcctactccctcgaaggggtagtacgttacgtagtttaagtattttaaccaccaaacacttgtcaattattccaaagctaaccattaatttgcatatatctaattgaattcgtggcatatgaactttctgcctgctgtggctgatttggtaaagagtatataaggagctcattgctaacgaaaaatgttgcaattttttatatgttcattgcgtactgtaccttaaaaaagattgttaatttgaggtgcatacaaagttatcaatttgaaattgtgtttggggatgtgaaagctaaaaagttggaactttccttgtaatgagatcaggatgtcccacaggctctaaacttgaacttgtattgtatcattggcttattagtagcaacaaaaagtctttttgctagcaggccaaatagtcaaaagggatcaaccccatgttagctctttaaatacacagcatatattatctgtaagagaaaatattaaatgaataaaactttatctcacatggtgatgaattataattaattttgctatccttagtcctcactatattagaaattgtataaagtattgttacatttgttatttccacaaattttaaaaataggaggttaagaaaaataaattcatataatcaacaggaaattagttatagtttttttttattgcaatatcatcgtgatttgtgaatgtcattgtttgcaatatggtcatataatcgtaactgaattaaattataattatatatgattatggcatctttccatttaataattttttataataatatttatattttttgtaaaaaaaatctataatcaggcttattattattattattattattattattattattattattattattattattattattaaatccatttacaccgtttgattatcgttagcttgatgatttgccttttaagactttgtcccgtatagccctttacacttcatacggtatgttaagcatgggtacgtatgtgtaaagcatgtataatataaaacaaactaagtaatatttatgattactaatgttgcaaaatgcaatggtaaatagaacaaaaatgaagtgaaattcgttaaaatttaaagtatttactgaataagttaaactgacaagaattgttcatttatttaataattaataacaatattaatttattctaataaaaattataacaaacagtttatttgtaaaatattttatatgattacaagtctaaatgttttggcgtttttattaaataaaaaattactttttatagttatttaaaaaaatggaaaaaaaaacatttttaaaaaaactaaaccaagtatactatcaatttcctgccaaaattgaaattagacattggcattataataattgggtatgcaaacgtacggtgttggaaagtggtgtacagcatatgcataagttggtgagaagataatatataaatatataattaaactaactcttccctcttctgtttttttaatatgaaaattgaaaaggactgctttaggtggtaattaaggaaacatacgttaggaatctacgtgtttatgtttcatctttcggtcatttgatttattcttctgattcttttcctattttaaaaaattacaagtatatctatcaagccagcacatattaccatttcagattcaataaaaactatgtatgacgataattcaaaccacaagatctatatcttcaataaatgatcgagcgaggaacgttcacattcggcactgacacattaatctattttagtttaaagtagtttgaacgaatttaaattttaaaaataaacttaaattatcttttgatgaattagttcaatttgatccaaaattatatattgtttaaaatttatttttttattaacaattatatattattaatgaaatgtattgacttaattaatattttacataacatgatattatattcatattaatattatttattttaaaatatatattgtaaaatatattttaaatataattttatagcctaattatatttaatgttgaatataatacattatatatacaaattaaatttgtaggcccggatcaagacatattttaacataaataattttttataaaataaataaataaatagaataaaatagtaattactagtagaaattccatgcattaccttgatgatttaattatacgaaattttatgtataaaggaagaataacggttgaataaaagaaaaaggaagaataactgtgtcaatttgcacaattttgtagacaacataactctctataattgtctctcccgaatgtgatattcgatttaaataattgcattttgtacaaaaaaatcataaacaaatatgttttcatttctataaattattagcatatttaaaataaatttaaaaaacaatcattatagagtttataatgatgttttacgttgattgctttttctttttactgctatttaccttgattgttttgcttacaagtaacgacaaccaaaaaatggtactacattgtatatattaattaattttattaaaactatataaaatactatttccgtgagagtgagaaagagagtactacattcagtacattgtgtatacttatttatatgaatcaaatatttacacttttttaagaaataaatgctgataagaagcaaaataaatctataactaacagttattatattttaaaactaactaatgggcatgcaattgtgaagctagctagccttaaaaaatttgatatatatatatatatatatatatatatatattaggataaaatatactagacgttatgaagtctgaaccataataaaaggatttaataacattataattagatagttagtataatgaattactcctaaatcctaattgaactgaaccagcttagctttacaaatgaagaccattgattttaatccaatataggaatactttatatttccctcattgatcagtcattctcttccaaaccaaaatctaaaaaattcatagacatttgacatgcttccacgtgcatcactggagggaagggggtctcttatttatatttgaattttgtgtttaatccttgataaaaaaaaatttcatatttgcttcccaatatttgaaaattttgttttagatttatgttgtcagttaagtaattacgtgtccattaaatatttgataacgcgatttgtgatgactcaaaaatcgtcagtatttgtttcaaaacaaatattgtttaaataaaaaaaaaattcaactttttaaagggaaggtcctctcccccctccttttccgcgaccacctccttctttgtgtcgctgccttcaatcacttatgttttgtgtcgctgccttcaaccacttatgtgtcctctttgtctctgtcggtgttgatttgcagtgggcccccactccaccatcactgtggacttttgttgttgcattcgcatgtcctagatctcgaacgccaaattcccacacgtgccttcccctgttgtagttgggcatctgctcaagcataagaatcacgggatgaagctaagggaccttgcataaagccctaattaagatgttgaaagtggagacgtcgtgtgaaacagcgtcagagtggagcgttttgacgagcctgagcttgttggctttgacaaagaggctgagggcaaagttgttgaagcgcgtgtcaggtttgatggcgatgtcgcactccatgatgaggaagagggggtcgatttcgccgtgtaggtggtgggaggtggcataggtcttgaggaagatgagggcggtggactcgtcgatgaggattttggaggagtgcatttggcagaggaaggtgagcattgagtcgaaggagtcagtgcagtcgagttggcagaggagcacaggaagatggaggggtggatctagtagttgggctggaccgaggaagaggcaaaggaggtcgaggaactgggaaggggagaagtatggggaagggagtggtgggtgacagaagtagaagatgagagctagaaaaggaggattcacaatgtatgttttattcattttctaactttaattgattatgacggtttttaaccgtaaaaaaaataatttaattttttaacaaatattaatattttttaaaaaatcacaaattatgctatcaaatatttaactgatatattattacttaattgataataaagattaaaacaattttttaaaaatatcaagatgcagatgcggaaattttttttattaaaagatcaacgtaaaatctaaatatataccagaaataaaaaaatatatttaaataatttagaaaaagtatataccctgaatacacctgtaagtcaaaccgaaactaaggaaaactaagctaagccagtaagccaatttctttgcacttgtgtctgttcttaaaaggtaacgcagaatattttaagaataaactttatgcagaaatgaattttttattcaaattgaccaaaataataaaataaatttgaatgaaatcagaattattataaaatagatagatacgttttttctcttaaaaaaaagtagtgaaatgatgataattagattagatggacaaagcattgtcacttccaactgtcatatttcagatctccatgcatcgcgtacaagaggagtacatggatgtgcacgtgtcgaatgcagagtgggccacgctgcgctgccaccatcatttggtagcaccgtaccgttcccccagaccacaaaatctcgtcgccagtttctgctgtcccttttacattgtatcgtatgttttgctttgatgtaataagaaaatttgctttacgtacattgtattgtatgttactacgttactacgtgcgtgtttgaaaatcaggtgtaatatcttatgttttgttcggtgggggaaaaatagtgaaaaaaataagtcagaaataaaaagataaatgtgtttatgagagaagagatgacaaagatataaatttaaaaatctgaaacttgttatttttaacctgttttgttcatttatttacatgcatctgtttttatttttttcttaaatcaaatatctttatcttcacattattttttacttatcctagtttatcatttttttttcgttcaccctaaaattttctttcatgtattttcaagtatgattgaaaatcatggtaagagtaaaacaaccaaacgccaatcttaaacacaatgtatgttgtgtataaaaaacacaatgtatgttttgtttagagtcttatatgtaacctgaaaataaaaaattattttttaaaatgttagtttaagaaatgaaagaaaaatgtttgttttaaatattattatttaaatataaaattttaattttatacattttcagtataatttttttacaccattaattaatttaaaattatcatatatataattattataaaaatcaatcatttcattatatttgataattaattattcaatgtaattgtattttaattaaatttttaatataatgttaataaatgtataactagacaaattaatcatcttaaatgttttgtccttactacgggaaggaaaagaaagtagaacaaaaataaaacgaggataattatttaaatttttgtttagttaaagagcaaatgaagaagaagaagaagaaaaaaaataatttaaaaataaatctggtcccaaaaaaaaggataaatcactaatttagtctataagattataatgattgtttaaattggtcccaaaaattaataaataataaaatagtctctaaaattgaaattgttgattaatttaatctctgaaattgtaatgatcaatcaactcggggtctcaatttttttaaaagaaaaactgaaaaataatccctaataatataaatcaacaaccaaattaatgtctccattattaatggggtcagcttcgcgtctttttaaaaaaaaaaaaaaactaaattagcatgcatgttaagtgtctaactagtagccgattaggacacatacatgcatggttatcatatcatatggatgaaattgaaaaaaaaattagttgtgaggagttgggtaaatgcatgaaaacttaagtttgattttcatttctgttattgtataaaaaaaactttaaattcaatatgaatttaaattatattttaattaaattcaaactaatataaaataaaatatccatggtaataaaaggtgtctatatatatatatatatatatatatatatatatattttcaaatcatcatcattaattaataatgatataaatatagataattaaaaatgaaatttttgatatataatttcatatataattttaaattaataataataaataatttttaaaaaattatcaccattgaattatttatattagtttaattatatattacttattgaattatttccatatataattaaacttatatataaatatatcaaatatccattttaatatataaaagataaaatttccaccaattcattttttacatataattataatttattcgaaaaactgctcattattgattgttttttattctcatcttacaaaagacatgaaatagattgataaatcatacatgcgtaccacttatttttcttaatgaataaatcaggagtaaatacgtaatactgatcaatatactagttacatataagtagttgtcgcacataaaattaagaatagaaactatagcatataggaatgtgaggtaaggaatgagaacacatataacggtgacgtcgtatagaggatgggattttaagatgaggaataaaagcacataaagaatcggccaccaaacgagaacgtagctgtagtgcatgtttctcaattaaataatgccagctggcctataaagtgtcatcgatttttcttatgttttggtcactacttttctactgattcaccggtcactactagccatgccactaatgtgaactcttttttttttttaaaaaaaaaaaataagtttccctcccttggatataaaggattcattatggttatagtaagtctcaataaggtcattaaacatttataaaaatatttataaattatgagtacgaaattcttatattaataataggaactaaactcatagtttaaatatttataaaaatacttataaattatcagtaacgaaaattcttatattaacaataaaaattaaactcatattttgttttggaatgaatgtgctatttatcaacttttgttggtccctaatgtaaactctgaaatgaaactgaaaagaaaagaaagaagaataaaataagaccccaacgcgtaacaccgactcaaacgtttgtaggtgagtttttttcttttttttgtacgtgtttcgagtgttttgaccgtacgaaaagttttgtggcttccaaacaccataaataaataacccaaaagtcaaacactagcaacccccagtcattaattcatttgtttgacgttgattggatttgcttctgattccattctacgttatctttatcttctaccgccgcccaaaccatacctctatttttgtcttcggaattattatgtctaatgtaattcacgtctcataaaaaatattattttaaatatctcaattaattttattattatttatttttctatccacttaattattttttattaatatttaagaaagaataattaagtgaagatatatagagaaaaataattgttgtatctaaaaatttaaaaattattttataaaatgaattttataattagtgacaaaagaaatatataattaaaaaagtctaattcaatttattaaataaaatatgtaatttactgtaaatttctttttatatttatcttaagttcatacgaacgaaagtataatcaaaacatatatcttagttttctctagtaattaataggactccttacattgaatttcttccccaaccatttcaacgactcataacagaaataaataactaaaacgtcttgctaattattaactaagttatgaaactagactatatattagcacagtaaacttatcgccttaaaaaaacatattaaatttatcgtgtaccaatgacttgatagggttgtttgtagcgttaaacaattggaattagatacggatgagtagaaccaaatagaatggtaaacaattgtcattgaagtagggtaaaatctatgatttttttacactcttttgtgatttacataataaatattttatttcaattccttaagactagttttataaaattattactcttttatttatttatagtttattaatttttcttgatatatattaaataacacaagacagtacttattttgggaaaaaagtaaccattagattaaaaaaatctaacgtattattattaaccttatattttcttgaatcctaccgataaaaataaaaataatgattagttgagaaaagagagagataattgataaaaaaaagtaagaataattttaaaataaaattaagttattgacagattcattaatttaatatctttgactaaattaactaaatttttgtaaaagaaatatgtaaagtaattaaaaaaatcataaaaaaaagacgtagggtacacgagtttttgccttgaaatgtgtgacaccttttatttattcgtttctcagttgatgtggtcagagaagcaaaacgtcactccgatgcttcgaggtttgatgtaatctacgacaaaatattaatgttgaatacaatgcgaagaaaaaatagtaacaatggcggcaggtaaagggaataataaaacttttattaattaatcgatatactccaatatacgcgcacgttatatctttgttgccagttggcgatatataaccgtgtgagtaaaatccagagttaaatataaatttagaggtagatattaatattcactagtattgagtttttggacaattttaaataaccaatcataatttgtttatacaagtagctgattataaaaggtgaaccaatttatgtattgtgaattcaattaattatatattcagatagattttatcaacaaacctatatcaaaattaattagatcacaaatgcattttcattcataactatgatctagagataactatgctcataaatgtattttaattatatgtctagtgcttaatttttaaaaaacggtacttcataggcgaagtaatttatggagtgatattaacgaaaatgcatacctaactattttctgtattagtacatatgtttttataaatttgaaggaaactaaaaaataaaaatatatatatcaacactaaattatgataaaataaagagtcgagatttaaaacttaaaagttcaatacatattttaatttgatcgaaataatgtatgggtgcataatcattatctttatgaatttaatatagagagtcgagatttaaaacttaaaattcaatacatatttaaattatatttcaattaaactccaataacaacatttgaaaaaaatgaatagtatccttaatataaaagaagttacctaatttaatagaaaaataatttttaagaatttattcatttaaaaataccaaatcatactttttttcttatatattaaaacaaagttttaactagctaaacacatttcaacagttgaaatatttttattcacacatttccttcttttatcttggccattattttatatatatatatatatatatatatatatatatatataatacatttaccttctctcttataagaatttgtgtgaaaaataaatcactcgctcactttttaattagtatgataatcataaattatataaatggatttgatataaaccaacttcttcttcttcttcttcttaaatgttgggagggataaaagatcaaaagttaaagacgtgtctgtcctgttgaagctggatcagtaaagacagttttaattaattccactctcaattctcaaccaccttccacaaagaatctcaaattgttttcaaccaatcgtgtttgtttagtatttcgctgtcaattcaaagtgcttttacatgcataaaaatgatatatatatatatatatataacaaattaattttatgaaaaattacatttgaagtaatttgatcttaacaatcaacacacatgtatatatagaaaatgtatcacatgataaatgcagcatacaaaaagagcaaattcaagaatataattcacacaaatgattaagattaaaattaattaaaataactttgatattctgtgtttttaattttttttttttaaaaaaaggcttaaacaatcaacctatatatctcttttactcttaattgggtccgacgtttgttttaaacaaatgataattgtcaactaaaacctacgttacatgtataaagttataactgtacagtttacatagttgaaggtacaacggtttcctactaatttagttgtctgtaaatgaatatttgttatttaacctaacagcagtttaatagtcatgtacacacaaagtgactatagaatttgctcaattaactttagttttttttatatggttcaataaagtatacattagttttgggttccatcaaccacttttatgaatatactttagtactttaattacaactagtagagacaatagaaatgagtaaatgacccaccagatcctcttgctgctaaattgttggcaccatttttcaactctcattttcgtgccacttgttattgccgaagcaaattttcaaaactgatgcatgcccctgccccctatagtgtatacttgtcaagcaagaatttttgggtcaattgtcaacacagttgaacaaaaagtatgcatattaaaaagtagcaacctcactgtaatctctctttctttctaggtccacgtcgtcctttatttttttttaccaaataattcgttttttggtctggtctttgttaacacttttgagcattaatattgaccaacctgacaacctaacatagtatatatcttgaacccgtcaaataatcagaaaagtaacttaccaaaattcaaaataataattataaattatgcttatccatcccaatatttttttaacataagatatttttctaatgaaaagtggtagactaatttcttaatgtattaaacttatttaagaggttaatctttcagtacatatattctttatacacaacaaatttgatgatcaaatttctaatcatatatttagaaaatagatatatcaactatatacacaacattgatatcttcgtctcaaatactaatgtacgtgattttggaattaagcttttgtgccaacaaaattaattttgaaacagtatgatttatgtttgtatatttttattataaaaacaaattaagataatagaactcaatataaaatttttcatcgaatgtaaaaacttacttaaaattgtttaaatttaaaatcaattttaaattatttttcacgtgaaatcaaaatatataaaaaaattatgtgtatatggatacacgtatcaaattgacgtgaaaaaccacgtcttcaccataattccaaacatattatatataaaatcaattttaaacttggatctccaatgcgaaataaaaaatgcaattcatgttctaaaaacttacacgcgcgcacacatgtattttctgtaaactttttagtcatttttcttataatacattgtaacttattttatagtttcaacgaaatatctaaacaaaaaaacttgattcgatcaatcaaggaattccaattcttccattttctctcgtttttttcaagttctttctgcctgtcaccaaaccgtatctgtgtatatatagtaggtccatgatccttgtgagacaagtcggtgacttggtcttttatgcgatttgccactttcacaaaaaaattgaaccagattttaaatgaaagtgaggaagcagccacgaagttgcttgaaatgtgtgtccatgttgttgggaaaaattagctttccctcaaatagtaccgtatgtgaacagtaccgtacgtacacgtgaatagtacttttcagtatgcttttgcggaagcgaaaaattataagagtggagagaaaaacacacaggaatttttacgtggaaaactttcccaatgtggagaaataaaaaccacgggacactagtccagatcaaacttccactataaaaataatgggttacaacaaatcaagcttcaccataaatttgtggtactctcaaacatcacctatagtggtggtacactcaaacttctcacaagaggtctctcaaatcaaacatctctcataaggatttttctcacaactcacactaaactctctcggagtttttctttctcttggtgttattgttgtgctctactggatgcccaaaaactgaatgcacttatttatagtgcaaagggcgctgcatttggtgaatcaattgtcaaaaaaatattgccacctaccgttttgttgttcaacatttgctgcgcctaatgtttggctgccacctaccattttgttcaaatgttgctgctgcccatgtgctctaattgaggaggaaaataagccgtgggccaacagatctccccctttccgacttaattagacggatttcaatatcagcccggcaccttcgcaacagtcttcaaattttcttgctggtaccggcttagtcatcatgtcggaccaattaaggtcagtgtgcactttgacgagtttaagctgtccatcatctaccacatctctgatccagtgatacctcacgtcgatgtgttttgtgcgagagtgataggtcgagttcttggctaagtgaatagcgctttgattgtcacatttcagctcatacttgtcttgatcatggccgagttcggaaagaaacttcttcatccataacagttctttacatgcctcagttgtggctatgtactcggcctcagtcgttgatagtgcaacacacttctgaagtcttgattgccaggagacagctcctcctgcaaaagtcatcagatatcctgtcgttgacttccttgagtcactatctccccctaaatcagcatccgtaaagccttgtagctcagctttatcttctccaaattgaaggcatagattcgtcgtacctcgaagatacttgaatatccacttcactgcattccagtgttctttaccgggattagacaaatacctgcttaccattccaacagcatacgccaagtcgggtctcgtacaaaccattgcatacatcaaacttccgacggcggactggtacgggatcttcagcatctcgtctttttcttcatcagacttcggacattgcttctggttgagctttatgtgtccggataagggggtgcttactgttttggctttgtccatgctaaatcttttcaagattttctcaacatatttttcttgactcagccacagtagctttctttgtcggtctcggatgatcttgattccgagaatctgctttgcagggccgaggtccttcattgcgaaggatgagctcaacgccttcttcagggcggctatcctcgttttgtcttgccctacgatcaacatgtcatcaacatataacaataaaatcagaaaatctccagcttcatacctcttgacaaaaacgcagtggtcggcttctgtcctcatgaacttgtgttctgtcatgaaagactcaaacttcttgtaccactgccgaggtgcttgcttcaagccatagagactcttattcaatcggcaaaccaaatcttcttgtccaggagcttggaacccttcaggttgctccatatagatttcttcttcaaggtcgccgtgcagaaatgctgtcttcacatccatctgctctacctcgaggtccattgaggctgccatcgccaacacggttcggaccgaggacatcttcacgacgggagagaatatctcatcaaaatcaactcccttcttctggttacagcccttcaccactattcgggctttgtatctaggcttctggccattttcttcattcttaatcttgtacacccacttgttcttcagagctcgtcttccttcaggaagttcagtcaactcgtaagtctgattttcatgcagagatttcatctcgtcctgcatagctctttcccattctttcttgtctgagctagtcattgcctcatcataactttgaggctctccgtcttcagcaacgacggtgtactcgtcaggtgggtaccttgtggaaggtcgtctttctcgtgtagagcgtcttatttgctcttcaagttggtgatccggttcttcattttcatctcggatctcatcatccctgttcatttcatcttggacctcatcatcttggtccgggattgcttgttcattgtcttcattttctccccctgcttcagcacggataggagggatgggttcttcacttcggatagtaacccgaactttgggcttcgagatgtcttgaatggtctcattctcatgaaagacaacatctcggcttctcactatcttcttgttgattggatcccaaagtctgaatccaaactcggatttcggcgatccgaggtagatgcactcctttgttttcgcatctaactttgctcgttcatctttggggatatgcacgaaagctcggcatccaaacactttcaaatgatcataggtcgcttttcgacttgtccagatctcctctgggatctccccttcaagtggtcgtgatggtgagaggttgatcaggtcaaccgcagttctgacggcttctccccagaaagacttcggcaatttggcattggatagcatgcttcggaccttctcttcaatcgtccggttcattctctctgctagtccattcagctgaggagtcttggggggcgtcttctcaagtcgaattccggccgctctgcagtatgcatcaaatgggccgcaatactcaccaccattgtcagatcggaccactttaagcttcttgccagtctccctctccaccatagcatggaattctttaaaggattggagtacttggtctttagtcttcaacaaataaacccacactttgcgggagtggtcatcaatgaaagaaacaaaatattgagctccacccagagatctctctgacatggagcagacatcagtatgtataagatcaagaatacacctgcgtcgtctgggttgatctggtttcacaaacgaaacccggtgctgctttccagctaggcagtgcgtgcagctctccagcacttgacctttcaacccggtcagcgatcctttcttgttcaggatctgaagtcctttctcgctcatgtgaccgagacgcttgtgccacagctccaagctaggttcatctcggactaaattggcttctccgccattaatctttccttgcatcacgtacaaggagccttccttcttgcctctggctacgaccaagtttcccttggccagcttccatctatttccaccgaagtaatttactaacccggcatcatcaagtttgcctaccgagattaggttcagtcgcatgtcaggtacatgtctcacgtccttcaggacaagttggcaccctacatcagaggtcagggttacatcaccgacaccaacaatcttgctggtcacctgatttcccatttttactactccaaaatcaccacttctgtacgcagagaagaatcctctatgcggggcgacatggaaggaggcaccagagtcaactatccaggtgcagtcatcatatgcaacattcaaatagttgttctcaccgattaagtatatatcggcttcagcatttgcaaccaccgccgtggtgctcttgtcttctttcttcttcagcacaatctgatctggcttcaccgtgccatttttctcatctttctgcaagttcctgcagtctggcttcttgtggccaaccttcccacagtagaagcatttcaattcaaattttggctttgactggcatctggacttgtcacgtccacctcgaccccggcttttgcttcgacctcggaagtcgaactttcccttattctcagcaacgttggcttcatacgtgctggttacgcctcgttctcttctcctggaatcttcattcatgaggctgtcagtcacagtctccatcgttaactttccgtcaggagcagagttgcttaaagtcaccaccagagtatcccaactctctggcagagaactgagaagcaatagagcctgtagctcatcattgagcttcatctcggtcttggacagttggtttactatccctttgtaagtgctgaggtgttcaatcatactcatgccatccttgtattccaacttgacaagtcggcgaaccaggcttgctttgttcctgggagtcttcttctgtatcatggtctccaacttcgtccacaattcaaatgcattggtgaactcggaaacatgctcaaagaggcttttgtcaatatatttcctgatcatggccaccgccttccgattcaggatctcccattgtttttcggtctttccatctgggaccttgtcaccgaggatcggctcatacaggtctttgcaaaacagatgatcttccatcatcggtctccagtatgtaaaattgtcggcagtcaacttgaacatttctccatgagaagtgctgccgctggtctccatctcttcttcctcagaacccttttaatcgagctctgataccactgttgggaaaaattagctttccctcaaatagtaccgtatgtgaacagtaccgtacgtacacgtgaatagtacttttcagtatgcttttgcggaagcgaaaaattataagagtggagagaaaaacacacaggaatttttacgtggaaaactttcccaatgtggagaaataaaaaccacgggacactagtccagatcaaacttccactataaaaataatgggttacaacaaatcaagcttcaccataaatttgtggtactctcaaacatcacctatagtggtggtacactcaaacttctcacaagaggtctctcaaatcaaacatctctcataaggatttttctcacaactcacactaaactctctcggagtttttctttctcttggtgttattgttgtgctctactggatgcccaaaaactgaatgcacttatttatagtgcaaagggcgctgcatttggtgaatcaattgtcaaaaaaatattgccacctaccgttttgttgttcaacatttgctgcgcctaatgtttggctgccacctaccattttgttcaaatgttgctgctgcccatgtgctctaattgaggaggaaaataagccgtgggccaacacatgtttcatgtttgacttgtgtttggtctgatctgtgtgtcacagctagaaataaggatctagatcactgattatgatgctggcatatatagtgagatatatatacacgtttatacataaacttctttgtatttttctcccatttgtttgagagtggagttgacaagtgtttagtgcaaaaatttaaggtcaaccactagttaaacaattacaagttacttaatgatcaagtattttcacatagcgcgtgccttagtgtgtgtgaccttgtataataaggtgctttcgatgattgacatgtagaagtagaaatcaacatgtgatgctgcttgctatttggcaaatttcaagttgcaacagtgctatgcaattaattccatgtatggaatttctgtgtgtgggagaggaacagaacatatgtatgtgacataaaaggaaattaagagcataagaattattgcttaatcaaattatctatgtaagtacttaaaatttaataattagattagattagatttaacgtcataaaaggacacgatcaacgaaaaaaataagacatgaaattaataatgtagcacgccatgcatgcttgttgatcgtgtaagtcatgcgtggaggcgaaatagcaaatcaaggagcaggttatatgattttgcaaacacctacagctaaagcaagcagaaacatgtcacaatgtcagtggttgaattaaataaacattgagccaattatatgttcgtcaataattgtccaatgatatttgtaactctaattaacgaatggtccaaaatcccgagttacatatataaccgtgtttgtgatgctctccaaattaaagtgaaagaaaaaaaatgctattcagaataattcaacattaattcatgtttataattaaactatgaatgtataacaaatcaaatgttaaataaatggtcgtaggtgatcaacagataatttcctcactagattaatattgcaggcagcatgtgatcctttatagcatttgcttgtagtaatgtaatgagctatttgtaaccaagcccaatgccaccaaagagctataaagctttgaccaaactataacattactttaatcctagatcccaaaacgagttaattgtttaacaattataaattgtaattttctcgaaaaggttgttagaaaatcacaaggagctaggatttaggaagtgatttgcgctagagcctaaaggctaaaaaactcacaagtcacgagatagggtcaactataaataaaccacaccaaatgaacaagctggcatatatgtatatatatgattcatgcacaaaagaaaccacctaccatctgtaccgtccccaatttgctatcggataacactaggcattaattaggctttcatgactgcatgggctggatcaaaatacacagcttgacaatacaatgacgcgagttagttgtttcaatcaaaactaatatttttcgtattctcatcaccccataatggattccatgtgatcatttttactcaaaatattggtgtttggtttgattgttcttactttttagtgttgatttcaccattttttttatttttttaaataaaatagtgatatttttaatatttattagagaatggaaaaaatatttccttaaatgaaacaagttcgaagtagtgtttgatttatttgttgtcttcattttctgttgctatatatgttttcattgatagttataaaaatatcacattaactttatgattttgtggggaaaatgatgaaaataaaatatttgaaaatatacacaataaaaataagatggcatttttatagttactagtaacaatgttgaaaatgaagatataaaataaatcaaacaacataaaattttcttttgaaaagaaccaaagaaaaagtacaaaatggctaaaggatctgcacgttgtatctcataaaacatgttatgccatctgtttatttttttaaaatgatggtgggtactcatttattttgcctgtggctatagtatttcatcataaatgaaccattactgctgaggaatcctaaacataactacaataaatatgaggaatcctaaaacatatggtactacggaaaatcaaatctgtcaattattttttttataaggtacctttaggacgtggagcacatggaaattttctactcgtcacattgttgaatttctgaattttccagcatgatggttggatcttagaacagctggctactgtaaatcctttaatatcttattcggcccataacgttatgcagcgtgataaacaaaacatggagcttatgaaaccgattggatcgaattttagggacgcaaagttcaattttagtgaatattcagtttgttaaaaattaactgtgattaaatatatttattgttatttcatatgataataaattcatataatctttagccgtatagtttattattttaaatttgaattagctacggcaagcatcaaatcaaatatataaaaaatcaaactaaaaatcaaacttagctcaagacaaaatgttcaggcctgaaatggcttccaaaagtcaagataaaaagaatcacaagaaattagttaaagacaattaataaatcaagtagcatgagtgatggtttaccaaccaaattatttaacaccggcccatggctttaaaactcaagtataatgctgatagatgatcaatcctctaaatactttattttcctgtccttatccaggtatttgtaccgcctaactaacatccatatcaagacacatacatagctagtgaaataaagtataatttaagtccctgatcttcattttctagttacacccaagtcgaatatcttggattaaattttgaggaattatccccatttaactgcatatcacatttccctatctactctatgattcataccatataacgcatctccgattacgattatcaataacaatttccctcggcgggaaaaggtacatgctactttgaaagatgcccctttcaccaagtttatacactatacacaatttaccaatactttaatgcgtgatcagttatcccacccttgtgcactcggtgcaaaatgcacattacagacacagtatccaaattaaaacaaatcaagatggaaaaaagttggtcataaaccattttaaaagttatatctatctctggaatgttacaaaattaagccaatttcctatcgcttaagttttacacgtattgcaacctataaagcgaagaactaatcagacttataatgcaactttccatcacggaatcctatcaaactggtaaattctgcactcttaagtgcttatacttttgttctttgttgaatctttttgcactcactgccaaacctttagataaaaggactttcttatctcaccatcggtgacgattctttccattgtttttcgaaaccgaaggcacgccatctgtggggaataacatgatggaccagcctgggtcttccggcggctcagaagccagcgtcaaccaacaagccccaaaccccgagcccccagagcctcaagcccctgaccttgaccatcctttactggatgacaacaaccagaagcgaagtttcttttctacgatacactggaatcgggtctatcttaagcgggaaggcaattcccttctttcggtaaagaaattctttgaacttctcttgaactgcaattctgcttttcactttgtctaccatcggcggagggcatcccttctcagcttccatcaaccccctcttgcaaagcctcatcaatctgtccaacaagaaaaaacaagaagcatcactgagataaagatttttttattgacttggccagttttcaatatagtgcatgtagcccaatgtaaaaatatttgctataatatagaagtggggtagtgtgcctcttcatggtggtgcttattgcctctacacatatctcatggtattaataactatggctccattgcaaaaaccttgcccttgaattttctagttcagtatattcattctcaaatgggactattagcatatatttatgacattgcactaacgagacaagtaactgcaatcatatttgacatttttcacaccccatagcgaagccacacaccatcccctcttggcaccacatcaccacaatgccactcatttttcccattatatttgaactgcaatttgaaccattggaaccaaattgaaactttcattacacgaggaaccaaaactccaaaagtgaatttaacagtaaatgaagaacttactcgttgcctagctgttacattaaacttttgaagcaaaaatgctttaggatccatttgcccaggaggactcccaatccctaatgacaaagcaaattgaaaataaggattacatcaataatctaaactagggaaagaataaaggatttgcaacataagtaccaaccaattctcagcctaggaaattctctatttcctctgaagtgatagatcacactcttcagcctggttcagtgagaagtgaggaccatgtacaagatgagtagtggtattcgagaagcacttaacaagaaaatatcagagctaaaaagatttcatgaactcattttccatcagactatcaccacttataaaaaatattattgaattataaacacgctcgtagtgatccttagtgtattcatataaagtaataattttttcttcgaatcttagcaattgatatgctttcgaaacaacttttttcttcatttgaattgaaagtaattctttcaatttgtgtattcttatttctaaattaaacaaggctttttcagccacttcataaaaattactttcctttttacctaaaacagtgaagcatcacagatatgacaatatatggccccttgaaaagtgaaaatgtagtgaataattgtgaagctatatatccaccatgaatagataaagaaaaactatgaagaatgactatatgattaagtttccatacaaagtactaatagatgttcatttactgaaagataaccatcaactattgagagcatttctttgagtaacagggttcttgatataaactctcgctggtatgcattttttctaaccatttaaattccaaacaaccacaattggagtcatggataactccgcacgggtccataatagaattgaaataatctataatattgcaatcattagttttttcaatactttaaaggcttaattatcaatttggtcctcaaatttctaaaaggttcaatatggtcttcaataaaaaatgaatcaagttggtccctaaatttttaaaagatttaatttagtcctcaagttcttaaaaatgaatcaatttggtcctcaaattcttaaaaatgaatcaatatggtcctcaaattcttaaaaatgaatcaatttggttctcaaatttttaagatcttgaggatcaaattgaaccatttaaaataatttggagaccaaattgattaatttttaaaaacttgagaaccaaattgaaccttttaaaaatttggggaccaaattgataattaaacctactttaaatggacaaagaaggcatttcccatagtttcaataagcaattggatagcaacaataaatgtcaggaaaaaactgttttttaattccagatggactggaacaagcttttaagaattaggcacgggcataaaacttacaggaggctggtgtatataagaactaagaaggtgaaggaaaaggaaagtgggcccgaaaatcaaggcctgtgggtatatatgagagaaggaaaaaatgtgacacgagggattggaaggagagagggggaataacagaataaacaggtggcattgagaatggaggagggaatgcaggaagcagagaatcaggcaagtagagagagaatgattatttaaaggaaggtgcaaccaaatagaaggaatgagagaatttccgaagggttatgttggggtttgttagtctgagcagaggaacttatcatttatcagtcactgggtgttaccatttcttttttatcctaattcctatttgccatattgtaaggagcttgctccattcattgtcatttgtttcctgtagtttcttgctttctgctaatatactgtaacagaagattactctgttggttgtaaggggatccttcaatatatatcagttcttttatttttttccaatctatatctagttccaatcaatgtatgattgagggggaaacgtttataagtaatggaattttttccctcaaaccacaaaccaatatacaacctaatcaggactctcacaatgttaactaatttggcttattacatcttcttagtctgtcctcatcttcttattataacaaaaggtagaataaacttccaaaatgttggttattggaataggactccaataacatctacatgttaagttcaagacagatacttattgggttctggaattagtgaattacacaatctaattatgcgtaataaacaccataaatctttatagagtttagaggagtaggcacttgaattagcaacaagtttcttatgatcagagtaaaaaaaaaaaacttaaggatggaaataatagtaattttgcttcacaattatcatttaatgttgtaccctttgtggcttccatgaccccctttgtcatgaagacgaagcaccccacaaggcaagttcatgtcatcatggaactgcaacaaaaaatacatgattaaataaagaaacagcgcacacctatcactgattagatacttaaaagaaaaggtacgatatggaataactcaccacaagcacctgattaagaggtagcttataataagcagccattggtcctgtctgcagtaaaacatatattgataataagcctgaggctttatatgtaagctaaagatcaacaaacaagtaaatgaaaccatttgcgtgctaccacaaacacagaaacctgccatggaatccatattagtataaaaccagtaaaagcagaaatgaaagatgaaccaatcagccatggtcatgatggccatctttcaatcctcttctccttggttttgtatgaaaaaggggaaggggattaatagcattcaataaggacctctatctgaccaaagaattattaatccacaggagatttgtaagaagctatgtttccctacttcccagcattttcttattcccttcattattctctaatctgaatgatactcctttccacaatgactataaccttactctatcatgtatgaaaagattttccaaaaaaaaaaacataagtcaattcacagagatgaaggaacacaaagtaaaatcccctataagaaaccacaaaaaactatggagaaaacacagaaaacttaaccatcacaactgccccaagactctcccaggaaattccatgcacaaaaacacctgcaacaaaagggataatctaatactaaaataaccccaaaacacactaaggcaactacaattcttcaaaatgaccaaaacgtatctagatgaaacaacttgtagaaactaaagcaaaatatctagatggttgagagaaaaaacaaaaggcagcacatcttaattccttaccgattcaccactgagattcatgtaagtttgaggctttgcaagaaaaacaggaacttcaccaacaaaacctgtaacaaaccaccaccttgcctaataaaattcatgaattacaagaaacatcaaaagagaaacagagaacagcagataaaccttttccagaaatggctttggaatggacagtgtccataggaatcccctgtgactcagcaaatgcatcaatcatctcaaagccaacctaattcagaccaaaaaaaaaaaaaacatattttcatatttcaccacaaaactgctaattcaaaactaactataccccctttacactacagaacactttctatgcaatttgatgttgataacaaaaacttgaaacaaactgcaaatagaagcagaagcagaagtaaaaggaaaagtacattgtgcctggttcctttgaacttgtcgccagggttgcccaaccccacaaaaagccaagggcgtggagcaacggtgcaaaagcagcgtctgcttaacctattaagcatgtcctctgctgcgaacgtaggagaataattcattatgaacgaagaagaaaattataagagttgaatatgcaatggtaattaaatacctatcttagctatcaccgttgtctctccgcatcttcacaatcactaatcgattcgtgcagctagcagctaggcagctactctcccgttctccgagaaccggaagcggttcaatcgcggtttcaacgtcggcacggtcaatgagtgatgaacctaagtgtgtctatatatatttgctgcttcgtaactagctggttcaaccagccacttctagatatttttaaatttaaacaaatccatccacaaacacactatttcattttattaaaataaattctttattttattaaataattgtttttttagaatacgtttaaacaaactcccctgaaacttagtatctgattttattcaaatgtttgttaaaataattgcttttattaaaataaattctttattttattagatattttatttttaattagtatctgattttaaaaggataaaatatgttttacttcttgaaacttcaacttttattaatttggtcctgaaatctaaaaaagaaacacagtgactttttttttccttgccatgaaaattttaggagggataaaaatttgtgttttctaaagtttggaaactaaggtcaaggtaattgccaatttttggttttcgattataaatagtttgttattaaaggggtattttggttttctcttagcatcacttacgaattacactattgggcacttgcaatatattcttttttctccataaaaaaaaaaaaaaagagattgaaaatttaagaaaacagagaaatgatcaacaaacttatgtaaagtatcaatgtaatgtaatactaatatatattcaacttccaaggagactaagggagagcaagtaaatattgatatagtacaatataattaaattcaaagaatacatatacaagttctatacgcatgaaaatgaatatacaaattaagttttatcgtaccaaaatagacatctccagaagattgagattcagagctaaagctcattctggtttagattggatcttctgctcctttttcactatataattatatttagaacttagaattcagtttataagtgactgattttttatttggagagagggcaaagcccaaaaaccaagagtcaaagacgctctgagtcccggagcacccgatccgcagggggaatgccgcgggactatgggagtcgaaccaaattctgcgaaaacccccgacaaaaagaaggaattagttcagtcagaagcacatggggcactgttcctctaaaacgaaggtggcgaaacattcatttcttccaaggtgcttaactaagaaaacggacttggacgttgattcggcacatcccgtatggattattgatattgaatttatacaaaaatttatagaaaaattacaacctgtggtagttgcattttttcctttctctatctcgtttttagcttcctttttccaatgctaattatagttcacaggatcaatgggtcaccgaagaaggtaagcaaaattccatgcatcaatcttgctcatgacctatagttaaacatacagtctatattagtcattacaaacaaaacatatatctacacaaaaatgatactttactaacatatagagcaaagggagaaataccactcattgagaaaaccaatatttttcagtacaaaatatgatctatatctatggatggcaatatgggctggcccgccaaaaatgggtcggactggcctacttttagaaagtgggctgaaaatcctagcccgacccattttaaggtggcttggcggactaataggccagcccgccagcccaccaaaaaaaatttttaaaaaattttttaaaagaaaaaagccaaaaaaaagcaaaaaagtgtaaaatgggctggcccgcctctagcccattttttgcgggtcgagttggcccgcctttggcccacctttttgtgggccgggttggctcgccccattttccaaaatgggctgaaattttcagtccaattcaccttttttggctggctaaacgggctggcccgtcgagcccaacccatattgtcatccctatctatatcatagaagaacaagccaccaagaaattgtaaccgtgtgaaataaagtccattgaattttcagtctaaaccaccaagaaatttgtctttgttaaaaaaagtaaataaagaattatgaggcgacctgcacagttttaccatcaaaatcaattttaaaattaacaaatatttaaaaaaaattaaaattaaaaaatgagtaattttaactaataaatatcaatcctgttaaaatcgtcctaaaaaatggtttattgctgcttatcgatttaaaaaaatttaaaaacgtattaagatgatatggagattaaaaaaaatatatcttgcctcagaatccacgggcaaatcttacacaaatgttaaagaaagttccaactccttaaaaactctaactccttcactttattagttgcttggctcgactcttttttaccctttgatactgaaaaacataatttaataagttgtgattagtaaatgaaaaatcccttcatcctttggtggttagaaaatgatttcagtcgtacccaagatggtttaattagatgcatgcctgcaagaatattaaccatgttatcgcttaatatgatagacatatgtgtagataaatagacatgtctgaaaataagtgtaatactattaaactacgcattgaccttaaacttgaagaacggcatttttcttgtatatgctcttagatctctaattattttcatacaattgcaaacaaaataccgagtgacaaaaatgaatgaaacacgtagtttccaaaaaaaaaaagttatatcaatcatacgtacatcatgaaattcaaaacaaaacaatatataacagacctttaaactgccagtatcatgcagtagcttttgatcaatatgcacagaagtcaacaatattgaagcaagtttttagggagttggctaatattcccgatcactcccatgcttacaaaataagtttcctgagggcataagagttgggaagaaggagaagaaatgagaatcaaagagaaggaatgtgcatgtcgatgaaaaccactcacgatagagaaaaaagaaagcaaggattaaaaaatggagtgaaacaagtaaagatgtggacgccaaacgagtgaaacaagtaagaagtcaacaattatttagttttaacatgtaaggggcttcttttgtttagaaaagagaaatggatagatgagaaatagaaaaaaaatatataaataaaataatgttatttatttattttaaaagaaataagtgaaaaataatgtttttgtataaaaaaaattgtttaaagaattattttttgtatatgtgcttatcaaaatttggagcagattgatgttagggttgactatcgtcaagttgaactccatgatttcttaggttggatttgtagatgccctttaccagaggaatgagaggggagtacaagggattttgacgctcaagtaagtattgagtgagctgagaatggataaaatgaaggtagaattggattatttatagtgtcggatggagccttaagcccttgattgttggggttgttataacaacataactctatagataattcatagccaattgataagtgattacctaacaacacaacaacttatagataattcatagtcatttgataagcggttacctaagagcataacagcttatagataattcataaaaaaaaaagataataacattaacattagaattcaaacttatatcaatagtttatcaactcaatcacctgactcctaagcaagtagtgtcggtgctcctgtactagggctgacgaagggcgttggcatgtatattttaatgtcatgcacttgtcacgtcaatttgtggacacggacaatacaaaagcccccaagctctaagtcaaacttgttggcgaaataggttgttcaatgtcaatggtggtaacctcgacaaatttaggggttgagggtttgttaagccccccagcttggacaaacagtgtccgggttaaaattgatagattgtctaaggtgagtgtgtttttcgtcccttcaggtagaatctggtgttcttatgagagaagctcctgtttttgacaattctaaccgttagaaagcgctttgaagataaacgcttcattggatcatgtgtatagttctcgacatgcgaattctctttggagtatgggctttagacttgagcaaaggatagttgttgactttgtttctccttttgatcaaaatcttattcgattagttggggtgcaaactcaatcaatgttgcaaaggtttttcttcaaaggagcctggctatattggaggaaaaggagcaaaggcacaagtaggccctgagtaggatttcttccttggaggctaaggtcaccaaatggagagtcaatgctcgaactgagtagcgagtggaacgactcatagtggccaatgctactgtcgcccttgctgaagccgttaggtctaactaccagttgtcatccagggtcaacgatgtctttgctaagctggtgagcataagactggatggtgacgaggtgttcgaatgtcataaagagttattggaaaagaatgacttgacgagcaaggtggagcgctccgtttaagagaaggagaaacttcacacgacagtagatgaatctgtcaaggtgattgctgatctctaagcctaactaaaagagtcgaagctcactgtatccagcctacaaactaggttgaaggagtctgagcttgaggcgacaaaggagaaataggcgaataaggagctagaggagaaacttctcatgttcgaaaaggaggttgtggagcagcacaaaaagggattcttcaaggccatcaggcaggccaggttcttcactgagggtcttgacctatgtctttttgacccgtttaaagatgtaaaggtctgtcaacttctcgacgaggaagagattgttgatggcgaggaagacgatgaggccaatgtttaggttgtgtttcccttaatgtttagcctttaatacttgtcgtagaataatgagagtggtcctttgcgctaggtgcgatttttcttacatggcatgtctgtatggaatagagaatgagatgacatctgatcatctcgggtttgatttcaatctggttgaaggtcttgtccaatcatcttgggttaggttcaacccgatgacgcttccttttcactttacaaagcttcttacccaaggccgtggggacttacttgagttacactaacaagtgtttaatctgaactttgactatgcctgttatggtttcaagggaataagtttaccaagagtgtgtcttgggtacatgtgaaacatgaaacttagtagcaaagaggctcattaagggtggaccttgagtttgtctagcctttgagattcgattagggatgtgttcgtcctgtgtgtggcaagattcaccaagggcggaccttgagtttgatgagcctttagagattcgattaaggacgcgttcgtccttggtgtgacaagacccaccaaggacgaaccttgattttgacaagccttgggagatttgactagggacgcgttcgtcctaggtttgacgagactcatcaagggtggaccttggggtttgacgagcgtttggagattcgaccaaggacacctgttgttgtcatccagggtattgttggtctcatgaggatgcgattcaccctgggtgcgctcattgaccgtgtgggaggagtgtttgtccttttgagggcatctcacacgagcctccaacttgtcatggtcgaccttcaattttatgagttcctcctcatggcgacgttccatctttgcgatgcaggcttgaagttgatggagagcatcattgtctgtcgttgtcgttggaggaggattggaattttctaggagtggctcttaccgaaggtcgaagcgtgtgctaaccatgaatgtgggtggttgcaggggaagttttactgcgaccccatgttgggcaacaaatgtacttaccaaaatctatagcaaattgacgttagagttgattttcgtcaaattgggctccatgatctcctatgtcgaatttgcatgtgtcctccaccagaggaacgagagtggagtacctgcgaaaaagatttcgacattcaagtaagtatgtgaatgagttgaaaataaatgaaaagtgaaggtagaacttgattatttatagtgtcaaacgggagcttaagacccttaattgtcgggattgttataacaacataacaactctatagatagttaattgtcacttgataagcaattacctaacaacacaatcacttatagataattcgtagccacttgataaactattacctaacaacataataacttgtagataactcgtaataatattatcattagaattcaaacatatatcaataacttataaacctaatcattcaactgctaaatgagtagtgtccgtattttttgtattaaggttgatgaaaatgactaacatatatatatatatatatattaatgtcatatcatttaacacgtcaatatatgaatccgaataaaatagtactttaaaataaaaataaaaatcatggattttttttcttgaaacggaaaagatgaaattttatgttacgggtcaatcacttgtaactttacttccttgtatcaaactttaccgcctttattttcatcttagcacttttttttttgttaaattttttttaaataactcaaattattctgaaatttcgtatgtatgcacgtagcttagtttgaaaagacagtgttaaaaaaatagaaaagaaagaccctacgacccgaaataaagggaaaagataaaagacgagggggaaaagtccttgtgacccaaagcctcaattattaaagacaacaattattgtgattaaccatctcttggaacaaattatgccgatgaaaaggttgcaagcagtagcatgtattggactgtaactctcgtgcttgtttgtatagattcgacttcgtgtttgttatttaacggtaatttctcttcaaacatgaattaaggaaaaaatatacgttgttaatattaaaaaattatttaccttgagtaatcatagtatttacaaaacaccgtctttttccagttttagatgcattactttttagactttgaagaggctggcggaagtggggtgagggtgagagtgggttccgacccctttcctttaaaaaaaaacagaattttattttatatgttacataaataaatacttttaagatataaattatattatcattagagttcataataagtaaataaatatttttaatatataaattagagtaaataatatatattaataatatacatgattttcacatagttaattaatcaaaaactgtaatttaaggtaattttgttaacttttatattattatcctaaaagtcaaccctaatgtaaatttttatttagatgatgtaaaaactttttgattaaattattctaactattcctaaagtttcaacaataacacaaactctctttgtttttttaacatttataataaccctcttagtctgatgttttttttcaaacaattaaggaaaattaaaggatacttgattgggaataatttttttttatatctaagtatcatgattattggaaagtcaattcttaaaaatcataattattttaatatgtaaaatatgtttgattagtctaaatatgttttctgatgtagaaaatatgcaaaaactttttttcactaaatttttctggattcccactctttccttgagaatgttttttgcgagttgagtaacattgatacctgaaaattataaatttttgaatttttttttattaattgcacattaaaggtgagaataatagtttcctaatttaagattactgaaaaagtaaaaaaaattgtctatcaaaatacatcgttagtgtaatgtataacaaaatatcaatctatatttttcaatcaattaagaatatagtgtaggaataaaaaacaaaaaaaaaatcgtataatttcataaaacctcgtgagtaagtactacagtttattaaaactttttatattgttagtgtcatatttttataaaataatcacttattcttttaaatttttatgcatttgtttcggctttataaaataattagaatcttaaaaataatataaattttgattaaatttaaaaatcgttgtattttttatttttataatccatatttattcccttatctagtaatgctttcttgtcacatatgattatatcttatctttgggaattaattaaggatatatgatacgataagattaatccctataaacctaagcttgatccgctgaaaagtcagattactcattttgatgttttggatagacaacttctaagttctaaccttaatttttcttattgaatttttttatatcacatttattgaaataaaatttaaaaattcctataaactcattcaataaggtttgttgccgttgctgttgtaataaattagtaaattaatttcaaaaaaatattaaattaattttaaaatttataaaaatataaattagttctatatatatattttaaaaatcttatttctcacattaaaatgcttatatcatttcatttaaaataatagtgtgaatacagggtaggaacaaacccaaacacaaaaaaaaaaaaaaaaacttttaaacacccgtttatagtaagaacatgattgaactagatgcaggttgagaatgtttttgtagatttggaattgtagacttgttcactatgttgtcacaggtactgactgggtcttatatagcatatccgatagaactagataagatatttgtatgctggatgattttattttttttgtcacatgctagatagttttactggtacgtatttttatatttctcaccattttattcttcaaaaaagaatttcgtacacaaaatttaaaataaaaagaaaaaacttaaaatctacattaatcttctaaatagttccattaattaattaactaaaaagaaacaatcatacacgcattttaaattgatccccaaagagtcccaaaaattttcacatacataaatttaatttaattaagccacaaggggggaaaaagaagtaaggaaagcgtaggctaatgatgaaccgtgacctaaaaaacaaaacacagctaataaaaatcatgtggttgccctaattagtcccactcgctgagcacggtaacctaacccttttcccacttatatattatgacaataaaccacaactcacaacacaacactccctcgctcgctccaacacccgcaacagtatatataaaacgacacacacaccccgagagagaagagtggcgacgcgagtctagtctctctaatcacataatcataaatcaaaaaccctaacccgcgcgtgatcactcgtcattgctctctcatcttcttcttctttatcgtggccgccatggattctgaggtgcagcaatcgcaggtcgccgccatcctcggcgccgatccctccccctttgagacgttgatctcgcacctcatgtcctcctccaacgagcaacgctcccacgcggaggcgctgtttaacctatgcaagcaaaccgatcccgataacctctccttgaagctggcacacctcctccactcctcgccgcaccaggaggcgcgtgccatgtccgccatcctcctccgtaaacagctcacgcgcgacgactcctacctctggccgcgcctctcccctcacacgcagtcttctctcaaatcgctccttctctcctcgattcaaacggaaaacatcaaatccatctccaagaagctctgcgacaccatctccgaactcgcctccggtattttacccgacaacgcctggccggagcttcttcctttcatgttccagtgtgtttcctctgattcccctaagcttcaggaatccgcgtttttaatcttcgcgcagttgtcgcagtacatcggcgattccctcactcctcacatcaagcacctccacgatattttcttgcagtgcctcacgaacgcttccgttaaccctgacgtccgaattgccgcgcttaacgccgttatcaatttcatccagtgtttgtccggttccgccgatcgcgaccggttccaggacctgctgcccgcaatgatgcggacgttgaccgaggcgcttaattccggccaggaggccaccgcccaggaggcgcttgagcttctcatcgagctcgccgggactgagccgcgttttctccggcgccagcttgtggatgtcgttggcgccatgttgcagattgccgaggctgaatcccttgaggaagggactcggcatttggcgattgagtttgtgattactctcgcggaggcgagggagcgtgcccccgggatgatgaggaagttgccgcagtttattagtaggttgtttgcgatactcatgaagatgcttcttgatattgaggatgatcctgcgtggcacagtgctgagactgaggatgaggatgctggtgaaaccagtaattatagcgtgggacaagagtgcttggataggctctctatatctttgggtggaaacaccattgttcctgttgcgtccgaacagttgcctgcttacttggctgctccagaatggcagaaacggcatgctgcacttattgcacttgctcagattgctgagggctgttcaaaggtattatattgatcggagatgtcaactattcttgtggatttttgcttttatacaagtaaatggcagttagaatatttgtgttagttatagttgatatgattgtgattggttgtttcttgttgggcaataacttgtgtgtaccacttgtgattttgactttctaccaacttttaattgctgcaggtcatgataaagaatttggagcaagtggtggctatggtcctgaactccttccctgaccaacacccccgtgtaagatgggcagctattaatgcaattgggcagctgtctactgatttgggtcctgatttgcaagttaaatatcatcaaggagtgttgccagcactagctggtgccatggatgattttcagaaccctcgtgtgcaggttagctgcccctttattgaagtgatattctttattcttgaacatgcattgaaagtcttgtgattcttttaatgaactttgcatctcattaaagatgccaattatttaaaatacaatgcaaacagtaactgcaatgttactttattatacaaatgtgaagcattgtgatatacttcaattttatgaagtgtgtttcatttattcttttattcttatatagtcattatgatttataattgaagtcatgctattttaattaaataagctatctggtgtaattattctcaaaatattgtctacacaggcacatgctgcttcagcagttctcaacttcagtgagaactgcacacctgatatcttaacgccatacttggatgggatagttagcaaactacttgtacttcttcaggtatatttattgagaattaatctcaagaataatgttatgatggtcattttgctaaattatcgtaattcttcaattaattttggatattctatacatttttcagaatggtaagcagatggtgcaagaaggtgccttaactgctttggcatcagttgctgattcttctcaggtattttgttaacttctttgttcaatcaacatttataatttattttcttttgatcactcatttaattattatggtctttcttaggaacacttccaaaaatattatgatgctgtaatgccatacctgaaggctatattggttaatgcaaccgacaaatctaaccgtatgcttcgtgctaagtccatggagtgtataagtttagttggaatggctgttgggaaggagaagtttagggctgatgcgaagcaggtaggtgtttcttgtttatttttttactttgccaaacaagaatgtattatgtatggttttgttttatatgttcaccttttataccactttatcatcatttggaaaaatagtcggtctagaacaggaaaataggaagttaactgcccctgcatctctgttaagcacttctttctctctctggttagctatgtcttatgattttaatattctgtgtgctggttcttcactaggttatggaagttcttatgtcccttcaagtatctcaaatggagacagatgatccaacaacaagttacatgctacaggtatgctttttatatattatttacaacatatgcataaactgccaattggtctatgttttagtctaacaactttaatttgttacaggcatgggctagactctgcaaatgtctgggacaagattttcttccttacatggaatttgtcatgcctccactgcttcaatctgcttcacttaagcctgatgtaaccattacatcagcagattcagacaatgagattgaggattctgatgatgaaaggtctcaactttagtcccttttctacgtaaaagtttaaacaattaccaaattatgaatgcataatgtatcgcttttatcacacatcgcttgtcattttggtcttgtatgttcactaatagtgactttaagccttaggagttaaggtgcatttattgctttacttatctttatattatgacatccactcgtgtaattgcgcacacacaaaaccctaacacattcttatttactaatagcgatttcattcttatggagaattagaagcacgcatcaaaacattttttttttaggcaggacagatataattaagttttatttatccattgcagtatggagactattactcttggagacaaacgaattggaatcaagactagtgttctagaggaaaaagctacagcatgtaacatgctttgttgctatgctgatgagctgaaggaaggattctttccatggattgatcaggttagacttaggccttcattgactccctttacacattaatgcttgtttaagtgtttctttacatatttttccttgttaataatttgtatgcaacgcaggttgctggaactttagttccactccttaaattttatttccatgaggaagttaggaaagcagctgtttcaggtatgaaaaattattgttgctttgcatccttttttggtcgatgatttttccttgcacagtaaatgtgctttatatcattactctatctgttttaatgtttattatttccaatattgctacagcaatgccggagctattacgatctgcgaaattagccatcgagaaggggcaatctcatggccgggatgtaacctatttgaaatttttgactgacagtatcatcccagctctggtggaagcattgcacaaggtaaattgatattcaagtttatccattcctagttgtgttgttatgaagtttctatttttggattttggaagtgaatattttttattttttgatttgaaattgtcttgaaaatattttaagttctgaatattcatataaaccaaagcaatcctttgtgagtgcagcatgttattttttgttagtttaggagacccggttctggcatgggtttgaggactaagattactctaggtgatattggtggtgaatgttgcctgacttgtcagtggcccttggtatttctttgctgagattttcccatttctgtttacttgcaggaacctgacacagagatttgtgcaagcatgttggattcattaaatgaatgcttacaggtttggatcatgagataacattgtcatatattttgtcttttttttttttttttttctggataaatttcttttctttattatatagagccatgagtgttgaatataccttggcatagttgatgttatatattataatttgaagtttgatgcttatcattattagaattcaatcaagagcctcactgactctgctattatttattcttctaactgatgtctatccctgctaggttttgtgatcaattggcaaataaaaactacattttacagtttaaatatttcccttttcatgattggcatgttgaggatttaaattattgtttagttgacttaattacgaaatttgtcttttgcacttagcaactgcctgcctcattaaaggtgacactaggtgcacattactttatactaatgtagatgtagattttgcagtattagagtgaggtatgccatgcaaaaaattggtgtgccttcctgtgaaggtgactgcatatgtttatttactttggcacagccttttatgatgtcactttatataatttctctaggaggccctagtaaggagagcttggtaagatgtcaattagtcctaccactggagctagagtgcgactgagaaatattataggcaaaactattaagatttagaggccaatggtttatatataattaacagaggatgcttggttgtggtttatattcttcaatttcacaatgtgtgcttttgtttattgtgcatgagtgtttagtagttgttcctgtgatgcttgggtaatgatcgacccttttcttgttttttgtgtgtctttttttatctttcccttgagtgcctatggtgcactataaatatgttttggatgtgttccaatcctttttttcttcctcttttagatctctgggatgcttttggatgaaagccaggtcagatccatcgtggatgagataaaacaggtgatcacagctagttcaagtagaaaacgagagagagcagagaggacccaagctgaagattttgatgatgaagagggggaactgattaaagaggaaaatgaacaagaggaggaagtttttgatcaagttagttgtttaatctaaaaataatttgaaacatcttaagtactggactactatctttgtatttttaagtttatgcagatcagtttcctggtcttccttctaatgtatgtatacattgtcccaggtgggtgagatattgggaactttgatcaaaaccttcaaagcctccttcttacccttctttgatgaactatcatcatatctgacacctatgtgggtatgttctttgagaaagctagcaactctattattaattagtttttctatttccatttattcattcagctggcctttaagcattatcttttgtattttgttttggtgtaattatgtctaaatttttctgttttctcagtttacctagtaaattttaaatatgatttcaaaatgtagaatctgtgcagtattgctaattttgaactcgtgccttttcaaaagtgtgaaagattactctgtgtttgcgtgcaacattaactatagatttagtcatttagagataaacttgcaagccacatacttgcatagatctatgtttgacttctaattctgatcttcacatctatcatcatcttaccagtttacactattttattacacttgtcatcttggagttcacattcattttcattctccaatgcacattagcttgcaagattttttttccgatgaaatgtatcattctaccatgtttaaactgtgagattgactttaaccatgttctgttctgcaatttgagtggtctatattatgttatgtcagcagatttcttacaagttgtgcctgctgattagttttaaactcaattttcaaagaactaatgtttggttgcacgttagtttagaccatagtacacacgttgattctcgtgtccaacatagaagttagtatttagagcttatggttttcacatatcagatgcactttttggctttctgatgtggtaccaaacacagcctaaaacatgtacatcattgttttgactcttggtttaatgttttggatatagggaagggacaagactccagaagagagaagaattgcaatttgtatttttgatgatgttgcagagcagtgtcgtgaagctgctattaagtaagcactctttgttttgctaggttaccatttttttgtgcagtgataattatgaaggcattttatcaacttcattcttttatataccaattgaacaggtattatgatacctatctcccattcctgttggaggcttgtaatgatgaaactcctgacgtcagacaggtaagcattaggtatcctctgttaacattttgaataccatttttattgcgtaagctgtttgattgttagagcgcaagccctgacacaacagtaaagttgtgtcttggtgaccgattggtcatgggtttgaatccggaaatgcatacaattaccctctcccatatctttgcttagtgaggagtctttgggcactggggtatgatagtttagttttaacttttaagctgtttgattgttgatgttggtattgcttcatatttctgcaggcagctgtgtatggtctcggtgtttgtgcagagtttggtggatctgtgttcaaacatcttgttggaggtactgcttgatccattaacaaactatgaaaaagctgtactatattgagtaacaagtcgttgttggcttactgcagaggctctttcgaggttaaatgctgtgatccagcatcctaatgctcttcattcagataatgtaatggcatatgacaatgctgtttccgctttgggaaaaatttgccaatttcatcgcgacagtattgattctgcccaggtcaattctgtttataacttgcttttgtgttttggttcttgattatgtttgtcattattattatcaattctttctgagtctgattgttgtttttaggttgagatgatagttaatatttttgtaatgttctgtcatgtttgcaggtagttcctgcatggctaaactgtttgccaataaaaggtgatttgattgaggccaaagttgtgcatgatcaactttgttcaatggctgagaggttaggggccctactcttcttttccaatcttctgatatgctcaagatgtcaggcatatctttttccactgtactaattgtctgttgatctgcaggtctgacagtgagctgttgggcccaaacaatcagtaccttccaaaaatagtttcagtgtttgctgaggttagtttttggttgcaactttgccaatttgtaatctgtgtgactgtctgcattgcctaaagttaagggttgtttgcttaatatttttgggttgtagggttgaatcagaaacactagtagactttttgtttttgatgaaagaatttaaatagaaagcaagctgtatacaagagtaaggagaataagattacttctctaaatagaatagaaaaaatacattaatgtatagaactccccaatggtggcttgttaacctaggcaatttcctacaatgaagtgtgtttttcacataggtcataatgtccaaggttcaattttttttattggaaatttgatcaatttggtaagttttggagaccagggaagtgtaaaaattgtttgtagcaccctgtcatatgatgaaagattaatatttgggaaatgtctagaaatttttggaattgagtaaaatgtcatttcataattgattgcaactgtaagttatttgcatgaaggaatatataccagaaggcaatgaattatttgtttgtaattgtagccattagattcttttattataaacttttgtaatattagttgatgtcatgcaatcatttaaatagttcatttgagtagttttggtgttgatattgacaatgtgcatgtatacatagttaattgatattttttcctcgtgcattagtcccgtgaataccttagtgtgtataaaatgagcagtcttttgttccatcaaacaaggacgcattcagtgaatgcttctttttggtaatatatataattatattggatttgtttgattttatttctccatttaatggaaaacattttttgtgacaggttttatgtgctggtaaagaccttgcgacagaacaaacagctggtcgtatggttaatttactcagacagctccagcaaactttaccaccctctacactcgcttctacttggtcatctttgcagccgcagcaacaacttgcattggaatctatcctgtcttcgtagttttcattgttttgctgcatatccatcatttcttcatagcatctggcttggcagttggtgtcttgcactttttgggaacaagctttttccagtttggtggtctctatatttgttacccattctttttgccataagatggtttccatcattcattcttgcatggtgttctgtatcagttttgagaatgcagagtcaattgtgattggaaagggagctttctctagaatgtgtatattatgaatgttaatagtgcgattgagtccaaaagaggttagggaattgtggcgtgggattttctcgttctattcctctattgttttttcttaccatattgcgtgagaatatagggttgtctgtggggcaattcttgcagttttggcctattgtattggttttatttccttatcagacagcatgaagttgtaccatatgaaattttaatgctatttattcattaagtttgcagacaattgtttcttcaaacaataatttggtattacttgagggcagggaaaagcatatgatttgtatgtagtatgggaatgcatctgggtcttgcaaaatttttgtattcgagttattaagatttggatcctcatgtaaaaaaatatgtgaagtgaaatgtgtgggtgtatgcacccttgatttcaaactaaattttgtgagttgcttaaattacattaaagggtggataggtttatttcactttaaagtatccaatcccgtgatggagggcattgattgatccaatcattggggggaaaagttcatgctttcatagtcggggacacgtacatcggtgttatagatgggcattaaaagtgaattgaatcgctgggaagtagcatgtctatattagtaagttgcaacagtgattgagattttagagcatatgtatatgcaacaatgactagaattgacgaaatgttaacggttgatttttttacgaggataattctcttataaaatgcacttttttgcactaatagcatagaaattaaacatccacaaaaaaaaaaaaaagcatagaaattaaactctttattgcaactcattgattagctaatgtacaattgtgataaggaaaaaatacatacaatagataaaagataatcgcttaatttcacttttggacctttaagtatcacaattatctaatttggttcttcaagtttcaattgaaatcttcaagttctgaaattatgcaattgtaataatccttcgataaacttttcgttaaatatttcagttgacaagagaaatgatcgaggataaaaccttctagcttatactctcacattaaaacatcccctaggctaggttttctgcgtcaactgccatatccatgtcaagtcatctgtcatggttaatgtaatgtcatgtcaacaaaatttaaatattattgaagaacttcgaatattataacattaataatttttttatttacaacataaatgtaaaataatttatttattttatcattacacattttaaaattttaataaaaatatttaaatttaacattagttgaaaagttaaacataaatatctcatacaaatacatttgcaaagttacttccaaaaggtttatcactgatgtacaaaataaaaaataaaacctaccaaaattaataataagttattccaaattccaaccaattacataaaaagtgttaggagagttttagagtgtcgctacattcctcaactttctatccaggccacactaatgcttggctgggccttaacgtaacaaacaccatgctcatgctggtaaccatgcatgagttggaataataattctccttgtgacctgaaggttagtggaatgaacaagggaggaagaagaacaagattcggagatggttgtgcgaagggttttgtcatattgtaatgtgtggatcgtcaaaagttacaggaagaaaaattgttgtgagggataacacgagattccaccactttcttaatggtgcttgttcttgcagtaatttttggtgaccaaggctatatagccatatgcgggtgaaaagttgacatattgatgttggaagaaaaaatttgaagtgagagggacctttttccatttctgataaattagaggcttgtaaagaactgttttgtgtcagcctagagataaactattagagaaggatgttgaaattttaaatcaactgcatacttgtttatttcacagggttgttcaatttattaatgaagagtgttaaaaatggatagggaagacaagtgatgccagctagcagactttttgtccttgggaaagcaaatgtttatatagatacatgatcaatgtagttgtgtagtaacattgagtattgttacatagagatgagaatcaaaggttgtaaatggggaatgtgagaaaccgtactgcattgattatggtaccatcctgaaactttatagtggcaatgacaaataaagcaatgcttatactgaagaaataagctaaaagcagcccttatatttttttgcttttaattttatcatgtctgcttttatcatttagaattcggtctttaaccaatacaattatgtcctgcgaattatgtaatcaactttatctagtaggacaatttttttcttcttattaatgttgtaattttaactggttattgaatatttaacaagtttggaaaacatttagcgggctgatagaatacctgtttttgaaagtgctcttcttacttattgttaccctaataattcttaaaataaggaaagaaaacaaagaataaagaatttttttcagaaaaaaacctttttactattttagatggagataagaaggaaataaaattgagaataaaaatatatcaccatgttaaatgacatttatatctaaccagaaacttctaaatttaagtctttaattgcaatgggcaactttgaaattgcagaggattaaattttatatgtttttattcgtatgtaaattagaatgcatttacatgcatctgcctttgactatgtttgagtaatcatttacatgcattctaatgcatttaaatgaaaaaaatttctccttgaataattgaaatgaacgaacgtttgagtcattagaacgtaaatctaaacatgcacttaaacattgtggtaggtggcatcattttattttaatttaacttgtaacattcaaagaatcaattcaattttatctatcttatgcatataccccttcttctcttccaaaaggaaagatacatcttcccctcctccaaaaggaactacaacattggcaatttgcttatcatcttgggataattttattaagtgcggataaagttttttttttttctctttcaaagaccagtgactaatttgcagtacacggttatttaaacaaaaaaataattagtgtgaaagtttgaatggtttttctagacaatttttctttaaagcttataactacctcggtcattctatatagtaattagcccatgtttgattaacattaattttgaaaagaaataaaaacaatcatttatttttaaaacacccttaaatgttgatgaaaataagtgattatttttttaaaaataaattgactaaatcatatctcatttatttatttataatccttaaacacttatcatcatcttgccgtttgttttgaaatagcttgtgtcgttgaaacttgatagcttgtctgggaaggaagtatgatacaaatggttataatttattttacaattttaacgatattttttttttaacttctttaagattagaaaagattacttttcttttgctcattacaaaatcatgactcaaactggtcatataagtttgaattttttttaaagagattacttttttcatagactacttttttaattctggaaaaaatatcaactgtttttagccttttctttataaattattttttattttatgaacacaaacgaatgtgagaataatacaaatatacaatcaagtgattcggattttctgggtcgatgctgggatcctgaagacatgattaggtcttattacgagttacgacacattaaatatttcagttctagaaaattaaaattatttagatgtgagttcatctgcatgcttcataatttgtccgaactgcttacaccgtctttgcattttcatttttatacggatgatgagctaactattcaactctcacttggaatatgtgaatttttcccacttgttctgtccaacaatgaaattcgaaacaatgaaggcatgcatcaccatttcaccaataatgcgaatattatattctaatgcacaactaaacttttatattttagaaaatggtataataatcgatgatttgcataaatggctagactttattgtagaattctcatttttttatggaacttctctaagatcgattaaaataaattatgacttccccccacaaaacaaatcatgactcaaactaaccagtaatcacgtaaagtttgcaaaaagaaaaagaaaacttttaatgatattttttataactttttttataaagtttaagaaaaaatctaaagctgtttgcttttgtattttggattttttccaaatttattatttgttaaaaaaatataagtaatgaaaagtaatttttaaaaaattcacacacaaacaatcaggctatagtttggtgatttcgaattctctggattcaggatgagctagcgagtggccatgcttaggcccttttctgatacatgatataattccgttcacacatgaaggaatatctaataataaataagtagttagtttgagtagttatagatttatttttaaaattagatttcagttttgaattttatgaatgaaaagtatgattagaaaaaaaaattattaaaaaacgaacaaatagatttttaacgaaaattaattattaataaaattagtaaatattttatattaatattatggtggaaaaaatattcaatagattccaattctttgctttcccattttcatttctttaagaggatgttgaactactaactatttaattctcactttgattattatatcttttcccatttattctcttcaacattgaaaacatgcatcagcaataatgcaaacattatattcacatgcacaaattaacacttggattttaggaaacggtacaaatgtatcactatatcatatatgaaacgaaatgaaagaataagaaaaatatcatatgaaatgaaacaattgtctcttttcctaaattaaaagatctaagcatccaccgactttattagtttccccctttacaattaatcaaaagaacttgcacattaactagttatgattggttttaaaattttgtttatatgacatacgtcatctgtctgttcattgtgacaattgacaataaattataaattataaatttcttactaatttatatacgttggtaacaacattttttgaattgttttttgttatctcaagcttaaagacgaacatactgtcacatgaagatgtgattaagtcagagtgattcttgtttatattttgctaatttttgaaacagcgaacgaatcaaatgcgactctatcttgttaaataataataatattataggagtatttgtcaagatattatattttaatctcaagaatcatattttaaaaaatattataactaagaatattatttttggatatattttaaaatgtttgattaaattttaatatttctaaacatatttttaaaaatgaaaataattataacaaaaaataaaagtagaagttataattgagttgaaaaatgatttttcacgttcccgtgaaaaatatgactttttcaaccctcattttagaaataaaagtacaataaaacatgataatactactttctaggaataaaaaatgcctagaaatatattttaacaaaattctcaacaaatatggaatattatattttcaagctcacattcctcaaaagaatcttttaatctgtaaaacatagtactaagttaaaagttgaaaaataaattagacatttaataaaataaagagtggaaatgaacgaaaataatacctggaaaataaaaggtcgatattttacattttcgagaagaaaaaagaatcttcctcttgaaatacgcacaagacaagacaaccctaaacataacataaactgaaaacaatagacattactattacaagtaaaacacaaaagcaaattaaaacaagagaagacgtgggtgtcgtgttacaatcaagatcaatacatgatcaacatgtcattctcagcggaagccatgattggtattccattccaagcataatccatgaagccacagtcattgaacagctgagtggtcgtttcctgtgcctcatcgaacatcataaagcagttgttgttggtggagttaatgaagctgatcatttcgttcagagagttcaatctgttgctcagttcccccatttgagccctcagaatcgcgttctcagcttccacgttgaggtacatctgcgtcgtgatgtctatgtttgtgttgatttgtgcgttctcctttttaagctgatccaattgggcactcagaccttccaggtgctgctgtttccttatcctcgatctacgtgccgattccctattggacaacattctcttcctcttcctctgttccatgatgtctctgtctccttcagaaccagagttttgaagagaactggaaccagatgaataggttccacttccaccaggagaagccatgcaatagtatgctatttgaacaataataactctaatttgctagctagatttaatgattgaatttgaaaaaagaacacgggtacgtactatgtttatactatgtacgaggttaatttatttagttcatgagaaaacgtagaaccagtggaggaaaacaacagagaaagattgcaccaagtgtgtcctgcgtcttagggaagagtttatggtgaagccagagaggaggatctcggagatcactggagaagacatttgtgttgtttctcaatcattcataactgcataacatgtaagtatgaacaaaaattatagcaatgcaatccaagagaaaaataatcaaactttgagaggaacaaggtaattgatgatatgtggaataagaaggttggtgtgaaggagataattatagagggaagaaaaaatctagaggttggaaaagggtgtcaaagactatgggcaggaagaagaacttttcaattctagaggcaacagagaagatgatgatgatgatgatgataagaaggaatatgcaaagagattggatagattttgaccaatttttaggaggaggataagatgagaaggggaagaggttttgaagggattcatggggcggaatttatagagaaaaaaatagcccattgtaataatagaatacaataaaataattggctagtgaggttttttggtctttggacttcatgctttttgctgtgtactgcaaaattaaaaaagtcaatagaaataagagaaggtgaaagagggaaaggacttggaaagggtcacacagtacgacgatgttcactgtttctgttcatgagcacgcgcagttttatttttatttacttatacttaacatatataatttgggttaaagatgttgatatataatcctagtatatatatgttgccatttaccaagtggaaacgcaatatgagggtgacctacttcgtagatgttggaccacccatttgaaatatttatttattagtggaattttaggtagttgcagttccttctggtttttctataataatcattttctggtttttattggtgctccttggcgtctgatattctactccttatattgccaatcacctattatttgtttgggtgagctacaattaaaagcttttgacctcttactgtaaactcaaattattattatacataatcaatttcaacgtgtgattattttctttccatgtattaaacatcttttaagtttgtttaaaatttatcattatttaaaatatataagttacttcaacaaataatactatgttttaactaccctgttattttaatgaaacatcaagagctttaaacatttttccatagagtattatgggagtactgtatatatatacacacataaaaatacgtatataataaccaagtgccgataaaaaaaattacgtatatgaccaagtcaaaaatattaacgacagaaataatccactcatatgcacaatttatttttacattcaattgatccgttgtctttaattatctaaatttaatacaaaaattaatgaaaatcacttaaaatggttttttttattcctcacaaatcataccaccgaaacagaatttagaactcacgaaaaaacaacaaataactctctctaatcatttcaacattctataaaacagaataattaagtaaacataaacgaatcaaataattaattcaaaagtaaggtgcataaaagataaaacttccacattgtttagagccattgatgatatagtgttatatatagatatataatttgaagatggtttaggtttaaattaatccgtcactgctattatatttatatttctatctaccaaaaatatggacatcttgaaatcacagcattcacatttttaattactaaaatattactatcatcattaagaaatcttttccacatggactaattttttccacagcgtttcatgtgaggttttggtgagaggagttgaactcgaatattaacaaacttaactatactccatattctgcagaaataattttaaatcaattattgtcacatgatggaccataactaacacaatactatactggtatttaatttaccgaaggtgatcgatgcatttttcaatagagccagcttttgaccaccagaatattttatttcatttacgatgtacattaagcacatggttccagttacgggttgtgttggaaaagaaagaaaaaggttcccgaccaaaatccagaagggtggccatgccagtccaagttgcccagctatttgtcctattttttttaaagaggaggtttacactaaactttacaaggaagaaaagagaaaaaggtacccgtccatagagtaaaaaaaaaatgaaataacaaaattttgaattaaaataaaatgtaagtgtgaatctcatttcgttttaatgtttatttattctctttttgctcgatttctctacaagtgaactgatccaaagaaaagaaaagaaatgagaatagtatatatattccttggtttattacttgatgtagttaagagaaagcaagatcatacaagattcaagtgagacccatttgtcagctaggttcctctctctctctctcttgcatcatccataagctagaactagaaggatccaaatttttcaatgtgaatgcagagttttaataacactatattctacaaataggtacaagtcatgtctgcagaacaacccttttgagttgggtctcactcattttcaactttatatgttgtttcgcggaagcttcaactaatcttacattcatgcattttttttaatcaataagcatattagatttctattttacatctaactaatatttttctcaccgaatcaatctataataggataaaagatattttaagttgtgatttcatttctaaaatgaatatcccattatttaattaagagacaaaaatatcgaaccagtcctaccattgattctggttacattcatgatgttacaactatgcatataaaccttaccgcttaagtcattgacatcaccagcgccagcaaatccgattttaatattttcaaagacttatgactcctgtttcaggaaaattactaatgctttcaacgtgggagaataacttataattgtatcctatgaaaaactagatggctgcttctgttcattttttctttgactcaataatcttcattgtgccaattgatataagatgttataattttatcctaggaaaaatcagatggctgcttcagttcatcttctctttgaccgataatctccattgcgtcgattatctattaaacttattatatagtccaatttagttagaaaaagactactcttatatatgacattttaatgattttattgcacaactattgcatcattaatactaccgataagatggaaatttctgagttgataataatctcaatccccttccaaaacaaaatcagatttttagctcaactgttaatgtttacttgacatgattaataaagaaactcgagttgtattggtaaggagctgttgaaaaagttcaattgtgttaacttaaaagtaaggtaatttcttgtgaccagtcaaaaaaataacttgttctgaattccctaaacatgttcttaaaatcttatgacaatttcgacgcctgtttctgtagttatgtatctttgtcggcttttatgtagttagaactaagaattacaaacctgattgactaggagaagtaatcgtcaaaaacaaaagatgaatgtgtttaagtatgcctagtctctctctctctcacacacactactctgataaaaaaagttcaactaaacagagccgcaaattgctttcactgatcacccttcagaaaatttcctgaatgtgtgcagttgctaaatggaagacatgttactttacgcacggtacccgaaattgattgttcatatatccaactatgaccaaaaaatagaagacaccaacaatttcagaagtgaaaaaaaaaaagtgaagtatgagatgaaaatgaaaacattatgtaaccacaaagtgttatagaaaacagactcgcagcctcactgtccaaaatcatgcatatccatggtcaatttgtcattctcaacaagaacgttgataaaccgaaagcatatatagagctttctttaacatattttaatgtatatatttaatttatttttattacaatactcaactattttcaataattataagtgtacgttattttctaaaatttggtcactttagaaaaacgaaatactgtatattactattacaagatctgatcatatcatgggtgctcctccaaatacaaagacgtacgagcaccaccctaaaaatgctcattatgttactttacgttgtcagcactccctgcgtctggcgggtgctattagttgcttttcttttcacgacgttttcatcggtaaagaacatcgcattacagtcacagtctcacatgataatacgagattctctggcatattcttgggccattgcccactcctccccctcactttctgagattggagtttggacgtacgggagagaaaatattgagatattaaattaaggatattgttaatctgtcgttaaaatattaggatattgattaaagaattaaaaaaatatttattataaagattatagaagtatgtacaaatttataattaatataattttatacatttaatcaaaaaattcttttaactttttaatcaatatcaaaaatatcgattagtatttgtcttaaattaattttttaatattttattgaaatgtataaaattttgttgtttatgatttttttataattttcatattaaatatttttattttaattttttgaccaatgtaataagacactgattagattagtaagaacaaaaaagttaaagctaattgttagactacccatttcctaagagaaactagacatttaattattcatgtagtataagctaaaatttgataactatatcttcaaatatttattattgataaactatcattttgcctgcttatctatcggatttgggaaatttttgttatgttttctaatatttagtgcttcaatttcacttaatttttctcattaagcgcagaaggataaatttcactcatagtcatgtatgagattcaaaataaaattatatattttaattgatttttttaaaagattttattcatcattataattgtatttcaaattaataccttgagtagatttctaccaatttttttttcatattttaagttatttcaaattatttatcatgttaaaattgcaacaaaatattttatttattatcattttcaaatattactaaatagaatggcataatataaatgaatttatattataattttgataattttgtattatgaagaaatgaggataatttttttattaaacaattttattctagtcaaataactaaaaaaaaacatgtttatattgtctttagtgtgtttgaataaatattcataaacagatgtttaaatcatcttaattttacagagagttaggcctcaatgaggtgtttatcattttgtttcttcttattatgcaatggtgcttaataggattttttctgaaaaatttatgtgagttggattttaaggaatgactcatcaagtcaagatgaatataatttcaataaatacttaccgatatacttatatattacttattaacaaaattttcacattgacaataaaatttagactcataattttataagatatgaatttgtttttcacaaactaaaccaatctttaacgtgccattaccaagcattcttcaaatacaagttgcttaaataagcagaggctcttatatcttatttaggcgcatcaatattaaaaaaaaaaagtaactaataaaaattaatatgataaaatatgaggatgtataattatttatgagacctatttaaaaaaaaaaaataaaagttaatgttttgctgagaaatgttgcttaagttgtaaaaagtaaaatttaatatgtgatgatggaacttacttaaaatatgtaaaaagtaatatcagtgtggcaaacatatcctttaaatgttgcaggaagtttatcagtgtggcaaacatatcctttaaatgttgcagagtaaacatatcccattgtgaactattttcttggaatccgacttatcattagagaaatgatatacacactcctactgcagagtaaacactcgacctcagatgcttatattttttttttctcttttctattttcaataaaatactaggtggtatgaaactattattgctattaatttttacatgatgacaagtaatttgagtgttattaattttttatcctaaattttctctttagagtatattcttgggttaatttttagtccaattacgtttctctcttctccatctttctctctgtaggtgaatgcgagcactaactgttcatggatcatttttctctttagtaccatcggcttatgttaagatttccacacacatattaacatttctagaggggggaaaagactgttaatttcattaccatgtaaatttatgctaatgctgaatatgaatttatattttggcataaaaggaaacaaaaggccaaaaaaaatatccttcctctgcagtctacattagcagttccatgttagtcaagtcagcaaccaaattaatggttaatatgattgcaacttgcaagaaaaaggtaaaatgcacttctgaggtctttacatgttttataatctccttactgtttctacttcaaaataccattacactcctcataggtcacataaagttcatcaaaaaaatatagttcattttgttttataactttccctttcaaaaaacgtgcctatgatacccggaatgatgaactttccatgacactctgatacattttccgatattgatgctgtaccggtaaagcacaagcacaagattttcaaacctgtggtaagtgccacaatgcaaatgccactgatactagtcccttagaaatgaagtaattacaatgtgagaactgtaaatcaactaaggaggcatttgaaagactatatttagggttatgaaagtgatttttgacctttctataattattttcaacatatttcaataaattccgtagttaattaagcttgtgaataagatctcgaatgaaaagaattacttcagtttattgcttgtctaagcacattataagaatctattgaaggttcttaagctttttgtctgaacctaaacacatttggttcactaatgatcccacgattgaaatccaggtagccgtgttatttaaggaaaacatcatctcataaccatggatatatttcaaagcacaaattatcttactcttttctgttaaattttaggaaacaacagatgaacaacactagttcaaatgggtttttagccgaaaaaccaaaaaacagtgtgcatggctatatacaagttacaagatgccattgtcctcgtggagacgtcaaattaaaaaggttctaaagtaatctcatgcaaagtacaaaattcggtagttaaatccttttaagattacagtttatctagggcaaatcagaactatcccttgagacaagcaacgggactagaaagccttggaagaattaataatctatgcattggtagaagcagcttcagggtgataatgtagcatctcattccacatcatttccctaatcatcggttctccccaatgttcatctatgtcaagactgatgggaacctgagcaggatggttgcaccttggatcatataggccagccatatacgggtgttggagagcttccaagacagtaattctcttggttggatcaaacacaagcattttttgcaacaaatctatggctaatggatctgcttgtgggtatagctgagagaagtgtctgcctctagtacagggcagtgatttgataaacctcctggcttttgcattgtcaataaactcaaggtgagattcatgctggcttccaagaacgcttataattagtttcagctggttgagacattcagttccagggaagattggctttctaccaagaatctcagcaaaaatgcaccctactgaccagacatcaatagaggttccataattgtcacagcataacaagagctccggtgcgcgataccagcgagtgacaacatactctgtcataaactggccatcaactccattagttcgtgcaagcccaaagtcacatatcttcaaatcgcaattggcattgatgagcagattcccgggcttcaagtcccggtgaagaatgtttgctgaatgaagatatttaagacctcgaaggagctaaagtaagagtatatggttagtatcattcacaagaatagttaaaatatgcaaagattagaagctcataaagaatccgttaactgctttctacttgtagattattatttgtcaattctgttcaacattctctgcaaaactcataaaaatgtagaaaagatgagggtgacaagaatagtccataatagggttctttttcataagaagcttcatcattcaatcaaacaatgctaaggtcatatcaatttcccaatttgggccaatgattttcgttgtctagtaccatgacaatatctagccggaagaagagaatacagaccccttccctagacttcacctgaaaaatcatggaactgaaacactaaagtctgactcaggaaacatagtaatacattcaaactagagaatgtaaagccacaactcaaattgtcccaactcctcaaaaacagcccgatgatatagtataagaatgcatgaaagaggatattcgatatttaattcacttttaagttgtacgttaataattgaaaatggggaattcactttgaagcatggcaatgccaattaaaacactgcaagagtgcattgcaactatagttcaacccccaacaaaatctccttcaaatgaatatttatacatttctgcaaattcaagaaaattcacaaccacaaaggtttagaaattagaaagaagagctaaaggaaaggaaaataccataacaaactggctagtacctgaaacaagaaatatttgcaatgatcattggaaagtggttgagaggacttaataatttgatgaagatctgtatccatgagttcgtagaccaagtagacatccttaaaacttgttctgtggattggcatcataacatctttcaaagcaatgacattctcatgccgaatatgtctaagcagcttcagctcccttaaagttctcaacgcatcaatagaattctcaaatatattaccaatcttcttaattgcaactttctcattggtctccctgttgatggaagagcacaccacgccatacgctcctcggcctataggcttgattggaacgtacttcgtatcaatctcaaacaatgtttgccatattgtgtaataatgcttcccctttggcttaattctgttggggggttcaactaaagttgccatttccctgcaaattaacagcaacacaatatattctcaataagtgaacacacacaggggactaataataaaactcacaacagtaaattcattattataggcatgaatcatgcatttactaactgtgacaagcaatcaacagtctgttaaagctggtatcaaacaaatatcagaaacacaatgcatatatacatccactggcattgttgcaggataaagggtgaatcattggatacttttttatgccatgttagagaaggttcgaatcaattcttagttgctatttctacatctgggttttgatcttttgatgtcaccttgtctctttttagaacctattctcaccaagcccatctttttggacatcttttttttcttaaaatataacaaagattcaattttatctttcctcttcacctgatctcagccttcaacccacacacaccccaataacaaagaaaccaaatcaaattgattccaaaagagtgagaaaagcgttcataccacaaaattcagctttcatcccagaatctccactttccttgcagctctgactccgaggcaccaaaagcgaatccaaagatgaagaatccctcctcaattgatggagcttcaagtaaacattctgtacaaaaaatcaattttgcacagctcaagcaataatctatagaatagagtggataatggattggatttcaagaagtggatttcatatcatttcaaatcttatcatataaacaataataaatgtccaatttaatcgagatcaggctagagaagaaaaggaggctatagccatagtcatcatattaataaatatatcataacgtatccatataataataataataataataataataataataacaataataataattacctaggcataaaggcatagaataaaataaaatatcaaaggagggtttagtttagggtatggttgggaaagaaagtgaaataagcacattaacatttttaacatacggcataccccatgactcacatgagtcatgacaacgaccccaacccacacggcattattattaataatgattgggtttgctttgcttttcccgtaaaagagagaatgtaaaatacgacaacgtaagtatgtactctatgggtgtttggcctttgggaactataaatctaaatctaaaatataaacgtgtcttgcctttttcttttccacgctaacgttaacattcacagattttggttcagccgtttcgtcttaaatttcattattattttcattcaggtgcaaacaaattggctagtttcctttcaactcaactaatctgtagaaaatctaacaaaattattcggtaccaaccctatggctacaagtacaaccaaaagccattcaatgttaactcgggcagggaaagtgcgttacctcctcgactcctcctattcttgccctacgtagtgctatttctatccatacatcactcctgtttttttatagtattttttttcctgaacttgtgattccaagtctaatattttgaagagtttgatttggtttggttttgaaatatttgatttgtgctattttgatttgctacgtagtctaattaaaaaaacgataaaatatacttttattcttttatcttataaaaatttatttgatttggttttccaactttcaaatttgaatttatgttgttcttgtgaaataatgatcatttttatttattttgggacacaattttgattataattatgactaactcaatacataataatttaactaaaaatagcaaaaaatgataataaaaaaattgtatgaaaaagtctcacaagcaactagaaaataaaattctaatatcatattcatttattttttattactcataaaaatcattgtaaatatacccttttgggtttgacattgctggagtagttgaatacttgagttacataattttgatctaagtgaatttaatatgaaaaattttacattttacatcactaaaagaaggactgaaaatcatgtttcaaaataaaaaaaaaaatccttattttgaaaggaaaacattaacttaaatttaactctggacccgatataaatactttatacatgtagcatgttaaaaaaattgtacatgagttttgtaaacaaagtagacattctattagacaactaatatgttataaatttgactttttattttgtaatgaaaatgaaaggaccaatatcataaaataaaaattataaaagtatcgaaattacaatttaatctaatttaaaagtgaaaaaataattgattgggtttgttcaaattgaaaaagataaattttataactaaaccaattttaattgatttggttcagattataatgattattttattgctcataatgaatttttaatttatattattttttatgattttgattcaagtgcttcacgaagctttttcaacttgaacttaaagtttctttttatttatttataacaaaagtcaattcaatgaattttattaatgatcaaatgaacaatacaaagggaaacataataaaaaaaaacttggaaaccagtataagatggagctacttttgccaaagcatatgtaactccattgccttatctccttacaacatcaagattcaagacagaaacttggatgtaaagacagtactctcctacattcagctataatgaggcccaaatcagaaatatcagaatgattcctattgactttatcaagaattcctttgcagtcagtttcaaaatcaacattttgcagtcccaaagaaatgaagaaattcatagccaacagcaacccgaaagcttcaccatccataactggcatacacggggttatacattcggtcctggaaacactttttattgtggcaaattagtaatgagcactaggcgatatatatgcaaatggttgtatccaagaaattatgttggtgtcgaacaattggtaaatatgttgtatgttgtgattagtgaatccctccctaacaaatattagcctataaaaacaaaaattttctttaaaagtgccaaataaaaacgatagtcatattccttcagaagaaaaacgatagtagtataagttaagataatcttacaggagagagagaaaacttaaccagtatcctttaagaaataaaaataatagaaaaaattgacatttaattttactgttgtaatttttaaaaataaataaaattattttctagatagctatttgcctatttctccgtttctttatctctagtttaaaattctagcatatacattaagaaaacgatcttttcatttgtattaaaattatttgtaactttttaatattctttatatctcttttttattattttgaaatttcatatattcttcttattatttgtaaaaatataattaaaataacaaaaacaataataacaaatttcatcttaatgtattaaaataatgtataaatataaacaaatttttcctttaaaagagacataaaaaatattgtagaactgtataatattttaagactgagggaataagtgcatgtttgatatcaagttgaagaattgattgagttcagaattaattttgaaaatgttttcatatgtttggtattagagaaaaaattaaaattgattttggatctaaaattaaatatggattaaaacaattttaagtaatttttaagttggatccaaaattttgtatttttatttttaacttgattttataataaagatatttaaacataaatcatatcactctaaaattaattttaactaaaataaattttatcaatactcataaaaaaaagaagagtaaaaaaaaaactcatattcaatgatactactatatcgtatacagttatcattaataacgaagtccacactttggatcgattggggcacaatccaagtttggttagtatccatgcttgaggagtaatgacaaatgaaagtaaaagatgaagaataagcaatggtaatagcgtctgcatttgggatcaaccttggctaaaggcaagtgatagttctatccttcatcatcacctccacttggtcccttaagtaatctcaatgtaagttgtctcattgaacatcaatccaatgattggcgtatggatctttttcataattttttctgccatcgtgatattcatgaaattcaaaaaatacatttgctgaatgtgacgcatcaagatcaacttctttggaaattttaaaaatggtaattactcagttcggacagcttatcttcgcattatgaaatccatcatccaaactgaccatctcaaggaagctggtgattggatgcaaatctagaaccttaaatttcctcccaaaataaagcattttctttggaggatcttacgaggttgcttgccaacaagaatcagattgcaaacgagaggattctcatgcacccatgcttgtcctttttgtggaacaggttttgagaatgaatggcacttgttctttggatgtgatcatgcaatttctatttggcaattatcaggattttggcctaaaagtcagcagaaggttcaggtggcggaaggtattaaggatctctctctctcacacgaggatagggagcagctagccatcattctttggactatttggactcgaagaaaccagcaactttggaagaaacactaattcatccacaaatatctatctccccctcttctcagttcttacacgaatggaagtttgctagatgaaacatgtttcacagacctactgcagtccaaaatcacgaatatcacagctggtctcctccccaaccaggctcgttaaaattaaatatagatgctgctatctttcgaaacactacacttcaaatttggtgcagggatgtgtatatgagattattatgttatattttttttggtgatacataagcttcactattatttaattcttatttttataattcttcaaatctcaatttattaattttttcacattatcttgttatttttcactttttattggagaaccaagtccaacagaagtagaagcatatgacattgttacaaggtcttacatgggttcagcagcttggataccagaacattagcattgagcttgattgtaaagctgttgtcgatgatttaatgtgctgcaatggcaacaaaacatatgagataattttggttaagtgtagagaggtcctatcattggtaatttttataaggaagctaagataataatattgttcataagttagatagagtatcattgtctttttgttagcattcaatattttttatcatatatattcttagttgtattcattgatgttattttgaatgaaatgaagcctacaaatcctgcacatgcgtacaagtatcatgccacgtggatgccaacgaagaattatgcgactatgggatttacgatcttgtattttaatacatacagttctatcatgactcatatgtggctgaaacttaataatggttcccaacttcggattttcatatggtggtgtaagagcatcttttatctttatctttaactttagtgttactattgaataaagattttaagtttaagatctgatttttactatatctttcaagataaagggatctctaacataaaaaatgaattattatagaagaactcttaaaatttgtatattctttaaaaaagaataatttttttttctctttcttactctttgaaatctcaaaatgagatttatcattaaagaaataaattagaaaaatcttgagagatattcaatcctatgtggtactatagtatccaccaaaaaatgatctaacattttaatttaagatttaccactaaaaatactctaaaaaaagtagataattctaatatttatttgtcagttaaattaaaaaaagataagttacattttaatttcttataatttggcttaaaatactttattttctgttacctggactatagaatttgatattttatcatctttatgttttgttttaatttattatcgcatcgataatttagtacattttatcgatttttcttaagattaatatattttactctcccgcgattttcagttcaaaaaatagtatatatggaaaaagaaaaaaagttgagtcactaataatggagatttatataaaagatatttgctttaaattgttgttttaacttttaacttgttcatcaaacagagttgggatttgaatcctctcctgcgtgtctctgtccaacttctctccagttggttagaccattggattgatctcatgacagaagttaatgaatgagaaatggtggcccttggattaatctaacggatgagaaattataagtaaaataaagaatgaaaagtaaaatgagaatgagtggaggataatggtattagagaaatttatgtcgggaaatgcaaatccaaatggcaaagatcatgaaatcaaaagcatatgccatagttttgcaaaatcttttcccgaaagttctgctcatgacacttttttgctttttatttatttttcctttgtaattttcatatcttatacaggaataacctgtgtggctgtagtttttaacctctcttgcataattacgaacagtgacattgattgtacaatcatgaaataatgtaagacttctcacattagtgtgggataatgcacttcacgttattgttcgtgttcacgagcctcgatgcttttgccttctgcaatctttcattctattttatttataatttcttatccattggattgatccaagggtcaccatttcccaatcattaactataaatttcagccatgagatcaacccaatggtctacaaaacagatagagagaagctggagacaggaacactggggagagattcaaaattcaacggattaggttaagctaaaccttagttgtaatatctttaccattaaacaactaacaaattataatgaaggtatctttagagtgatggtaagctttcacttttttattttcaaaaaataattttaaaataaaacatgcccaataaaatggagatgaattgctttttctttaaaaaaaaaaaaactcaatttaaagaaccaaaacaattcagtcttttcattctaagttataaacacaaataatcaattctcttttttctttattattttaaagaaaatttcaaatataaccattgttgtaaaacttagtccgacccagccgatcggatcgaaacccgatgatttatcctgatcggtttcattattggatccattatatagttgattcgatcaaatttgtccggttaggttatccgatttcgattggaccgatccaatccgactggttttacaatttttataaaaaaaatggattttttattataaaaaatttggattttttttttaaatatattttgaattttggagtattaataaacttttcttatcaaataatactaagcatatacttatatatagatacatatataatttgaaaattttaatatatatcgaatcaaaataaataccaatcaattaaatcactaactcattatctcaaccaaattaatgacatgagaaaatttcacaactgtgcatataactattgcgattcccgccgtagcaccatccatttatgattaaagccaaaacttgctctccctcaaaaagtaaatatatttcaacaattttcttatgcatgatttttattgtttttaacattgattaaggtattgtcaaactattataacagtattcattcatagaagcatgggcggatgcaggttaacaattggggggggggggcagtgccccccttaaattctcaagaatagaaattttttttataataataaaataaagtaaaataaaaaatagtttaaacgtttgtataagataaaaaattgaaaaacatagaaaaaaaataataaaaaaaatgaaaaataagaaaggagtgagtatggatatgtatgtttgtaacttttatgaatgcagtggctacactcttgttacttttgagcacccatcacatgctaattttgttaattttttctcttttaaattatacatttttcacacttttattataataatttattccttttaattttcttcacaaaaaaaaaaaaaattcggagacgccacctccgaatcccgccactattacctctcttatttattttttttttctagatccacccctaccctatatagaagcatatgacccaaaacatcacaaacacaaattcacctcttttgaagcaagattcaactacccattcatgcatgcctcaaaacatcatgtagggaatttcccatcaacaacattaccaacccagcaagaagtatacattatttcccatcaacaacattaccaacccagcaagaagtatacattatttagtccttgccactgcaacataagaaacagagtccaaaaaaaaaaaaaaaaataggtgtataggaataaatttacagcaccgtcaaagaatttaagtccttaaggtggggattcccaaaatcttaacatccatactaacaaatcatgttctttgataatagccaaacgcttctttaacctatgtttatttaaaggacgtaaatacaaattatagaaataagtagaagttatctaaaatctttaaaaacggttaatctagcaagttttccattaatattatatgctattctacctatttatgatagactgaatatattttaattacttattataattttctaacattaatttaatttttttaacaaactaaagcaataggtgtagcaaaaaaactaaagctatatggatcaagggattttagaatattattttaatcatatagattcacaaatctatgataaatcgctttacgttattcttatttatacgttgtagatgtttttataattttactttttatttgaataaaaaaatatttaatgtgtgtttaaattaaattgacccctattaagtggatctaactcagttaattaaataaggtgtctaaataataactgataataaaaattaaattaaccccttaagtgaaatatatttatgacgcaacattaagactatatagctttatttttgggatcattaactcttttataaataaatcgcaacatcattcaatccattagtgtcaattgtattttttatttaaaaaaatgtgtactttttaaagataaattattttttcattttctaattttctataagtaaacaataatcaatactcataagccactgactactaaaatgaaaaaaaatgttacaaaaatattattgtaccaaaaatcacaaaaaaatgtttaaaatcattataatttctttacattttttaattaattttagaataaattacactaatcactattaatatttcttaaaattacacaaactttcacgatttttttacatttacattagcatgccttacatgagagtacggtagtgtatattttataaaaattaccgaggattgtagtaaaaaataattaaaaaggataagtatagaaataaataaaagtatgaaaagtttgtgtgatttctcaaaatttcaaggatagttagtgtacattattcttggacttaaaatgttaactatatttactttttttatttaatcctcttataaaatgttaactatattttttttatgaatccaagatatcctacatcaataaccaataagtactttcatagttgataaaatgttaactaaatatattcttatatattttaaatatattcttatatatgtacaaaattgatatctttgaacaaataatttttttcatattacgaacttgggatataactcataactacatacttaaagaatagaattattatgtcacactatgttgataaataaattttaatcacgcttgtgaaacaaatagtattaaaaaacttttaaaagcaaatatttttaaaaaatagtattattttaaaacaaaaactgcaacataaatggcctaaaaatatactctttgaccattaggcttgaaatggttgatgcgttttgttttattagtaaggttggtgttggaattgaagaaataaagatattttttagatgcaggaaggaggagtgaatggtaaattggtgatggaggaaactgaaaacgaagcaagtagaaccactgtgctgtgctgttattttgtttcgttgtctgctaataattgtaagcatcagtaatgggcagtggctggcagcacatggccgccctgctccaccaatccaacttcgcgacataaggacaatttcgtaatatttcgtttattaaaatacattttttctcatacggaatgtcaagtattttcatatttgaaagtcttcaagatgtaaagatcatagcattttgccagataatctattttgattctctattaatcaatattttgaactattatcatagttaaaatgaatagcttaaagtctagacggaatgtaataatctttctaccactattccataaagttattagatttttcttatacagaacactcgtgttaataaaatgacttggtgaggatgacagtaatatatataagaatatatttaaaatatttattttattcatcaaattaaataatgtttttaaaataattcattgttattctagttttgaaatataacatttaaattctatttttcctttagaattaatttttatatataaaaaatctaaatatttgatagtttaattttttaaaattacataactacttttttttttgcaacttatgtaatcctagtagatagaagtgtctacatcctatcttaaatcttaagaatcccatttttttttatcggtaataacttatacattctacttaatcaatttatctaattattttattcaataccattttttaaacacatctaaatgatcttattatcacatgtatcatttatttttattttatataatctatccaactcttctctccaactcgacaattttatattttttactgagttccacaagtgactttacattcctacatcagcaacattttttttattatgttgtaattattttaattatattataataaaattgttataaaaaatagtttgactaacatcactacattacgtaattctatgtttttctataattaagtaacacaatattttacaatctcattgttttctttctatcatctaggatggatccttgaagatgatctctaacccaaaatctcccctcgtttttaactctaattgcttcaacttgatttgttcatctttgacatttgttaatttcgtcattcattacttgatgggatgtccaatattagaagagacgagtatactttagaagataaaaactttcttctctaactagctctataaataatgtatctgatcgtttaggtctcttttttcaataataatcaatcataacttctacttgaatcgttgatctacatcatgagaataaatcttatatgcatatctcctgatgtcatcttagagctaccatttttctttctttcgcaagcttgttggtatcactttgcaaaaaaattaactatgctattcaacctttatcattgatattttagtcgtgtaactgctgccatcacttgcaaataggcctgatacttattgtatttctctttaattcttaccccaaaagaacatccctttaattctcttcacccctacaactgcatcattgaaaacatgtaaccatgtttggatgagaattttatgatcccttggggtgaaccttgctctttgtttttttagttggttgttcttcatcaagcttaatattatccaacttgaattagtagaaaaacggtggagcttgagattctcatatgctatttcatgtctctttttactagaccgccaaccattagtactattgaagtcccatgattcatgttgagcttagttcgtggtgattgaaacataataaattgttctaaaaaatagagttttttttttacagcacgaataattagagtttagaaatttggaaattgttcatactaagatattttgtgaatttggtaaacgtgggagattttattaaattttagattagtaagagattaacaattgtatataaaattttaaaagaaaataaaattagattagtttggatttattgggtgaaaatgactaaaaagatagttacggatttgagagaaagtgagtaaaacttttctctttgtaaaaaaaaagaaaaaagaagagaatactagaaaataattttggtttttaaataattttaaacggtttaatttgattttcaaaattttaaaaatgaataattttgatttctgaatttttaaaagatttaatttaatcttaaaaattttaaaataaattaacttggtccaaaattattttaaaataattcaattttttctcacattcttaaaaaaatttaaaacttgaggaataaattgaaattttaaaaaattttgaaatcaaattaatttatttttaaaaacttgagaatgaaattaaattctttaaaattttgaaaatcaaattaaatcatttaaaataatgtgaggagtaaattaatattaagtttttactttagtaaaactattttaaaaggatagaaaaaaaaaaaaaagtaattgtggatgtatttgtgagatgcggaatggatggagtggggtcggataggctggggccaaacggggcggattgtaaagatttatgaaattcccctttgaaccctgaggaggatgttaagacaataagacttaagagtgagtgtagtaagtagctgtaaagatagagagagacgcttcgcaaatctcaatcgaatctcagcctttgaagaaagatgagagaaatcatcagcattcacataggtcaggccgggatccaggtcggaaactcctgctgggaactctactgcctcgaacatggcatccagcccgatggcatgatgccttctgactcctccttcggtgtagcccacgacgccttcaacaccttcttcagcgaaaccggatccggcaagcacgtcccccgtgccgtcttcgttgacctcgaacccaccgtcatcgacgaagtccgctgcggcacctaccgccaactcttccaccccgaacaactcatctccggcaaggaagacgccgccaacaacttcgcccgcggccactacaccggttcgttcctccttccctccctcactctatttcaatttatctgacctaattttcactttgtctgacctattttttattttccccattttcagttggcaaagagatcgtagatctgtgcttggatcgcgtccgcaagctcgccgacaactgcaccggcctacaaggcttcctcgtcttcaacgccgtcggcggtggcaccggttccggtctcggatctctcttactcgagcgtctctccgtcgattatggcaaaaaatccaaattagggttcaccatttacccttccccacaggtttcaaccgcagtcgttgaaccctacaacagcgtcctctccacccactccctcctggaacacaccgacgtggcggtcctcttggacaacgaagccatctacgacatctgcaggagatccctcgacatcgagagaccaacctacaccaacctcaacaggctcatttcccagatcatttcgtccctcaccacttccttgaggttcgatggtgccatcaatgtggacatcactgagttccagaccaaccttgtgccctacccgaggatccacttcatgctttcgtcctatgctccggttatctctgccgccaaggcctaccacgagcagttgtcggtgccggagatcaccaatgccgtgttcgagcccgctagcatgatggccaagtgtgatccaaggcacggcaagtacatggcttgctgcttgatgtaccgtggtgatgttgtccctaaggatgtcaatgctgctgttgccaccatcaagactaagaggactgttcagtttgttgattggtataattttctctcattctcttgtccattgtcatgtttactcacatttactaatattcatcactagatttgtgtttgtaaactggtttgagttgtggaggctataactgtcggattatcagtgaacatgaacaaaccccatctgtgatctggaacctggaacctggagccaaacatacaagttcatgtttggtttctcacattgagagatctaatatcatattgaaatgcgagttaacatgattttagggaaatgttcacttgtttggtctctcattgatgaattgattctgggtgtagaattgattttaacttttaggttgaagcaaaccttaggtagtgtttgcattggatcagaaagtttataatgagatttgccattaacttacattttagaataagaacacttaaacatgattcatttcacttaaggatcaattctaattataaaatcaatttttcaatttttgatctaacattgtgaatttgttgttgttgattgtgataggtgtccaactggattcaagtgtggtatcaactaccagccaccttctgttgttcctggtggtgaccttgctaaggttcagcgtgctgtatgcatgatcagcaacaacaccgcggttgctgaggtgttctctcgcattgaccacaagtttgatctgatgtatgccaagagggcttttgttcactggtatgtcggtgagggtatggaagaaggggagttctctgaggctcgtgaggatcttgctgctcttgagaaggactatgaggaggttggagctgaaggagcggaagatgatgaggaaggagaggactattgataattgaaggcttttttttgttatcagtttccgagtaaaaagggtatatgcttcgttacattaccctgaaccattattgttcgttcttttttgtttttactcctgtgtgatatagttctccattattcaaactgtgaagtgatcaacattatgcttctatttggtggtttaggacctgttgtttgcgatcctcagtcatgtattcagaattgtccatgtcaaaagttgatttcttatgtttatgtcgcaaattttaccagatttccgttttgatgatctctttttgaaccgtgaaaaacgtaccccttgtatgttttttgcaattcgcttcattctgggaatcgatgtgattaatttgtgatttttgtacgcttgtttaagtttattattatcagtgttgggtgaagtcaaggcgcgtaaaaactgttgcaagcaaggctatctggaaaaaagacattactaaaaactaggaagtatgaatacggatgttccagataacaatttccgagtatggaattgagggaatcagaaccttcagaatgaaacttgaaacgcctgaattgggaagtacgaagctgcgtttggtttggcctaaatatggaaaaatgaattggaaaataaactctacatgagttggaaaataaatggtaataagatatctgagcttagtaaaacttgtagtaaacactgttgggaagctctgctcaataataattcggttagtgtggtttgtttaagcatccctcagttgtttttcaatactgtaaattcacaaaaccatgtgactttggcaggcgttacttcgattgaaaatttgtacctatattacaagtttggttgagataattctaaatataaattccttttttcaaaattcaattttaattaagattaatttaattaaaacaaatcaagatcatccaaaatcaaatttgtaaagtcactcaaacacacgcctttcaaaataatatgcgaatggggctaataggatgaagttgtcggtagcagacttaaaaaagttccagttggtgttagaaaaaaataaaaacggttcagttggtatcattagtgttaatgtaatataaccggtcaagctcaggcgcacacaaagccccattctacggcttaaaaattcaagagagaattactaaattcaagagagacttactgcatatctattcttgagacattggccaaagtgtcacaaatcaaaaaaaaaattgtcaaaatgccacatttcagaaacaatttgtcaagctgccacgccacgtaattcgttggccacatcagcgaattacatgggctgacgtggcgtcgcgtgagtggagggcataattcgctggaaggggtgccaaattaggtatgccacgtagcaaatttttcgtaattgcgtataagttttggaaggttataacttttgactgggacgtccgattcacgcgaaattggtggccacgcgctcgaaattgagaggagaaggcctaagtaagtcccctttggggacttgtccaaaaagttttcccaaaagaggcctctaagtgtctcaaaattgcgattttgtatttggacatccaaaaaattcatttttgtctactttttttaattatttaatttaatgttattttttattttttcaattacttctctaaatttcgagcattttgacatatcatacaccttcatcggacattcctagccaaaaatatcactgtttaattgataatgcatataaacttcatataacctttgaacagtgatattttttgatagaaatgtccgatgaaagtgtatgatatatcaaaaagctcgaaattcagagaagtaattgaaaaaaataaaaaataacattaaattaaataattaaataattaaaaaatcagacaaaaatgaatttttttggtgtccaaatactaaattgcaattttgagacacttagaggcctcttttgggaaaaaattttgggcaagtccctcagggggacttgcttaagccttctcctctcaatttcgagcgcgtggccaccaatttcgcgtgaatcggacgtcccagtcaaaagttatgaccttccgaagcttctacacaattacgaaaaatttgccacatggcatacctaatttggcaccccttccagcgaattatgtccttcactcacgcgacgccacgtcagcccacgtaattcgctgatgtggccaacgaattacgtggcatggcagtttgacaatttatttttgaagtatgacattttgacaatttttttttttatttgtgacactttgaccaatgtctctctattctttaagtcaataactatttggaacggctatttgattcttcaacataattattgtggcatgatcaattattccaaaaattttaagcggtgggaccattctcaatcatgcttagcagttagcaagtcgtgggtcctatccccgagggaagtggggacgtgtttaactccaccaaagactcattttcaaacttcttacgatctattccagacacctcatcaacaacgtgggtgttgatcacaacataagtggttggatttgacttagtagagacaggaggttaactccacaaaccctagtcaatccctcgggttaaacaaagcatttatttattttatcgtagtcatttgtttattttaaggacattcatatttaaacattattttcttttacagtattttaatacttgtattatacataacccactaggaccagtctaatattataggacagggttgaggtagcttttacaaaagtcttaaacaaaaatacttgtattatacatgacttgatcacaaaataatatggacccataagtgaacctagctaggagatgcacttacatgtgtgtgcagaaattattttaaaggtgatatgtaacacaaaaaagtaaaatacatcttaatatccgttttcatctaattatccaaccataaggagtgggattgaatatatcgtaagcactgagtacatttgtagaagaatgaagactgatatatagtgcgtacacatttgacttcgcacattagtcttccttattatactgagatggggtgtgactgtaagtgatcacgagcttgcaaaatatccaatgggttaactttgaggagttaaaaaggattgtttcactctgggcaaagtaccatggtaccaaaaatcttgttactgattcctataagcacttgttgaagcagaggtgggtttagaaattcaatggtcttgactcttgatttatcctctcagggaaaatgacatggaaacaaggcaatattatagaaactatgttttaagaagagataggaagattaagatagatatcaagtgaagcagaaaaagtgggagagaggataattgacatcatattcatacgcatcctcctcattgcactcattggtggcatatcctgacaattgcctttctacatttaaaccaaaatcatcttttgatattggcaattcgttaatcctttgttgggctaatggccaagaataatcaaactgcgatgtatttggtgtgatacccattgaacagttgatcatattcatatctagtccatacgggttatcacagacttggtggttctgaaccaaaaacaaagacttaccttcactactacaagcagagtagttttccataaccatgatcttattgatggcactaacatttggactagctgaagtagcagcaccttggaaagtggaacttatcatagaggattggctttgaatttgactttgactttgatttgacatggctttacgatcaagcaggtttctgagtttgagagatatcggagaatttgtagcaatgccacacccttgagtagaaaaattggtgcgagtgtttgaacctcgaaggaggcatgcagcttcatcataagctcgagcagcttcctcagcagtttgataagttccaagccaaagcctaatcttctttgatgtgtctttgatctctgctgcccatttccctgaagccctttgtctcactcctacaaacttcggcttattcttgatctcgagtttctcacagaatctaccctccttggccctttggttttgatactccatactgtatgagagcaatcaagttagagataacataaacatatatatatatatatatatatatatatatatatatatatatataggttcatgtgagaggcttaggaaaatatcataggttaaatttaattttgtggcttagagtagtggagagctcgtattttgtttcttgtatcctttttatctaaaatcttggaagtcttggctaatgcctaaactaatgtggggtttgtatttggcttgtagctgtagtggttgtcctcacctcatgccttagttctttggattggtcaaccaaattgaaacaaagtttaattcgtgatgaccacttacataaaatgttgttttcaggcatataaattttaatgtgctctcgcagttgatcatttaataatcctatagatttttgtacaaggcacccgcgcagtgcatgtgggcttattttatagaaaaataaaaagaagataactgtacgttttttccaccttgaaatcacaccacttatatttcatagtcgtagaatgtgatatatgacactatctcagagcctgccacgaggttttaaattttgttttgtctcaaaatctgtattcgtgtttacaattctaaaaaagcattatccttaattatgtattttcttcaagcacaatatatttcgtgataaaatccgaatcactaatgaactgtaacgagcatttgaagtggagcctccatgaagccatgtttcggtcttgaacaataattggtcatcacataaatatgacatatattagttgtctcatgactggtggttgacttatctctggttggaacattctccttttttttatatttttttttaaagttcaatttcctctaatttttaaaaataattcaattagcttcttttatttttaaaagttttgtttgtcctttattttttaaaataaattcaatttgatcctttttttcatctgcttcagaaaaaattaaaaatcaaatcaaatttgattttaaataaaacctaattgaaacttttaaaaataaaatgacataattaaatatttttaaaaattaaaaattctaattgaatcttttaataataagatcaaatttaacttattttagcttgtttcttcagtatctctttactccttgctttctattactaagcattgctttatttgtcattaccaatctaaaagtttcaggatggcaccataatcaatgcagtacggtttctctcattccccaattacaatccttgtttctcactctatgtaacaacacttaatgttactacacaacaacattgatcatgtatctatacaaacatttgctttgccgaggacacaaatttgtctactagctggcatcacttgtcttccctatccatttttaacactcttcaataataaattgaacaaccctgtaagatgaacaagtatgcagttgatctaaaatttcaacaaaacagttctttacaagcctctaatttatcacaaatggaaaaaggtccctctcacttcaatttttttctttcaacatcaatatgtcaacttttcacccgcatatggctatatagcctcggtcaccaaaaattactgcaagaacaagcaccattaagaaagtggtggaatctcgtgttatccctcacaacaatttttcttcctgtaacttttgacgctccacacattacaatatgacaatcctcacatatcctaaggttcttcataatctttatagtggaaccaacatcggtactcagcaatccaaatgccaaagctagtttttcactatgagccattagtaaaagcctcttctctctatcattaataccgtatggcaccgaacttaggtttggctggtatccaatacctttcagccgttccaaaagatcatttaactccttctttatctcattaatttttggatgagtcacatcaccagcaacgaacttgtgaatcataccattttttgcttcaacccagctccaccctggattttttttcaaatttttctctctcagcaatttcctgaccttagacacatcatcccatcttccagctgatgcataagtgttagaaagcaacaaataattccctatgttatcaggttcaagctcaaataaacgcttagaagcaatttcagcaacgtcagtgttcccatggacgtgtgatgctccgagaagtgctccccacacagctccatcggactccataggcattgtctcaacaagctgaagtgccttttccaagtatccagcgcggctaagaagatccgtcatgcaagcataaagctgtgcagttggaacaacaccataacacttttccatggaggcaaagaggtgctgcccttggtcaaccaagcctgcatgactacatgccgtaagcacccctacaaaagtaacatggtttggttttaccccggtctccaacatgtcataaaacaacttaatagccgcacgagctcggccatgtatagcaaaccccacaatcatggaactgtaagaaaacacatttttttccctcattcctttaaagacatcatatgcctcctccacattaccacattttgagtacatgtctatcaaagccgaccccacaaggacattatttcttaccctaaatccagaactctcagcaatgtcccttatccagttagcatacttagacgcacccaattgagcacaggcagatatgacaccaaccaaggtaacctcatcaatctccacaccctcatctcgcaaccgccggaaaacctccaatgcatccatcggcatggcgttctgcgcataaccggtaaccatggcagtccaagccaccatatccttaaccggcaacccgtcaaataagtcccgtgcggccctcatatcaccgctccttgcgtaagcaacaatcagcccggtccaagaaacgacatcccgttcaggcatttcatcgaacaccttgcgcgcacaatgcaaagacccgcatttgacgtacatgtcgataacggcattgttgacgtacaaatcagaggcgaagccaccaagcaagagtgtctgagcgtgaagctgcgcccccaacgcggggtggcgaacggcggcgcaagcggaaaagagagcggagaaggtaaaagagatgggactgacgcgtcgtttccgcatggaggagtagaaggtcagggcttgagagaggggtccacggagagcgtaggcgcgaatgagagcggtccaggcgaaggggtttggggagtggagctgtgagaagagaaggcgagggtaggagtggaggggaacgtgggggagcgcggtgacgaggcggaggagcttggtgagtacgtaggaagattgctggaggttctttatgtagatttgggcgtggacttctttcgcctgattcaggctgctgcatctctccaggattctcaccacttcccactccaaaacccttcgcacaaccatgccccaatcttcttcttcttcctcttcctcgcttcctcacaacaaggacaattattccaactctaatacttaaatctggatctcacttcattcaacgtcaattatataattgggaggctaaaataattataattatcaaagttagattttaaattaatggattttaattctaataacagaataacataaccaataattatcaatttatttaaaagcctaatataactatatcgagaagtaagaactgtggtaggtgtaataaaaggactaggtgctcaacttcaattttcaactcagggtctcaggcacatcacttcacccgttcaccgcgaagaaacttttccttgacagagccctgtgaaggtggttgaagcttgaagattgttatagatagtgtggactgtggaccaccccatttatttttaatattagtactactaaagaacatatctaaaatctaaatcatatagtaataatttctccttctttcgttggcagcacatagtcacctacctacctggaagtgttaggtgatgtgaaggcactgcatgttcaacttgggtgacctcaaactcaagtactcaacaacccttctgcaagttggaaagatcagagatcgcgagagatggggaagagcgtgcgggatttgggagtggaggatttggtgaatgcaggaggcttaacagtgtcagaaggcaatgaattatatcatgctttgagtttgagggatatcctctctgagtttcagtctccttcacacatatggcgccaaattgtcactcggagactgctcaaaccatcttaccctcactctttgcatcagcttctctactagtctgtttaccactctcaacattcttccctcccactctattgcttcccttctctgtatatctctcttactatgccttatgacttaccactacctcaacacaaactctaattcatctttcattttttgctttttgatttcagagagcaatccaaacacaccaacctgggccgtctcatggaaactcatacccctgaccttttaggaccttcctacaaagaccctattactagttatcctctatttcacaagttttctgttcaacaccctcaggcaagcctactaccctcccacctataattccctttttttattctagtattgtgttttcaacgggtatcatttgtttgtgcagctttactggtcccttattctcaaggaactttcagtttcctttgttgaacctcccaagtgcattttggatactttcgacccttctaaacatggtgggacttggctccccggttctgtcctcaacattgccaattgctgtttgcaacccagttcacacccccacaaaacagatgacactttagccattgtttggagagatgaaggttttgatgattccgaggttaatcatatcacgcttaaacaactccggcactaattgatgtaagccattcaacttttccacctaagttatgttactcatcatcatactagtaacttgtgctaagtcggttaattcaataatttgatgtgtgttttttcaaattaatcgggattaatttgtgtatcattctgctattttacttttgtttcaattcttttcgtgcttgtatctcactttttggtttttgatctttctgcgttatgttttactctagaagtaatttctatctataatctctttatttgcttcctgtgtgaaattatatcgtttcaggttggtagcaaatgcaatagatgccacattctcgaaaggagatgcaatcgctatttacatgcaattgacagtcaatgctgtgattatatatttagccattgttctagcaggatgtgttgtcgtatcaatagctgatagctttgcaccaaaagaaattgcaactcgtctgcatgtttctaaagcaaagggtattttcactcaggttatcttttaaatttggtattatgcgtatgactttaaaagtaaagctgttgttgatcaaagtgagtctattcaatctttgatgttgtctttgactttgttctttctccgttaccaatttgtgcgtaatgctactcagtgtgtgtgaaggaataacaaaattaccaaattgttagtggcttaaaaatttttaatcttcattcgagtctaaatgtctaacttgtgtttcccgtttgatgagattcaaccaatagtccgtgcaaagatatctgactttggagaatttgttaaaatactgattccttggaccttattttagttaacttaggcttatacctgtttgatgagggtactgacaacatcatatagctttgatcctcagtattaacaaaagttggatcttgttctggctgattagtctttgtgaatgatgtgcattgcaataatgcaattaagacttcataagcttgagaaagatcaggtttttaataagtactaattaggtagaaaagtagctgcattgaaagcttattgtatgtcatgtgtgatagcagttttagtgctcaaaacagtactggtgaaaatagatttcatggtgccaagagttttagccttttaggtagagttaagcaaaaataaattaggaaatcaagtgactgaaatcttaatgatgttaagctccaactccaaattctcctatccaatcttgcaaacatcacattcgagatgtttagccttcagcataaagggagtgtgttgaatattccacattgactagtaatatgattaaaatatgagttagcttttgggggttgagttaggctcaagtccaaattctagtaagtatcatacatatagtactcctctttaaggagggagagagaaaaaacgtttcttgcaaaataagatgtagatgttccctttgaattttctttagatataaaaacatatagcctaagcttttaggagagttggtccttggcatggtataaaagtctcctgatccagtggtaaagagtttgatctttgctgccctcacatttaggtctttgatataagcacttacatgatgaacttccaaagtatcaaattagaattgttgtattttactcagcttaaatttgttttgggatttcatatcaagaggtggcaggaaattccctttgtacaggtaaaaaaatttaacattatatttatatttgttgcaatatgaaaatcatactgtctagtttatctgttcaaaagatcataattggcatcttaagctttataagtttatttgtcattatcctcaacttttggcacaattgccaacttaatatttgctattgttatttaatgatcatctgttaaagtatcctttgataaatgtttcaatattatgtttgtcttattgctgcttgggttcaaattcgatgctatgttccacatgctggtgagaagtctttgcgtttgagcatagatatacgtggttgggctattttgggaaaactcataatctattatggaacagaaaatcatcaaacacattgtatttttggaacctgctttctatagaaccctgttttctttttctcatttctgcctcactttgttttatggcgtttgttataggcacgaggcgtgactttagttaatagatatttaatgggatcacaaaggaattattttagtgacaaattatatttttcacttataaaaatgatatcctactctcagccactcttggtattttttgtgtatttcctatttacattctaactcaggattctaacaagcttagttgtcaagaccagattgaactggcaatctgaccgggaatgagtatccagacctgtttggtcaactctcaactgatgttacaaagaacttatcttagaacgaatgcattactgcctctcattggccaaactttgtaatctagatcctaatttcctaactaatgcttacttgaatgccactttcagaatattttaccatgcaaaatttcttgaccactgacctcattctgcttatttctccttgtagtcgagtcattgaagcagctgcatgtaaagttatcgctctgcctgtgataggtgatgatctaggtgtgcaattaagagaatgcgatatatcatggaaggtttttctttcttctagcagacagcatcccaggtaatgtacttcaaaatgtgtctattaagccatatatattcatcctaataaattgtaattatgtgaactaaaatagtctttgcaaaagaccccaaaaacagaaaaaagagacagagaagttgctttgtttctcttgagtattgtctcaccataacattttaatcgtgacaggtcacatcactactctccaatctatcaatcaattgattctgtcactaacatacttttctcatctggaacgacaggtaaacattctcccttaaacacatcaagcagaaactaacattgtaatgattttctggttacgtttttacttttcaggggagccaaaagcaattccttggactcaactttcaccgatacgaagtgctgcagatgcatgggctttcattgatattcaacctggagatgtctattgctggcctaaaaatttaggatgggtgatgggcccaactcttatatattcatgctctctatcgggtgcaactcttgctttgtatcatggatctcctctaggccatggttttggaaagttcgttcaggtatttgtccaactcttatatttcagtccttatagtatttataattaacataacatgtcttattctacaaaatggtcattattattttaataacctaagaatttggaaatcaaacaaagtaagtgctgactagtagcagaactgagtgggaactagactagttgttttttctgcaaaatcatggaagcaatgaagtaatatgatacagtgggatgtagaaggtaatggttgtaaggtagtgttatctatagtgagataacccaagaactttcatatcttttgtgaaaataatttgcaactgtgtgccacactgatgtcataacaaggtcaaaaaacttttctcattctttcgaaaatgctttgtcacataaaatagcattaataagatgaagtttgtgatgacagaaaaaatatattgtctcattgagctatgttcatagaagcatttacatcaacttttgcaattattttatggtaaaaaagaaaatgaggtgtccctatgcagaccctcaaggacaaggtgcttctagttgaattttaacccttgcactataggcctggatgaattatacatgcaatctgaatgagttttattcttaaaaatgtaaaggaaaggggtaaaaaacttttagaaagctagactctcattgctagaacttgacttagctacaaagaggttaaataaggtctggaagggggcaaaagtccaacataaatgaaacaagataaaaattaaaaaaagcgtcattatttgttgtagattatattgtattctgcatcaatagaatttgatacattgcacaaagcaacatcattcaactacaattgttcaggatgctggtgttactattttgggaacagttccgagcttagtaaaaacttggaagggtacacaatgcatggaggcttggattggacaaaaataaagtaatttcttttaagtttgaataatcaggtaactaatgtgaaaaactgaactaaactgtggttatatgcacagaacattttgttcaacaggagaaacttcaaatgttgatgatgacctctgtctttcttcaaaatcttattacaaaccaatcattgaatgttgtggaggcactgagcttgcatcttcttacatcatgggaagtccactgcagcctcaagcttttggagcatttagcacggcatcaatggcaactggtttggtcatccttgacgaaaatggagttccttatgtaagaatgttttcttgatagtttctattatttgatcatgtgatactatatatgttgccaccgaattgacactgctttccatcatgccaatacccacatataattttgttgctgcaatggataatggatgtcaagtgtattacataatccggactcagaaccaataatggctaattggaaatgctatctcaaaatctcaagagtcaagactgacttctaatggtcatcagttagaatgtccatatggattctccttcactatttgtttctgaatggtgtaattcttatactaaccctttggccaccaattttctcctataacttacactcttcaattctcttatgattttttactcttcccaagtgggttgcatttcctctagtagatgaccaaactatcttcaataaatgttcattgtgatatataatagcaatttttgtggtatagacaacttattttttaagctatctaatttgtttgatctctttgaccaatgcgacagccagaggatgttgcttgtgttggtgaagtgggcttgtttccaatatatatgggagcgactgatagattgcttaatgcggataatgaggaggttttctttaagggaatgcccatttacaaaggaaaggtatgattttcacattcagttaaataaagaaagaaattagagaggatatgattactgtttaactctcaactttggatgtttgtcaaataatgctattgcctatgtcagtgatcaatatctaaatgtttcttagaagtgtggattagtcagatcttccatcaaggattttcagatagtcccttgtaaattacataataacttattattagattgccttgtaaatttgtaatgttaactactcttttttttggttgttgctgaaatattaactactctcgttctattgttattgtcatctactttttcaactggtttatttatccataatttatcctgtctaacatgatataagcaggttcttaggagacatggagatataatcaaaagaactgctggaggccatttcattgtacaagggcgggctgaggacacaatgaatcttggcggaataaaggtatcatccgctatatttatgtttattatagctccttctcccagttctactctgattggagatgaagcttctgaaagctattctgctagataaaacatggtgtaagaatcctaaatatttccatgtcaatgtcctgaataaattaataagaatggaaggtacttccgtacttgtaactgatcatggattcatcagaaattcataaattcctatcttgatatccgtggtctgaccgttattcttacttggaattttctgttctgttatgcagacaagttctgtagaaattgagcgtgtctgtgatggggccgacgaaggcattttggagacagctgcaatcagtgtttctcctgtagaaattaagcaactacggttttgaattgaatacatcacgaaaagcaataacttaattatttaaagattcatgaaagtcttagtttgaaaggaaattgaaattttatgcaaattttaacctgacttatgatgaagttactgatttgatgttcacaactcattttgttactttacaggtgagccttgttaaaattgtgcccgactttccccgaacagcttccaacaaattactaaggagagttttgagagatcaaatgaagcgtgagctatcaattcagagcagactttagtaacattattaattcagtccattccctatgtctagaatacaatttatactgggtgaggtctttgcaatcaaatggtgaacatttgatattattagtgggaaatccttcactttataaagtcgtaacattgtttattgtcattgattttggtcttcttttaatgtaaaataatggaatataaagtaaaaaggaataaaatgcagagtttaatttttatgtacaatctgtgtaaataagtttgcattattaattattaattaatcagattggtatgatttttataaaaattaacaaatttatattatgattatttgtaattgaatgataaagtaaaatcctttacactatcaatacatatattattcattctaaaatgaatatatattttttgaagttaagaattaaaaagattttaaaaattaaaaaaaactaaagtaattaacaatagtataatttttaaaactagagagaggattgatttggatattttgactatctactaacaatatcgagggacgatttggccagtatttaggtaaatgtgttgaattttttttttagtatattaaacgtttcattataattttgatcctttaatttaatttttaagtttaatttagttctcttgttattaaaagattcaattaggtcctataattttaaaaataatttaattagatctttttatttttaaaaatttcaggtctcttattttttaagattggttcaatttggtcccaatataaaccaaattcaattgtgtttttcaaaactttcttagcaaataaaagagaaaataagaccaaactgaattaattttaaaaaataaaggatctaattgaatattttaaaagtaaaggaactaaatcaaatcatttttaaaaattaaagacttaattaaatctttaaataataagatgaacaaattaaatctaaaaaataaattagagaactaaaatagtaattaaatttatattaaatgcattcaggaaaactagaaacttaagggcatggacatatttgattctcttcttttttttttatacacaatatttgattctcttctaaaacaactttgcactactcattactcaataaccgttttcttatttaaaattattaagttttgaaatttgttttcaaaacaattgttttaaaacccaaaaaaatagaaatagctgagaaatgttttcctgtcttcgtcaattttcattttctttaacttctctctcgattccacactttgctgtgtgcttgcactaccctccaattttgtgagcaacttctgtcaaatccacacttagcagtttgcagtgtgcttgcactatcctccatcaattatgtgagcaactttgtttagttgcattttgaaagctaaaaacagttttttttttttttaaatggaaattaaggcacacctttagtttcgagattaaatgcacaatgctgcatcacatggtaggacctattgtctttccccaatgatatgccagcattgaaaagaatcatagaattgccaaaacaatgccaaagataaccacaaccaagaatgccaacaaagagtacaaagtaagagagcaaatctgatagtccagcatagaaaaaacacagcccaaggtagggagtcaaacacagctacggaaagatgttggattttcgtactcttcctttttcatatgcgggtttcgtatcggcgcacggtccctcaatttgaattggtagtgattttaattgtcaatcccaatcatagaaaagacttttctttctaaatttttataccccaatctacaaattatagacgtagggattaattttgaccaaaaaaaaaatattcaaggactttaagcatttcttttatcattcaaagaataatgatcaatgatatagatttcataaattaatttaactgtttttcctgaataaacattggctactaatgtctatttatgatgtaaccaagtaaagatgaacgtgtcttgtgtaagaaattctcacatcctaaactagtgtaatatatttttaaaagaattgttaattaacccttacgttcacgaaacctataaaataaagactccgtgcacaattaaagtaaaaaaataagtgtatttggcaatgctgatttcttttcaagggaataaatgccttttgcacggaaaaaacggttcaagtacgtaactactatttatgtgattaacattttagaagatattcagattgtaatcttcaattttttttataaaaagaattactcataattaaaacttattattataagttattaagtttttttttttatctagacaattggatgtttttaaaaaaatatctttttaatataattttactataggaaatgtcttttatttaaatatccctttttaccaaatattttcaaacataaaaactatttcatggaattgattataatttatttttcataatctatcaacacattttgtcccttttgctaaacgccagtttgtagtgaaagcaatctaaaacaggtattataagggtactcttgaacaaaagatatacataggcaaaaccaaaatgcatatggcaacttttaccaacaaaaatgtgtaaatggcatcaaagacactcgcaattctctagagaccatttagtaattctgtaacattcacacctcatcccaatcccatcagatgatctgctggttgacgctaccaagctttgagaaccacccctctctctcgcaaaaaaagagaggaaaaaagtgagcttaaacgaattacttacaaagcaagcatcaaattcaagtaagcattattatcactatatctcaaacaaaaacaaaagtacaaaactgaaaaagccaaaacgcatcaatagtactacatttgctcgaatacaaaactgatggcgctggattatacagctttagtacagcagcaagataccaacctaaagtcccttgcaacatgcatttggatggcagaaaatagtgatgcagaggaagcaattagtagtcatttacacaaatgaatattcaacaccgattgcagccattttcaaacaaattgcaagaaactgcaaaggacatgcatacaaattggaagtattaaaatttctttgctcctcctgctaagatcaccaaattgtaaatgctaacagcaaaaagcacaaaatttgctccaagcaatgatcaagcagaatagaagtcattttgctatgtatttccccagcctcgattttcacattctagtctcatttctttgccaagacctcccccttgcactcactaccagcagtgaccacaaaacctgctccaacctgccaagacaggcaatatcacattccaattcaaattgcgatcatgaaaaattgccagagagaggtgaaacaaattacttggcaatcttttagtacagcacgttcttggagctgtacattgctgcagataacagaaccttggattgaacaagattctccgatagtaacatgattcataactactgaattaacaacctgcatccataaaagcaagtcaagaaaaagcttggcattaacattattgaatacaactcattagtaagatgccaatcagtgttgctgaccaatcatcgagggttggagatcataagtgtcacagacaaatcataagaccagaaagtaacttgttaacttgtaagaataatatcaccccaccttaacattggcaccaatccgacaatgacggccaatgacagaccgtttcacactgcatttgtcacccatctgtgaaccttcccccagtatacaatgtggtccaacctaaaaacaaattgcaactatttatataaatcttaaaatgggaggaccaaaaatattgctccagaaactgtaccagagcacacaacttaggtaactaactcacagttgtttttgccccaagctctgcagaaggatggataatgttgttttgagtagagaaggaataccctgataagtgactagcctctcctatcacctgtcacagtaaaaaatgaataacgcccaagcaaccggaactatacccaaagaaaaaatgtaaggcaatagcaagtgcctgataaagatcataacaataactaactcacatcacggttaatgtcactgtatgcttgtatagaatttaagcgagcacagtatttgctgcttccagcaatatacatacaacatttgtgggttcttcgatcaaaagtagacccataaggacccagtgcatgtcgcagatgaaaggttggttcagatgcattagcgagtatttgagatagcatttgttgattgctttgagaaataaccttttcagttccgttttcttctgtttgtggcataccatttaataatacttctgatttctaactctcatttagaaaatatgaataaggttagaatccttaaaagtacaacattacctagcctatctctgcaaaaacctttaacaactaaccagttggctccggactagatatggcaatacatcatgctttaagctatgaaatgcactcttctgatctagaacttcttgtagaactgatctgcaagaaaagtttgtttcaggatacaacatgagtaatccaagactacgaataaaggagaaagttaaaaagtaagtgaatgtaccttttgaatgcatacaagtgggcgtccattagatcagctcttatttctatctacatgaaggacaaataacaataaagagaaacaaagagaaataagaaattgcagaagtcttgcatttaattttctattactcagatgaagaattcatattttcacagaaaatgctatttctttaagattgacagattgaacaattttcttactctaaaagcacaataaccaatttccatctctacacaagtaacaaacagaaaatacctccaatactaaagttggtatagaatagacacttatatctcacactagaagagtgataaactcataacattagagaaattataagcaggaggaacaaactaggaaggttcagagacaagaaagaaaaagtacctggccaactgcagggagcatgatcttctggattcgaagatctttttcaacttctgcacctgaaaagagttgcaagattccacatgagcatacatacaacaacaaaatgacatatacaagggaaagctagataactaaccagttgctatgtgaactaaaaactgttttgtgggatccagccctatcaaatcatagcggccaggtttcttggttttgtctttcccaccagaggatactgactccaaaggtccacttacaggagcagagcaaagcatagcagtgacaactgcatcatgccgtctatgagtagctgcaacagcaccaagtggcacatcggtaacaagatcaccactgacaacctgcagaaaatcaatacaaccataaagaacaacattattttaatcagagttcaggggcaggggaggggaggatattccaccaaaatgtctttagcagttaggtgatgtgaaatggcccgaatagcacccgctgtccccacatcctcaggaactgcagctacctggaaaaaatttaagcacaaatcatcacctttggacatagtatcaatacttttaagtacaaactatataagacccttaaggaagatataaggttggttggatgattaagaaagaagggaaggagagaaaggtggtgggttcggtccctcctgctaaaaaaaaactaacaaactaacaatattaacatttgccgataaaaaaatttaaaaataagaccctgtttgcatgagttaaaatctgcttatgcataagctaatttatagaagctctcccatcttgcttctttaaaagtttattttaatttatgcataagctaattttaacttacgggagaaacataattcactttaccttcttattttcttctctaaaagtgcttgttgaaaagtttatccacacaggcgaattcattctattttttttttcctactataacttataaaacctacataatatccttatgtttgtggtcactactgagacatatatagaggcaatgaatcatgtttggtaaattttctaatatccaaaaagtgattacctcaacgtggaggcgatcagcataagcccccgaaatccaagccccaacatgaagagccgcttcttcgccttcaaccacctacagttaaaaaaatcattactaattcactatttaccctcttcaataacatctaaaatattgcaagaaatgaaaataccaaaatgagatctttgaggttgctaagctccaagtactcgagaacgtaggagagaacggggcgattcgccaccggaagcaacgcgttcggaagctcctgcgaacagaaataagcgctttagaataatagaatagcatcgaaatttgtttggtttgaagcattcgcgttcggaacctgcgaaacgagagggatgagcttcttggagacgccaccgccgagaacgacgacttggaaatccatggccacgacgccaacagggttttgcgttttcggagggtttctgttctgttttaatttccctgactaatcaaatctcggattctatacagcacgcactcactcgttcattcgcaaacccaaacccaaaaccaaacaagcctcaccttcctttagaatttgcttaaaccttaatgtatagttagtttttaaattttaactaattttgttttagtttgactaattataaattaaaaaatttattaaaaatgaatacaaaattcattaatttatcatgaactaaaaaataatgtcaagaacaaaaaataaatttttattttataaggaattccatataaaaaataaaattaataacaagtgaacacaaaaaataaatatttattatgaatcaaaaatatatttaaatctttaattttatatgttgtcaaatactcttagggagcatgtgtaggggagaaatttttttcatatatatgaatcatgatttctggaaataaataaaatttatttgattgatcattgaaatttttgacattaaatacttatgacattaaatacttatgcatatttttttattttaatgattcaccacattatataatttggcaaagaattatgtcatgttttgactgtaataaaaatattaaactaaaaaaataaataagattttcacattccaataaaaaagttttcatgacaaatttactaaaaaaacattatggaaaacatacttttctaggaatgttatttaaaaatgcatatcaaacatggataagtttcccaacatatgattcctcataaacaaaaacctatctcctattaggcgttcccttcgagtctatttggtggccaaaataagagggaatacgatatgatagttaccatatcttattataatacgaatttgttacataaatataatatgatagtattatcttattgcttatcatattctattatttttattttaatatatttcttattttgattaaaattatgatcgacaagatagaataggagttatgttctctctttcctctctctctatatatatattataattttaaaacataaatttaaattaaattatcaattaaaataataaaattaaataattattattcaaatattttcaaagtaaaatatttgactactttaaaaccgttatataattgtaaaaaaataactacataaataaaatttaaatttttatagttcagtttttttaatcatagtttataaaaaaaatttataaattataggtaattttaatgaaacaatatttttaaaatttaaccatgtccttttgttggtgttcgcggattggtttgaatcgattttgaccaaaattatgattcaactcaatcaaatttgatcggtttagttcaattttaaaaaaaaattaaaacccaactcaacccgttcatgaacggttcggttagggccaacagattacccatttaatatatttttcttagaactactattttatatcatgattctttcgaatattcaatataattaacataatattatcaaatgtatgaaagtagtaaaattgattcatttaatactatgaacataatgttctaaaatagacttataatataaattaaaacaaaagattcttgaacaatatttactataatagtctgaatcacaactatttctcacaaattaatatgaaaaaatgggtgaaacaaataacaatatacccaaaagtaatacattaagaaatttcaacacttgcaatttcaacacttggagatctaatattaatagtattgaaagttaaacaaacgactctaaaaatttaaatacaaccccgttagcccaaaacttaattgatattttatacaaatataatatttttgcttttatgatgaaatgacatcatttcaatcattaacaaaaaacgtaatatcattattttggcatcgttgaacactgatttttaagtaaccttaatgttaaaagaacaaaagaagaagaaaaaaaaaaagacagcattcgaatcaaactttcaaagaatgttaaaaaaacaaaagaaaaataaaaagacatcatttaaatcaaactctcaaagaataaatcaaccaacgaaagaaaaaaaaaatcaggtcctgactattactcactctgaaactaattctctcaatctttaatccaaacaggcacattttcctcttataagattttatcaaagattagcttaattctaaagcaaacaagaaaaagaaaatggtaaatcaaatacaacaacaaaaattcgagtcaacactcgacaatgaaggttatttcttttcttcccatccttgtttccatctaaatctcaatgaatacaaaccaaaataatcacgagaagttaaagagcttcgaaaaagaaaaaagaaagcgcaaaggaaaacgtgatgcttgatcgatctaatgagataagatgagagaactgagaaggagttggtgcataaccgcaaagaatgagatgacatgcgagagaacacagaagtgcaaaagaaaaagaaacctaaacctgtgacatttattgtatcacaccttcacagcaaagatgagttgagatgattatggactgacccttcattcggcccaacacacctttttttattgtcaaaatatttttttagttttaaaattttaatatatatataataaaatttatttttttattacgaattaacggatcgggtcaataggccaacgaatgtataaatctaaactcgtgactcaactcatacataaacaattttgatcggttcagttcgattttgacccaaatacataaatgatccaacccaaattattcagattagttcggatcgattcgggttctcgagtgactcatacccgtgaacacccttcttcgttatctagtatgcaccaaacattcaatacaattaaagtttatcacgttcttattatatattgttcttatcctacttgtatatcttatcctatcgtattagaattggaccttagcagaattttggcagaggctcgggactctaactgcttgcttgttgaagaatgaatcgacgactcataggcaatggcttggttaagggaaaccatcggagttgtagcgaaaatgagtcttccaggggcaattattactgcttatggacccaaacctgggtaatctatccatgaccaggatgaagcttgggtgaaactaagtggaggctcgaattgactgatgttgaagaatcagtgaatgagttgtggttaggggtgaaatgccactcaaacctagatctagttggttctccccgaaatgcgttgaggcgcagacctcttcaagtttatatgtaccatactctagtctcataaggcaatatacactagctaatagtcctcatggtgctacatcataggcacactgggaacgtagataattgtaactgtatatataaaatgatagcaatggaatgtcaatccttggactttatttgtaaagtcttgattccttggtaatcgaaacccaatgatatatgaattagtcgatgtttgactagccaaaaagacatgatcttgcattttttcgcttctcctaattttttttaccaatttggtattagtcttttatatttacattatgatgaaaattttcaaaatagaattgctatttcttattgtactttaaaaaaaagtgtcaagcgatatctctaatgtaaatggcacttgataaaataattcttgaccataatcgccgatatgagtattgtatccaacatgaaacttgtagttggttgtaaaacatctattctctcactgagaccaccaaatgatcctttaacatcaaattcaccttcctttaattggtgctcaaattttgttccatacacacaacttttattttattttttatttttccatggaaaaaatatttaatatttagtttgatatgtaaatatgaagaattattgatttaaatttgagttattattttttaaaatgaaaaattatttaaatcaattcatgcctgttcgtgtttataatatgaatttttatatccattttataatatgaatttgaatggttcatggctactcttgaatataagtgtttttaagttaaattaggtagttttttttacattaatttattttttatttcttttaaatagtatcacttaaaattaatttttaaattttaaatttgacatattaatagatgcaaaaataggttaagttaaataagacgtattgcttgaataaacataaattattttaataaaataataatttaaggcctaaatctagtttattatttataatagtccatttcttagacttcaatttaattgaatatcattggatttcatcacacttcttaaaaaaattaaataatgttaattgaatattatattattattttttacaaaaaaagtcttttaaaactttttttagggtacttttaaaatcttacttaaatacatcccttaaatgatgttgtacaaatatattcataaaaacttcctttttatactaccttgtttgatttttaggattgatgcattaatttatctactttctaaaattaagaaaaaagaaaatagaaattatatatatttttcttatattatttgaataaatagagagataaaaaaagtaaaaaaaaaattatatcaaatgaaattatggcatgattaatataataaccatgacgaagaaaaatatattaatattttatttggcgcgattagcgtcagaagcggcattgttagcatcatgactcgaccatgtggcgcgattagatccagttatggcgctgttagtgccagaatggccctggagaccccctgattcgaatatctggcacgattagcgccagagatgatgcgattagcaccaaaatgctttaggaagctctttctttcgaattcttggcgcgattagcatggggtgtggcgccattagcgtgggaacgcggactggggcctataaaaggctattttctcattttgggagaggaaaaatgttcctcttcttcttcctttgcttttctaccattgacaacttagaaaagtttcatatctcctccatacctcatctaaacacttcctatccaactagaaagttgattagaattccttcatgagctaggttccagcttcaattcttcgagagaatcatcaatcagagagatcccgttctctaggggactttgtaaaactgagttttggaagggaaagaaagcgattcaaggacgctaaagcttggagaagtgattctccagccttcctcgactgtttagaggtaagaaactcaagttttaccgattgatttgtgaaatggttcttgggatgaatagtaacccaattgtgttagggctggaattagtcttggattctttagaaaaatatgctcaagaggttgttctgaggaatattgagctttgaatcatgactattgatgaagtttggttttgactctgagatatgtatgagtaggaagaatgttagttaaatggcgggtatcatgatatgaatgagcatatgtgcttttactaaaagtgttcaggagaccctatagaaggtaattaagcgttcgattgattgttttgaatgacttggttattcttgaggtatagagtggttaagcaactgaatgctttgaactagtttatgtagagtctagggagactctaagatcttggttcggtccagatagatcctgttgagggtctgtgaatcgcttataaggtggttagctctgataaccctaagatagagaacagagaggttgtaatggaaatgaatagtgtttcttttcattctaacggttgagaaccgttattgattgattgtttgtatgctttgtgtagggtgtgatattgatattactggtggttgtgaccatgaattcgggagagccggtgtagcgctgagagcaggtaagctttttgttcttgggagtgtttcccttgtttgtgttccaccatactccaaagggagtgatgattattgtatgaattgatgcatgtatattgaaattgtgtgttactattttgattgaaatcatgtacttgatatacatggattgagactatgtgtgttgattaatgagatttatctggccagtagaatataattgaatcgaataaatatatgtttgaataagtcctgatgataaatgtgcccatatagatgatatatatatatatatatatatatataccatgtacatgtaatgtgttaagagtgtgatggttaaatgatgatgatatattttataaaaagataatgatgaacccttgagacatatatatatatatatatatatatatatatatatatatgtgtgtgtgtgtgtgtgtgtgtgtggtaatatggcttgagagctgtgatggctagtttataatgccaattttaatattatatgcatgaaagtgaaccagggggaggaaaaatttccaaggaccctgagtttattgagattattatctcacccctgttggggattatgttttgcaggtgatattcaaagataggtcccagggcaagaagcctgagcaggaatagtttatatgagaaccttaggcatagtgttggagagcatattggttctacttttgttttatgcctatgattttgtacccattgatggatatgtacagttatgatttatatatactgtatattataagaattcaccatatatgatgtatagttgatgttgttaatgacgtttgatgatgtcattttgtttattgcttccattttgattgtatgtgataattgctgcgcttaacgaccataaatcaatgttaatgaaccggatgcatacggagcgttacaattaatagataattatgtctcttaaatatgtgatcaagtatttgatttccaattcaatatgagaatgaaagagcttgtattggaaaagatattgtttatatggatctcaatatggtgaaggattagccttttaactcttagttgatggatattccaaaattacccaaaaattgagattgtgagaggaaaataatccactaaaatacaatcgaaacaaaaataaatttataattttattaagattttgtattcaaacacactttctatcttaaggtgattattttacataaatattatatgaatttagaaggcataggacaatattacctctatttaaaagggataaaattgaggtatttcaatattacgatgtgttggcctatgtgagtgatggttttacagaggatctgacattcgtcactgtatttccaaaacaataagcagtttcctaagtatggcttgccatcaacccgtctttcttcaggtctacaacaagagttttattattccaaacaaggataagaacagtaacactttcatctgctttcatcctgtgaatagctcgccaagggtgattcttttctttttttttttttataggcaaatcaagggtgattcttgggcccagaatcaaggcatttcgttattagaccacctagttatgtaaatcaaggtcatcgtagaacaaagtaaatttgtaattacaaggagtcatgtcttcaacccaactgtaactgaaattatctagtcctatatattatgagttaaatggcttaaactcaactcaagaacttctagggaaagaaaccgagccaaacaaaaggcaaaaaaaaaaaaaaataaacaaggtgaaaaataaaaaagcacaaagaggacaaagggaatacaatccaaatttagccatgccattggcatcagaagactgattgacttcgggaagggttgtgcaggaaagtgacgaacgagctcaagtttgaggtcctcaaaaggcttaatactcaatttaatttaatctgatactttatattaagtatttaatactcaagcctgaggcttccccatcttgcaatgaagagctccggcagcggcgcggggtgcttcctgcggcgacggagcaacgaggacatgggcgatgcgctcctcgcgtgactgtgtcagtgaacaggccgcaaacaacctcgtctttcagcgcggagaagaacctaaacaagccttagacatcaaccgcgccctggcggcgaggcacgtcaggcccgacgtggtggagctactgctggatctcgacgcggttggtttgggtagattgaggcggtgaggatgagggaaggacgaggactactcttgatttgttttatattttttaaccgccactacacatacacatcattaaaaaacctaaaaaatatccctaactgtcacattttcgtcaaatctctaaaatactatactcgctagggaagcaatcttttacactcaccatcgcattggattcccatcaaccggtcattattatgtggtccatttataagactatatatagtggtccaatcttagtggccccaaatattattattatggataatctcaatgttctaattttcaacactccttccttggatcagcaaaacaatatactatacagtaacatttacatttgtatggtaaattcaaatgcacaaatcaaactttgcctttgccccctccattttagcaaaagaaaacaaaactagtaacaaatttggcttttccaattctggaagggtagtagcatcttcacaagtggcgagtcttgtcttgtacatcactcactatatttcaacgcaacaccccgattggacaaacccagagaaaccctcaggcacatttatctttctcaatttacggttctgcccttcctccatgtccaccaaatagaacccatgcggtgcaccttcgtaatcggatccactcaacataaccctggacccaaccgcaaccccacataccccaaccctgagccccggatccgaacctctccaattcaccaatctcccatctttcccaaccccaacacatgacctaggacaccgaccctcttcccaaacaccgtttacctccctccactgacccgacccgatatccaacacctccgccgacccatcgaacatcccttgcctctccgtggaataaccactcacaacccaaaactcatccccaatcaccaccccctcgcactcgtccctctctcggcccatcgggttcagcccggcccattcatcactcctcgggtcataagcccacgccgtactcagcgcgttcttattctcatcatgcccacccgcgacataaacctgacccaaccccgccccgatggcataaaaagaccgcttctccggcatgtccttcccccgccgccactcgctcgtgcgaaaatcgtaaacaaacactgccgtcagaggctcgtaacttgctgggtcccaccctcccatcagcacaagcttcccgtcgcagctcgccagctggcagaacagcggcagcccggacgggtaatccggaaccgggtcgacccggtcccacgacatgctctccgggtcgaacacgcttatcccgtaaaccgacttgtttttttcctgaagcagttgctcctcacgcgcctgaacgaggcacgtgacttttcgggtgtggccggttttcttcctgtgggagtaaaacgcatcgctctggaggaggcagtgccactggctgcagactcggagggcgactcggtgcgctgagtggggcaaacgagtgaggcactcgagtccgagttcgctcggtaacctgggtatcaactcgttgaactcgatcaagttggagatcgtattattatccatcactattgagtaatgagagtgtgtgtgaaagatgaagtggcgcttgaagaagcatttatagagatagaaagaagccgttagataggtcatcatactccagtagtactcaatcacctccaactggttggagcacacggataatgccatctgtgctgtgtgcattcagatattttcagtttttcatcttatttattattactaacattaaacgtcaccttctaatatatatatatatatatatatatatatatatatatatatatatttacgatataaatgtaatatcatgaattatactactatttatataatgtattttttattacattcattattttattttatatttatgataaccaattataaaatgttatcacattgttttgctccatttgacatcaacagcacataaaaaaaatcaaaagctttgatagatggataagtatttatttgtaaatatatttatttataacatagtttttcatatatacacgtctttgataataaaattacaagtatgtaacaagttatgagtaataaacactcataacaagtgaagaagactacatagatggtgtcatgtgtaagtagttttaaactcaatatagaatcattaatctttgttttcctcttgtttttttgtcatttatttatttcttgttaattttatatttatctatagtctaaaagaaaggcattcatgagtatggttattctgtaatcatacacatgatctacatcatctctgcatgcatcactgcacacatgattatttaacaacctaattagtcttgtcaaatatttttgactcttatattataaatttttaattcatgacttcaaaattatatatgaagactcaacaacaatctagttccttctttaaaagtaaaaaatagtaaacttatacttatgactcattagacaagtttctttctcaaacactttttttatatgtattttgttttcaaatatataaaagttgacattagtttgaatgaaaatgaatccagatatcttaagtaagatgtcaagtttggattttattgatgaaaaaatattataccaaagataggtcattcaacttcgggataaaatcaataagtattttgcagtaataaaaccctacaagcttacccaaactactgacactccacaggcgtgtctagaggattagaatattaaaattattagtgttgttttcattgcaggcttgcggttaattaagtactgaaaatgtggcttttacaccacttgggagtccgtcaaaaagtggtgtgtccctgtcctatgtattagagtacaagcgttgttgtgtggtcgtcgtttttcgtttgagtgtattatatatgcaaatgtatgagctgaaacggactaagttggatttattgcattaatgcacttgagaacgatacaatttcagatatcagtaacaggtctatcattcgatcttcatctattgattcggattgatattcatcccatatgttgttagcaattatcgtgtgcattgcttgagttaaaaaatatgaagaggttcaatttaagctgaaacaaggttttaaattatcaagtgcaattataaggagattaagacccatagttcgagttattttatttcaaaaataaactctaatacttaaaaaatttgtagaacaaacgaattcacattttttacaaccaacagagtggttgggacagattctcttcctaggaagtataaattttgaaacactaaacttattatacaaataaatgaagcttataggagtattttcttttaaaaatcctattttagtcgttgaaagacaaattcatgtattgtccgcgtaaatttgttaccctattaattcattaaaaaatattattaatataatttttaagataatttattataaaaattaacaaattcatctacataataatttataattaaattacaatttataatttattaatatatattaaagttagtgttaatgacaaaagattccattatgtattgtttttttttgttttcctgttaattactgtaactgccaaaagcgtagaagtggataaggatgaattatgcatacgtgtgtagggaaaccaaaattaatcagacagcgaggaataatacaatagtcaataacaatttctatctttctctgtaactttgtcgaattgtccttctcatagcaaaaaataattaaataacccaaaaataatacatccctgtgcccaaccctacatccagggtgtcgtgtcttggttttaatctcataattacttttttttttctcaagtgagaattttttttaaaaaaaaaattacatgtgtcgattgaaattaagagaatactttaataataacataatagtttcctaaaaaaaaacaataatataatatcacaatcttaatcttaattactattttaattaataaatatatatacatatacatatatttcatttaaccagctctgcaggagtcaaattcagagagaaaaattaaaaatacatgtatttgatgtttgactgtattttgataaatgagcctttcattacccaagagtctcaaaccctcttttcctcctaaaaatacatgtatttgtgtgttgtgctcgtgtaatttatttctatgtattaaaaatatttgttttagaatagttcaaacttctgattaaaaaaacagttcaattttaattaatatttcctttttttggtgtataattaatatttctgtaaaacgtcatgatgattttaaaattaattacccatatattattataattttatatatatttagtataaaattagattatcaaatatccatgcatttcacaagcattctctaaatttaaatgaattttaaaagataaattgaaagaaaatacctaatattataaatgatttgtgtataattatttcacgtagaatctgaatatttaaaactataaaaaaatatataattatttcagaagcatttcaatatatttaatggataaaatcttaagtaaaaaaagtttatcatcaaattagtcattagctatattcatttgcaagaaagattaaagtggtgatgtaattataagggattagttgagtgaaataagacattattttacatatgatgtctttcagggtcaagctcttatgtgtttttttctgtcttcggagtaaaataaacataagtactttcataaatacttttaatccaaagttataaatgataagttgattgactggtataatactaaatttaaaattataatatcataatttgttattcatgtaaaacatagtaattaaaacacatgagtaaacttcctaattctatgaacaaatgttatggtcccactgacacattagtacaattagtaaaataaataagtttatattttttatatgaaaaaaaaactgtcacaccaaaattcaattcacaaagtatggattgtatttatgcaattaagttattactagtgccatgaattttgttattaagtaccaattattaagtgtggttgatcaggggcttaatctgttttcttccttccaatttttattgttgtttagttaaaaaaaatatgcaatgttaatagtttaaaaagagttaagagagagtcatagttttttaattaatgattaaaaaattgcgtggtggctaaatacaattactttgaaatctaacgtggaaggatgtgacgtgcaaaacaagataatctcaattaccttatccattcactctccatttgctaatatattggtatgacgaaatttgtacataaacctcaatgcaatagttgtattttctaaacagataaatgcaaaagtgaatggcccagaaacaaaaaacagaaaggaaaaaaatactatatcagagggaagacaggataaattcttttaatcactagaaatccattaaattattttaatagagatatcctatttcatgatttgattttactttaaaattcatttgtaaaattgtttacatgcaatgattgcatttcatgtaaaattaccatcgttcatttttttaaagtaatctttttaattataaatacactttcatgacatcattaggacgcgtaaaactaatgtttaacgcacttgcttaaaaaatgccataattattaactcttaacaaaggatgcatgtaaaaaaaagaaggatgcatcaatatggacatctagtgctttgtaacaaatataaatataaatataatttaagatttttgtaaacggaaatgtattatgtgagaaagatcgaaatagaagatttgacttgaaagtagtaatagaagcagaaagagggaggagagagtgaaagtgatttggaaacttggaatcatcggtgatttggcaacggatgagcgtgattggagtagtgtgaatcatagggtgagtggttatagaataatagttcagccgtatacttcttatattaactctaaagtgattgcaagatactccctctgtttaaaaaatacatgacattttaaaaaacaaaattatttcaaaatatatgtcatttgtagaatcaatgatatattaaatattttttaaattattattaataaatactttatggaagtaatgcataaaaaataaatgaaatcattaattaaaaagataaaaaaatattaaaaacattatttaatgtatctttttaaaattcagtaaattaattatatttctaaaaaaaaactttaaaaggtcatatattttagagaaattaatttatatgaaactatgtttaagattttttcacaaaatattaacttaaatgcaaactttatttattgttaaattaaatacaaatttattgatagtgtaaatgttgtgattaaattgtaaatgttatacataataatattattattttataataattttaaaaatcattttcaattaactgacagtataatgttttataatgatgaaccataaaaattgaactcatatttacattagtagaagaaaaagaaatggaatcaaattatatttcattctttaaatttgaaaaatagaacgaaactctctaaaattcattctattctactggatccttttatttttagttcttttttaatctaaaatataaaataaataaaaagtttctcttatttatatatatatatatatatttaaaattatttttaaccgatgcaaaacttaattttttcctgatataaactgaaccttgacaaaataaatactgcctaattaatcttgtcattttctttggcagttattatatttataactcaaaaaaatttaaaatacaaactccgaaattgcatgttgcatgccttttagctagagtacacgcgtactcagattttgtttgattaaatttaatggatataaacaaagtggaatttttaaaaaaaaaaaacttaactagtaaaggacacattttataattattggtaataagttattattaaaaatatattaaatgtataataaatttatggtgttatcacagaattttaaaagttttaaagtattttttttttaagttttaaagtatcatatctcttaattttttatacttcaaaacataattattaaatttggttcagataagtggagatcagtccaataataagtggagatcaatccattggactgagaatcaaatatccaattcaaatcacatgttggattagatatgcacttgacccggaatgacttaatttgattcaatgtgatttgactttgaattaataacttagttgacttgatgagtcatgaatttttcattttttaaaattttttaacatcacttatactaaaaaattaatttatatcttacactttttttgtttataaaatttcttgcttgttttgtttaccaaacataaccgaatattgaaatttaagatgataaaattattgttacttttaatattttcttagctaatttacgcgtgtgtattagattatatctaatagtgtaccaaaattacctttttgtatgctcaaatttcaacttaagattgtgtgtactgaattttgaaaaaacatattgtatactcaaaattttaaacaatttcataactattgttctaaatatgttaaattaggttaaactttaacttgtaaatgtaaagtttatatgttataattttttttaatatagatcgaatcatgtggatcaactgatgactaaatagatctatccttgatccagtaagtgagtacctaaccaaatcaataactaaaatataaaataactatgctttgaaatatttatatataagttttatgaaccaatttatctctagtagcaaatataatagatttcaagttttcaaaaacgttaataatatgaattaaaaaaaacatattattagtaaatgtcatttatttattcatttgtattaaataaagacaataacattcaaaataaaatttaagttaaattttccatactctttatcaattgtctatgtctattttttttttttatttggacacatcacatttaaacatgttaaatagtgtgcttaatatattgatgttattataattttgtatatttcaaacgtgttcttaataagaattgcataataattcattttataaaataaatgtaattataattaagataaatttgtgacattaattagataaaaaaaaatttcaagtgtatcacactctttgacaattatttatacttattttcacattttgaatacttatattaaatgaataatacaagttaaatatacaattcaatttaattatgtatatttatgtacaacttaaatattatatttgtaatttaattatctattgtggttttgcatattttaaatattttttaattgtttagttctattaaataaaaataaatacatttacgataaaataaaattatgacatcagtcatacaaagtaaaaataagtgaaagttattattctttgacaaaggtttatacctttatagttaaataaactaataaaattcaaataaatacactcaatttttttgtttacctcatgcttggaggggtcaagatataataaatacatttaaaaaaaagagtcaatatgatgtatggttttgcttgtacaagattgagtcaatttcgcctagtgaaatgcaaattattcaatttctgctcccaaacttcatacttatttgatttttgaattttaattcaaataacatatagattaaatttgcataagtaaaatgataattttttatacaatttatgagtaactaaaaatagtgaaaaaaattatgaaaaactaaaaaaaataaagataaaacgaaagatcaaagcatattttaccctataaaaaattggtatctacaactgtaaaatgtagtttgggacacttataaaattaacatgttacaatcggttcttgtttttcttgaaattaatataaaagattaaaaaaaacaagtcataagagactacaaatacaaacaaaacgtattttatcctataagaaattggtatctaaacatgtaaaatacagtttgggggcactttcgtaaaattaacaggtttttaaaaatcaggtttcaaccggtcacaccatgtcaccacaccctcactggtgtacaggactcgcataatcttaatgggaggacgtttgaaattttcgacagtacaaacaagcaaatatttatccattaaaattcttgaagcattttactttttcactatggatttggaggtttatacgccacgcatgtattacttttagtttacatatatatatcaaaataaatatgacagggacgttctccttatcctttcagaaaagataaagggagagctctcttttcagtcaaaatcaattgaaaacattcattgacttgggttgggttggaagaatgtggggtagttaattaatattgcaaaaagggtacatcatttccccatacatatatattatttggtacttcatatctttaattacctcctttagttgtccttgaaatttttctttttcaagttggtttgcctatgctagctgattcttttgtccgaaccaaaaaaggaaatgacatttcatgtgccaagagcctccatctgcaccgtcgttagttgaccaggacaaatccaattaaacttcataataccaatattggactgtatacacatgagtcaaacgctgtgtttaagaatattaagggtacgttaatttagttttaaaaaggaaaaaaaagaaaaagaaaaaatagtatgtgtattatttttcacactgttattaaccataaattactgtataaatattttttagactttgataataacttctttaaaagtaattaaaaatgatttttaattaattgattgtataattattttacacatataatacatgtctcttaaactcagacagaaaaataggtttgtagattgtttgacaagaaagaaaataatatatatatatatatatatatatatatatatatatatataacaacgtaaatatatttaatgaagaaaatatataatcagcaagtcattgatttaagtgattatgagtttggtccttttaaataaagtttcgtactcaagtcttataaataaaaaaatatgattaaaaaatcaaattccttaataaaattagttataaataaaattggtgaatatttctttttcatttttctcattccaaacttgccctattatcctaattacaagataactttttggtgtgcggaaattcttttattggtctttaaaacaacagtggtataaagtaaattctcaaagtaattattataaatattaataatgtttatcatattataatttgagtatattgtatttttttttcatgtcattgctgtatttcaatttattcaaatttaagtaagtaacttttcagttcttaatttcttgacaattgccttaaaatcaaccttaccattatcatgtaggtaattaacgacattatgaatgtataaagattttgttagcaaatcgacacgctaattataattgtcttttaaacgttcctataatatttcaaaaccgaagatatatatgagtcttgaaaaagttcgccattttggacaagcagatctgcagatgggaccaggaaatactggaaaatgatcgatcatgaggtaacaggaagagcacattgtatagtaaagacaaattaaaagacctctataactatgagcatcaaccacttgattaatagcaggttaaggaaaaagagaaactctgaatgttttttttttggtagtatatccatccgtgaatatttgattgaaatttaatgacaaaaaaatgtttatttatttattttaataaagtttcatttcttataacatttattgacaaaaaatatttaataaaaaagttgtttttggaactaatttaatttaagatgacgttttattaataacattttttgtatggttaaaacatttttagatgaagtttaaagattaaaagggtaaattaaataaaaaaaggaattacattgtaactaaacattttcacccaatttttattatttcaaatcaagtgtgcaaatcacacaaaacaaatgaattaaattaactttttaaaataaaaaaaaatgagcatacgagatatcactaaaatgaaaaagaaccttacataggacaatactccttataaaaacatttttctgaaacatgtgggtatataaaatatatttaaaaatttattaatatatttactaccatacttttatttaaatttaaactgaataatgaataactaataatatattaataaattaaaataatataaaatttactcatataaatttaatgtgagtgcaatggaggggacactagtttcatcttgttgatagtggattttttggggttccatatatgtaaaggattggataagtttgaatatatgcatgttgatggagtgagctctgggcaactgcttgttattttatgtggtattggcgcaacttgcatgtccatgatgggttttcatgctgtggagcttcgacttgattctgaaagtgtagtcaggtaactgtttttgttttgtttttctctaacaatcatttcccgaagaagaaagatcgttactttccaccgaaagccagctagggataacgctgttagtcacgagttatccctttcccttgatttacttgcccacttccatacgatttcacattcactcatgaaaaaagtaactcacttctttaatattaatcactatcagaagtaattttttgaaaatcaaattactattattctcataattctaattaatatttgttagttatgtagaaggacaattaatttttattaaataaagtgttatgttctaattttgtgaatgaaacataaatattgaatattatatttatcttttaaaatagatttatcctggttgatttaattatttaaaatagaaaacaacttatgatatgaaaatcctcaattttttttagaattttattttattaataatattttttctattcacaatatttagatatgtaattttgtttaaatagttcaaacctaattttagtcaggtcaatgtaatgttggtttaatattatttgtatacattcttataagcttcttttgaaaacaaaagtcaattttaaaattatttacatgtacaaatataactatttggaactcttgcattaaaaaacagtactcatattttatttattaggatgaaaataaaatttcatttaaaaaatgaaactaacttattatataactatttgaattacctttgcatatattttaaaatgagaaaaaaaagttatgtacaatataaaaaaattatacaattatttaattataatccattatgtatgataaatttgttgatctttaaaataattatattaaaataatttaaacaattatttatgattgaataacagaaatttaatggttaacacccaaaatgaaactatttggttattgctggaagtatttttttttttgacaaagagagagaattgggctagttgttcaaattagaagattttctcctctgtgcacatgaatatattgggctttcggacttcttgctccttcaatgtgtgatttttggatttttcttcatgcacaacacaaatttcttcatacactcagaaaagacagcaaaaaattaaaaatgccattccttaagattcttacggatttgccaatctgtttgggcttactgatgaatccgtaacctcatacagattgacaaattcgtaagaatcttactaattatgaatatgtaagaaccttatagattatggatcgcctcaacgacctcatcggcattgtcgatggagagatcatggcaaggattgtggtcgaggacggagaaggggatgccgaggtcaaggacgaagtgggaagtggagccaatgctgaagccgaggaccatgccactcttcacggactccatggcgttgtcgacggcgagtatcttaagggtgatggcgcggagataaggcgtgcgacggcattgtggtgtgcggatgagagagatagagatggggaacaggagagcaggaatcacagagggaggcagggggagtaagagcagctgcgggagcaggcatcacagaagagggcggaggggaaggagaggagggcggagacggcgttgagggaggtggtctgagcatagctgtgacgactaatgacggataaggattgaccaatctgtatgggccaatttgtatggatcatacttattaaatttaataaatatattatatttaacaatacaataaataatacattgaatatttatataaaatttatattagtaattttaaatatatgtctcaattttttttttcgaagatatatatacacattagttatttcccaattatcaatgtatataagtcaattactccacaacattaatattgtccacatttttccttttcttttcagctttaacaccatcagttaccaaggccacttgaggaagcagttaagcgttacaaataggcatttcgtacgtacacgagagaaaagcaaaaaaggacaaaagggactgactcatttttttttttttttgggtacatgtctatttcttttggtgtatactcaaaatcaattgtttaatttatcacacttgatattttttataaatagtaaattctgtttacaatattttacataattgtacaattatttgatacttcattaattatttttattttaatattaacatatttttaaatcgtcatcaagacatttgcatgacaatatttatactttaaaacataatggctgaggagaatcaaatttctcccgcagaaatatacacacagtataaacaaagattcttctaccccaaacaaatacttttggcaaagattccataaaaaaaagcaaccataccaaacttctacaaaacataatcattttcacccaatttatctcccacacgactgaattcaagccacttcctagacttagaaagattcatgaaataatataaagcaatcccaagacaggtcaagaaggcactagtcacatacacaattttggaagcaacactcatcacatacaccaaaagcacagatggtacaaaacacattatgaccaatccaaagaaccccaatggaacctgaaatggccttttcaaagcagggaatttcctcctcaaccttaggaaagctgcaaactccaaaagcatccccaaactgtacaagaaattcacagtagatatgatctctgtgaaggtcaagaaactcatgccaagtgctataactgttgagatcaaaatggccatccaaggagtgttaaaccacttagatctttctccaaaaattcttggtatgaatcccaaatcagccataccaagaagctggtatgcagcactacttagttgggcttcaaacagcccaattattgacaaaacagcaccaatttccatccaaattttcaaccaattcccagcaatgaccccggcaacatgtgcaaaataccctccaacccaactttgttgatcaagtggcatagccccagtggcagcaaacaagggaattatgtaacccaaacaagtaagcagccctgcagataacaaggcctttgggaaagttttatgaggctcctcaacttcaccagctagagtgctagcattgtcccaaaagttcaagttccaaaagatggtgttgaagtaaagtgtccaatccttctccacaccctcttgaccaaaacttagccacttgttggggtcaattttaggcaaagaaaacaaagacaataacacaaaaggcaaaagtgaaacaacaccaagaacaactgcagtataacccactatagccaaaccagaatagttcaaaaaagacaacacacaagtggagagaaaaatagacacagagcgagggaagccagaagataaagcggggatcaccaatttgagatagtctatgcagagaaccgggtatgaggctaagttgatgaccccactgaagaacttccagaagcccatgagggagccccagaagggtccaaaggcttcattggcccatatcacaaacccaccattgccagggaaagttgtggccaattcagcagtgagaagtgcctctggaatgctccaaatgaaagggaaaaccacaaagccaaggatggctatcagagggcctgcagcacccactgaaggctcttcaccataggggcctccagcaacctcaaaatagataagaaaaaccaaagggagaagtgctagcttcttgtgtgatttggtcttggaaccatcttgttctgtctctgacccttctctatgatggtttagaagatgttgctgctgggaacctggagttgaagtgtagagggaagaatcctccatgttgggttattgaatgattgacttcaacaacaaaattctagttataagatgaagataccaatcaaagggttggaattgaaaatatatatatatatatatatatatatatatatatatatattcctttgcgtaatctcacaaagacgttttaattaattatgcttgcaataatccaactacaaacgtagccaacaaagcgaatacatgatatcttgacgtgtactctaattactggtcccggtcttgtggggaaattcttaattccgggcttcgatttagttgaacacttttttttttactaaagaacttcgtcaaacttggaacgtgtttatggagcaaaactttgatcattttatgcaacaaccgaagaaatattcatcaaaaataaaattgaagaaatgattttctctgtcaagttgttctaattgtttaaggaaaaatgattttaattttattttgtgtttaaatgttttttttttttttatattctataccttttctttttttatttttaataccacctaaaactcacctaatcatgaaacatgaaacatgaaacatatggttatggtttatgtcaaatgatttggttgattcacatcattgtaattatttcaatcatttattgtgaacccactcaatttgggaattcacatggttgaaatatatggaatttttggctagtttgtttgatgtgtgctttacaatggttaagtgggggaggaggaaaagcaagtgtgcccattgagaaagcttctcatgttattgttaattttgttctccgtcaagtactttgtttgtgctcagggagttgttatcggtccttataatcccttaaattttaagagtatctctccctgaaaaacattacggtattgtgtcactgcaaaaaggttttggactggactccagttaataaagacttttttctttctttctataaatcactttaatatttaggtttgtacattgaatcaaatgtaaaggagttaaatataattctggtaaggcattataaatataaatcatatcaatatccaatattttttatagtttaacccacgagttccgaataaaccactttaatatttaggtttgaacatagaatcaaatataaaggagttaatatataattgttactcttacggaattataatcatatcaatatccaataattatttatttttattttaacccatgagttttgaataaaccactttaatatttaggtttggacattgaattaaatatataggagttaatctataattgtttcttgtacggcattataaatcatatcaatatccaatatttaagttttttagttgaacccacgaattcgagttcagaataaaccacattcatatttaggtttgattattgaacatataatggagttaatatgtttcctctaaatatattaattcaatatgtttcctctaaatatattaattcaatatgtagaatattcgctttaggttattgcgtacatatctttgactttgaaaaacaaaccaaatctttgtgaataaatacttattttgatatctaaaaatatgatctctaaaaatataaagtattgatagattgatgattgaaacataaaaaatttgaatttaatcttcaagtataaaaagtatgataaattaattatattattaattcttttctgttatctttaatttgtgtctatatgacacttctaatgatgaggtgacatttaagaattatcatatgttattgacatgtttaaaagttaaattttgaatttaatttctaaatttaatattttattgtcattttactttttaatttctaaatttaatcatttattaatattttggtctttgaacttgattacgtgttttcattttagttgctaaaaataatttttaaatgcttaattaaatcttatactaaatatgaattattaacataatgattatcatatatccttatttctatattcattaagaaaaaactaccaattggaattaaagatgataaagatgattctacggagaatctaatagtaaaaggagtatgattgacaaagccaatatcataacgagaaagcgaacttgatagcaattaaacagactagtgatagcaacggattgagatcttgagtttaaaattatactgtaccttgtgctgtgttaatgtgttatataatgcatcaaatttattgaaatatagttatacactattttttttatcatctaataaacaatcttaatggatgagatctctggtaattgtaggtaatctcaatcgataacaacttggtttgtactttttttttacacaacttgttttatatgatataatgatgacactagttttttttatgaccacatgtgtatttaattaatgcaactgcatatttaaaatttaaatttgagtacattaaataaaaataattccatactagttaatcaatatattcgatgatatgataataaggttagaatttattttttataatttttagaaaaacaaaaaagtattacttttttctaatataatattagattcttaatcaaatatgtttgactataattaataaaagaaataataatacactaaatagtccacattaatagaattaaaaaatatattaacatttaattgcaaattctcatttataataaatttattaatttttataataattattttaaaagtcttattcactatgtttttagattagttcacaatataaaacgtatttatactaattgtcaatacataaaaattaagttcataataatatcaataaaaaggatgatatgtatcaactaaatgtaaaaatcaatcatttccaacatacttaataaaattgaaaaatatgtttgaatggattaatttcacatttgacattgttcaacaattcaacaaaaatatgttgattataatttttattaaaaaggaaagttcaagacgtgtactataagtttatacatttttttagggtgcagaccgtaacatgcttcccaattccaaccgcaagttcatcacgttagcactttcccttccgtttaggacattaaaactaatgaataaggttatctttcataaaattacctgaaaattaaaaaattaactaaaaaataaaaaattactttaaaattaatagttcaaagttaaaaaattatcttttttaaatataagtgtttgataaaattaattattaaaatagttgaaatagataaaataataataaaaataataaaatcatgatttatataaaaagaataataattttttttgataaatatatcaagaataaaaagaaaaataataaaaaattttaaattaaaaggtaatattttaaaaaatgttaaaaattattaaaaaattataaaaaaaatttgtttagtgaacaaccaaacaaaattttcaattaataaataaattataaattaattaaaatatcttgtcttaagattatgtttaacaaacttatatgaaaaattagctaaaagttaaaaagtaaactgttttagttgaaaattaaaaaattatcttatttaatcacaagtgtttcataaattatttgttgaaataactaaaaatgcaaaattatacaaaagataaaaataataaaatattaacataaataaaaaaattaaaaaatataataaatatttaaagacaaaaaaaataaaaatctaaaagctaatatttaaaaaatattatttttcaaataatattctaaaaaatataaaaaaactcattcataaaaaaattttaaaaaattttctatccaataaaaaattaaaaattaacttaaatatcttatcaaatacactattttttaagtgtaacatcatgataattgataattcatatagaataaaaccggtgaaatactgttcaagaattcatattgtgttaggggtcttgtggctttgttgaatttatcaacatataacattaaaactaatgaaataaaactaaaaatgcaattagtaagaacatttgtttcgaagaacgaaagtaaacgagaaaaaaatttgcgtttgccgggagtcgaacccgggtctattgcttggaaggcaattatcctaaccgttggactacaaacgcttgttgaagttgctcaattttctttaaaattatctttataataatctctttgattatttcatggattcaaatgtctgtagttcagttgcgtctctaaactgcactgcaattcctgaattggagtatagaggcacggagggaattcatgtgaggactgtgataccttcagcttcaacgtgtcactctcatgattttcaaaggaaaacaatcatacaagtatcatcttcttcatcaacaagaagggttcctacccacaacagatatttacgctttgctgttcgggccagactatctccttctgatttcaaggtacccacgtaacaatttctgcagaattttattaaaaatctaaacgtttaacttttagctttatccaaattaatttcaattttagtttgcttcgttattgatagattatgggaatggatgatattctctgtacctctctgttaatattttttttaacgaattttaatagcatcctgtctttttaatagtacttatgtaaatacaatttttaagattttgtgtcctttaaaacggtggattcacttcatgcatatacaaaagcaatgatttactcatagaaaatcaaacattaagattaaaataatttccttgtttattatatatttgaatgtattttatcatcatataatcttttaatttttcaattaatgattgtaaatattgactttttcctctaaagttaggggaatcaaatataaattttcatataattttttcgtacaaaaatctcatgagaggatttaatccagttataaaatacatgctggttgttaagatacggtttactctttatacggatttgcatctatctggtcagttgtccctaaaagtcaatgatcataatcaattatgatttttgatcatagacttcacagtcaattattatatagtcacgtcatttgctttagtggggtgaagtattaatcaaatccgtcacatttttaatgctgcaattatgattgcaacttgccaggtattatagtgtaaaagattattgcaatgaagctaattggttggttttggttgtccaagtgtttgttggcttcatctgatttatgcatttacagggtaatttatgtaaaagttcaaaaatttgtagtcaatgatcactttagtatcctggaatcttgccttctttttttagctttaacttgagtcatacacacgtgaagcttggtttaaccaacttctattaaattggcaaaactaatcagtttagtatttgttgggtccaaggcctggtattaactaacatggattgctttccacattttttttttaccaaaatgtacttcccttttctaatttatgggattgatcagagcctcagaggtagttccattgattatctaggttgccaactaatttaatttgaaatgcagacccgagtgatttcttttcccttcacatgcaatggttctctatttttttactcctaatttgtgatgaaagatggtaagggaaagggttatgacgtaataacacatctttcagtaatgaagaccatttcaatgaagaccattaaagtagacattttgatcattaatgttctaaagaagtacttgtgatgttgcataatattttagtttattcatcaatctctgatgtttccttccacagattttcagagctatgcgaggccttcacatctcttgccagcctctgaagtgaaagtgtacacaaatacatcagtagagaacatttcatcatctttgaaggaggatggatccacatctttatttagggtcaagttagttacaagcaacgcatatggctctagtattagtgacttaaatgctggaattctactatgcttgatagatgaaaatggaaattccatattgcaaaggatcgctgtgagtttgatgatggatcattctacagaatcaggggatatgactaatattgacatgcttcatttccaaagaggttagatgaattcatttttgagggtcctaaaattgcacaacttaaggctctttgggtcagtgttgaatcagttatgttattattgtctatttgttttcaaatgattaaaatattcatagacatcattcctgacctacaattttaaagtgcccttgattaacaggcttgtctacccacaagacaaatgctaacaatatactctctaacacactttttttaatacactattattagttgaaatatattagaaatcacaattttgtaggttttacttcttatttaatgagtctcactcgtgattttgaaaagtttctaataaatttaaatcattaggacaaagtgtatgagagaatgagttgctagtactcctgccgagaaacttgtttttaggtaccaaggaaaatatcccttctgcattctgtgctaggaagccagtatactattatatttcttctggcatcttagattcgaattccagtttttaaatcattatgcaaccaatatatgctctctgtgaaacaacaacatcaacaacacctttaatcctatgcaaccaatatatgctctctgtgaaacaacaacatcaacaacacctttaatcctagctaattggggtcagtggtagatgaatccaatgatagatacgaggaggttgaaaagaaaaagacaaaagcaaagaaggggaaaagaaggaggggaaagatgaagagtaaaaagactaaacaacaggtctaaccctccaccaagcttataatatgctctttgtgaaacatgaagaaataattgttggtacaatcattagttcatcccatatttatctgtttaaacctaggctttctaacaatacccttcttctgtctctaaggtcaggtcagtggcgcctaggaagtgtatccttaatggttattaattgtgaagggcaaccatctggaccggaagatggggtaccaacgtatactggcttcctgtatgactttcagattgatgatgtgttgcttggtgagggagctgatctgtccatgttggaattaagacctagccttgtgactgagctggaagggattgatcccataagcatcttcaacaaaggacttaatgaccctaacttactctcaagttctaaagatctcaaatgaagagagcatgaaagaatacgcagatttgaagttctcattgttattttatgatgccatgctgatgctttttggtacatcagttgcttccctcttggctggggaaaataccgggattgctttcttgattggtggaattggaggcttcttgtatcttttactgttgcagagatcagtggatgaattgccagcttcagaattaatcaccaatgacaaagaaagaactgatgttttgttcagaggagtgaagggtccaatagcaagtgtaacattggctctaggcttggctgtaattgcatcaaggtatagctcaggagatcttcaggtgatgctaacaccaaaagatctcatagttggaatggtgggatttcttgcatgtaaagtttctgtgctgttggctgcattcaagcctataacactggattcaaagttaccaagtgatatgtaacattgtactttttgtcgcttgtgaagtggtttaatttttaaaccaggtgtaacttacaattatcaataccgtgactattgttgctgtatagtgctcattctaagtgtttcttacatactcttcggctggaaaggaatggaacaggggaatgagattttgataaaatttgttcattttcggttaaggagtttgaagggatggagaagagaaatgaaggtcttgaaatctctttccaattgtttttgttttttctctaatagagggagagttttatttcttccatttcttttctttaaaaaattagtcaagtttcagttttaaataccgataatatttaaggaaacacaagtacaaatatgagatatgggatcaccattacaaatttctaaaaattaatataacgaaattattgtaatattaatataaaagcatgaattagaagttagaataaagacaataatgttttataagttgtttctgattattgtgaacacaataaaaacatgttattatttgtccaattactataatatctatcccgtattagtatcagaggtgatacgtatcaaaataccaatagtggtagttttaagttttataaggcatgcactgacaagtacaaatttgtacataaactgattaaaattatttttcaatggttaagataattattatttgtccaactaattctgcccgattaacaaactcaaccacaaatactagtaattggttcagtgcattaagagtctacctttctttgtgatgaacttttccagtttggttgaactcaaggatgttttctcaagaagttaattgaaatatggggagtttacgaagtgcagattaccagggtaagtttcttttgaacttgcggctaatgatatgttttggttgacaaggatagccttggcaggtaagtacacttcgagtttacagaacccatatgaacgatattgtaatgtaagaaatataagttctaaatttaattatttatggaaaattctattgaacgatgaaactgaatcaagacatacgactgtagtcatgtgggagatcttgcccaaaaccacagaaacactcggaaatgttaccacttgaggatgtaccaagattatcatttagacaatagaacctttcccacatttttattctatcaagggaaattaaattcgatcaactgcactagtgcgtccacccatctcgacctcattttccaacacgtgctaaaaaatagtttgcaactaatgagaaatccattctgaaattaaatgcaacaaaaagtttttcccaatgtatcaaaaagccataagttgcatagaggacagcaaattattattctttgaataatcaaacagaagatcatgtcaagataacaataaagtttatcaagtcatacaatagttctcttcaaaaaagtcatacgatagtttacaaaaactcgattgattttcgccaagcttcgcagagtacgaatataattagaaaaattgaaagtcatttcatgtaaaaacaagactacctattagaatataattcttacaagacgagtaaaaaatcataaaacaccattaaaagatatgttaaaagcattatcaatctacagaaacccacccccttaacaataatactaaattgagaaaagaaaggtcaagagacttgcaaataaatagaaaagggaaaaaatgggggaaaaacattaaaactgatacactgcaagctggaatgatacacatgcccacaatagcatcgcctgctgctcagcttccacttcgaaagattcagttataattcaactaaataacacatccagcgaagcctaacttcaaaaatataagtatcaatgtgattcatggctgatttggacaagaagatgagcttgcacattactgcagggcattagttgctatgctggtaacagcaactcgaccaaaatagtatcataggaagtaatcaggcattctcctggttacatcaggctctcccctccttggagctggctcaaactgagattaaaaaaaatattaacatatgtacaaaagactaaaaaagagttacagatccacaacatattacttgagtagataacaaaaagaaggaagctcaacctgaatgaatgtgtgtcctttgcagtcatcaacctcaagaattgatgccatgttcccacaacgataacaatagttaggtgcactaaatatagtaaccaccttttgatcctgcaacaagggactataaatcaactacttaccacaacgaatgaatataagaacaaacaaaatgatatcaaatatttacatgtccccagttatatccttccataaccagctggtgagctctagcaatcagcttcaagttattggtatggttaaattgctcagatatgtcctacaaaagcaatatgcataagcaataaaaaaaagcaatggtgacagatgaaaacaatcaagcttgatacataacaaacaggactacctggccaaaggtatatccagcacctctaggagagatgccccaaccacagcgatcatctggatcagaccatagaagatcacacatgggtccctcgtgaggaacttcttgtacacgatcaaaattacgtatgttatccagggtttcaatagatggtgacaacccaccatgaagacaaaatatttcagattcaacctatgaaagtaaacatatcacactttagcaacactcagttattgaaaactagaaatccagtgaaatatgagcactgcaattgatggagaagaatatcatgaagcttaatcaaaaagaagagacacaattaaactagacaaagctcaaaagaagcatattgaattcagagtaccaagaacaaaatgcacatggaactagacaaggtcattaaattgagatcctacttaggattgggaagggctaaagatcataaatcatggcacattagcaaggatcataagatcatacaaaattcataatatatgtgtgagagcatataaattcatatttttgttattaaaaattattaatgtttcaatttacttttatattgatagtaattataaaaatataagatgctgaaggagatggaacataaaatttcagtctgaagatcctcaagtatttattttaaatataaaaaaacccatttcttaggtttcagaaacaaaaacaatgctagcttcttcagacagccatgggttccacatagcaggcagagcacaaatagatcacaaggatgctctagaacacgaacagaccaaagaacttcaaaagaaagctccaaaacagatcaaataacagataggactagatgggtttgaacaagattgaaaagttagaagaattggattgaattgatgtcacatgagatgaagcttcaaggttttttttctttccaaaattggtcacaaccagaccaagaatctcagttggcaacattcaatttttcattcaccaggtcatctgaaatggttcccaatcagggggaaatagggtttttgaaagacagtggggtcatctgctccaacagatcccacaatccagcacagtgataccacccaattccaccatggtctaatcttaaatgcaagccaacatactaaggttgcccaggatcattgaatcgaacaaactaccttggaactgagaacaatgaccatctaacaaaatatcccagtcctttccaaaattatgtaatagtatactaaccaatgctgtcaacggaaagtagtcaaacaaatcagtaaagatcttccaaacattagcactaccatacctgcaaatgaaataaaaatattcaccaatataggattgcacaacttcaagaatgaaagttataaaaagaaggattaaaatgagaaaaaaaagattagcaaaataatatgaattccagatcaactttcggtacaaaatttaatttggaatcattttgcaattttataattgcttatcctcagccatggacttagcaggtacttacttccgcaggcactcatcataaaacccataaacttgagtaatctgcaacagacaggtaagaacagccattatcattcaaagctaaagcatacaaaacaactgaacaaacaattaagtcaatgctgtaatcagtgctatattaagttgctttaaaagtaagaagttctaactccaactactttatcaaatccatggtatcattttttaatacaagcatatttggttcccaaaatactacataatttctttcatctggatgtgtgaaagcatttgattggcagcattgcagcaatatgaacttatgggtagtatattgataagaaaaaatctgtcaaaaacaactgatactgacaagtgaccatgcctccaatcaccaaaataggattttaaatctaatctataattcactactaacaggaagatcacatgatttaaaaaagaacaaacctggcgactttcatgatttcccctcagaatagtgatacgctgacgataacgcactttaagggcaaccaaaagctgcattatgacttaattagcacccaaaatgttatcaaacaaataccatatggaagcaaaatatacaccatctaaactacgcaattaaaaaatagcaatatcaacatgtacctcaaaatcagtttgaatgtcatacacatctctgcatgttaatatttatttattttgctcagcaatgtttacttatatgtcagtgtgttacattggtatcccacttatactacagacataatgcattatttacacatacaacataatcatggtacttttttttattttggatagcacaatgcacaaccacgaaaagtttaatagtggcacccaataattccaataaacccccatacacatggcatatagcatgaatagtaatgaatcattctcattgtaggagtatgacacaaagaaaggaatattagaattatggtccagaaaacagaaatttttaggtaaaaaactactgctgataaaccaagtaattttctaatcctctaagcagatatcaaattactgattaaaaaaaaatacaattcaagcttggtcaattagtctaagacctataagatttcagtagaacatcctaaccaaataatcccataacatcttataaaaaataaataacaataaaaatatgtcagaacgaagttgaattctaaaaaaacaataaatatttaccgtaacagtttcaacagaataatagccacgatcaacataatctcccataaacaagtaatttgtatctggacactaccaacaaaaatggtaacaagaatcagtatttaacaaagaggttccatatttcaactaaaagcaaaaaaaagtatttaaatatgcaagggtgagatgctaaaaaataatggttcaaccgagaataaaataagcacatagcacatttgatctcaaatttgaaataagagaatgagagactgagtatgcaactcattggcaataacactgcagcttgtttctcaataaaaaattagactttctgctatgaaataagaaataggccaaacctaatttcgcaatacaacactaaggagcatggaatttcctgattttccaagtactacatatttcataattataaaatctatgtagtcaatgtgtcacaaaattaataaatgcatgttgaatgtaaaaccaactatcataaagaataccttccctccaatgcgaaaaagctctgcaagatcatggaattgcccatgaatatcaccacaaattgtaacaggacttttcacaggctgcaattattggcaaatgaaataatctctttagttttttcagtcattcaaaatcatcatgagttaaagctaaaagccctacaaataaacatattaaacaaagtaaaaaccaatataaatggtggataataagacctccttaacagataatggtcacaaattgagaggaaaaaggggcttgatgcaaacaatgttggtgacatatgaaccaattttaaaaaaaatccctacacctagcacaaatataaacatgctaacataaatgataaaaaatagacagactcacctggacattgctctcttccatcaaaatctcttttgccttatcacacaagacccttacctgtacacacaagtgcaaagtgaaatcagagttggatcgctaaatcaaaaaaatcacaacactatctcaatggcaaggctatttccagaaagaagacattcttttctgttgcggccaagtgccatgacacaatgtcacaataatcacacactattgacaactatggtttgggcttttaagtgttaattagaaaccaggaaaatacatcaaaagaacactgaattgtgaatcgagggtgggaatgctgggtttttattttttactttaatggatgtagagattcaatgttttcaaccctaaatccctctgatttagcaaagagtttaaactgtaaaaaaaaaaaaaatccctaaaaatcaatggccataataagaagggaagagaaaaacaaggattcctcctgttcagagttgtgacttctaataggtgtgattttttctgtgaaaggccgctacctcagccgtgatctgtgagaaacaaaaaacacaaaacaacagagcattaaagtggtcataggatcctctgccccacatcaccacaaaagcagcacaggttgccacaagtaacttactctgctaaaaaagaaaattgatctgaacccgcaaaaacctaggtagaactttcctctaactccctgaatcccaccgatcaaatatgatggcacgtgcaaataacaaaaaaaagcaaaactaattggaaatgtttaacttgattaatacaaatgctttacaagatactcagtaggagaaagtagcaaggaattcttactcatttaattattaattattaacaagtccattcaaggatccagcagtttttaatacttcccttcagctttgctgactccttccgtgttcaaaggagacaaaataaatgtgtcattaaataactgctgtttcgtaagtaccaaaataagacaaacgtcatgcaacgtatgtaatgtcagagctgtatccctgactctagaccgaaaactatgcctaaatttcttcaaaaaccaatgcaatcaactagggacaaaaatgaaaactaacccttccttaagcaataagcatagactcataactcataaacaacaatccgtggatcaacaaacttagagcaaatccaactatcctaactttttgtgacgaaaataatacaaacaaattgtgtattttctacttcttaggagctcaagtagcaaatcatagctcctaacttgcatcaacatttccactattacacccaaaaaactaaactctgccttaagtaaagttgcaagagtacgcttaagttaagcggaagtatccaaaatccagagtatttacagccctccctaataagacaggtaaaaagttatcgtataaaaaattaacgtacactcaagcatagagaaagaaatatattcttcctcctcaaataattctcagtcaatgttaacaatctaaaatatccacaccttaaatgaagaaaaacaccattaattgcgaccaattgatttaggtctaaaactgaaaaaccacaataacatgatataatcaaaatcaatgtaaaataattataaaaaaaaaactagaatcgctaccacgaattctgcaaatctaacggaatattcgaacaaacgcgcattccagtcgccattccaattccgagagaaaccagatttaacacaaagaggaaccgattcaattttcgctacaacaagccacggatcgatgcacgagaagcaattggagcaaaaagcacaaaactgatgacaaataacaagagattttcccgatccgcgcatcgcatttcataataacgaaagaaataaaacggagcgagatgaagcggtttcgggaataacgttacctcttgctcggacaagggtttgcactgcatgagctgagaaatctgctcatcgaggtttccatgcgaattcggaggcaccgaatccatgttctattactccacctcctgaccttgttcgttgaggtcgttctatcaatatcctctctccaaatcgatggaaaccctagatctcactcggaaaacccctttcgccttttcggtttgtgtttattgtttctggtttttagagagagagagaggagaaggatggtggtggtgaagaaaccaaagcgttttggaggcttcgttttgttcgataaccactcctttttcgggggcaaaattgaaattaccaataattgaaacgctcatgctcaacaacaatattgggactcggtgggtgtattgaggtttggattttaaaaattgttaagttcttttaaaatgtaactttaggggcagttcttttatattttatatgtataataaataatttaaattatgatgtaagttattcttttactattaacatttaaaaaaaattatgaaagataaattgaaatagacaaacaaaagatcaaatatacatagaaggatgagacgaggataacttaaaatagttgaaaattgagatagaattattgttaacatatgaaatacacaaaaaaatattaaaaatctatgtgagagtgaaactaataagaaaatttatctttgagtttatattctaaattataatatcaaagtatattattaaataattttttattttaatgggaaaatatcaccgagaacacttaaaaaaatgtaaatttatattttaaaatttaaaatgaatttgtaaatttatatcgaaagcttaagtcacacaagattttagtaaaaataaaaaagagtttttactattattaagttatttacataagacgaagatatagaaaagtgaactcgtaatatttaccttgtttttagaaagctaaatgtcagtattttttttgtccattaaatttcaaaactcttattttcatcatctatatttttaaaaaatatcattttaattatatcatttgttttctgtcaatgttagtgttctgttaagattgtcagaattttaaattttgaaataattaatttaaaataataactaataaacgttatcatctttattttattttaaaaaacactaaaattgtcatctcttccaacttagatgtccaaatcgaaatccaccatcaggtgttccgccatcaccatcagcttatgcacaagcaaaaagttagtttttgaaagaattaatacgacaaagtttttacaaattaacttatatataagttaattttaacttttgaagaaattaattttattttgttcttctcctatatgagtacttttggaaagctccattagtatgagttgtgagacatgaattgctaatacaataattcaatcacttgatacgcgcttcagtgtttttccattttcttattatcctttctccctctcccttgaaaagcctaacataagtctttcattggacctaaaataattttctggccctgctcccatgcctaaagcgagtttgtatgttgctaagacaacaatcacacgtggttgtgtcaatgtcctcattaaagtacatcttacccatttcctattcaactcgttatcacaaacattaacttgttgtcacacggagagacctcatcattccttcatgattaactattacgaaagaggcaccccaccatcgaagcatcctaaatgctccaacaaggcttctgcaagcagcttgctcaacaccaaaaaaagagagtagataagtaccctttttttaatcagcaagtagactagtacccatgtactagttttgacctacaaatccctagttctctaagcaccaaaaacaataagacagctatctcccacttagcaagccatatcaaaactcaaactgccaacacacatatatgcaagcaggaaacgtccaattatgcacaccagcgagaagtttgacacagaagaggcaagcaagaatgcaagacaaacaagtttagactataaatgagatgatttggattttgagattgaggtaaatgatgaggttttgacagccaaaaaagttgtctgaaattataccattgaatgtaaatcttgtctatcaactacacaagtttttcccttgcctggagtggcaataataatttatatcttatatggaagctaaaacaaccaattatataaaactactcaatgaataatgcctctgcaacttgaatgcacatccactgcttgattaatagtgtggaagagcctggttaaacaaaattccaatctccttgcggatataaagatcgattttaatttaatgaccgtgagatatatgaacaatttccctatctgcagccttgaggggttacctaccaacagccattctattcaatccatctggtagccaggaatcaggatacatctgcataacaagattgttgtgaggcttaccttaattttgcttcataacacgattaacaaaaataccaaaaggccaagtaagataaaaggttaaaaacagcatcatagaaatccacattaccaccattacccatgcaacagtccaccagtcatacatagacactagtagtatatttgtctcttaaatcagaacactgccctattcttaataagaaaaggaaaggatccaaaatcaggacccatgatttcacatttgttcaaacaaattcacattggcctctactccattttctatcataagcccaaatatgaaactgcaactcctagaagtgaaaatggaaatcccattttgatctattttagaaagcaacattagaataaggatatattaagcatcaattggagatgtatctgtcatgcactctttgcttttaccaaagcattaagagtttgtaatgctaacaaactgacagtttttaagtctttgagaatataccatccactcttctgtattaataagtcctagccttccttatgactaacaatttagtcagcttggaaaaagtatagtcgcaataaagtacctctatgctggagttttactggcaaaactcatatcataattgtacatagtacatactctaaaaactaagcatactgtattgaacaacaaacatggggtgtagggagcagaaagtggattatttgtttcatgtaagttgagcttaactacttctgaagtataaaattttgctcacacaaatcagacatttcagttccgataaatttattagctaccaatcaaataacaaaggaaatatcaaaaagaaagaggcaggcagtacctaagtttatgttcaccaataatccccgcaggagcatagtccatccttaaaatggtggaaccttttcgcatctcgaataatgagttctctgcctacaagcttagaaataatcttcagtgctgtatggcaatcgccacaaacacggaggttcttaattaccctcatcggagcacgagcagggctgttaaggagaccataagcaacagcaagtctctcactgtgggcaagaagagcttcttctttgccttcctgatctatgtcatgcaacacaaattttgtctccggaacatagccagcttctttcatttgtgactttaaacctctaagcagggcatatatcttatcattttcaggatgagaagtatctcctgctcgatattcacggactcgactccttacttcaagaagatttttgcttgccaaattctttttttctttctcttttgtcaagtctgaggcttttacaggtacaaggccagcctttgattgctcatttaaacgagaagaatctagctgctcaactagttcagcacaacgatcccccagcccagtattcccatgaactctacagagattcatcaaaatctcccatatatcagcacttggctccattggcatcttttcaatgaactcaaaggcttcatccagatgcccaatgctgccaatcatgtctactacactgacaaaatgagtcatagatggtacaatgctgtaatccttgctcatggactcgaagtgcagcattccctcgtcaatatctcccagcatattacatgcaaatagaactccaatgaacatctgcccatcaggtttcagtcccaagtttttaaattgagtaaatagatcaattgaatcttcggcaaacccattcttggcaagctgtgttatcatggtatcccaagtagtcaagttgcgctctggcatattgttgaaaatgttgagagcatcatctacagaaccacattctaaatacatctccaatatcctattatatgtgctgacttggagaggtgacagatgttgtgaagcatgcctgtgtacgatttttgcctcttcaagagatttattctctgcacattggtgcattaattgcaaatatcggggcaaatccacaggaatatttagtttttccaacaattccaaaacttcaactgcttccttcacgttaccctcaatgcagaaattatctaattcctcaagtgtacctctatatggactatcattagatgcattgtctgattcgccatcatgatttgcgttatttgatagatgagagccaaccactgatctttgtgcaatattcaagtttggcaaataccgaccatcttttagactctgctgaaactgtccagaacctgggtactgttgatgcatttcatgactccctttgtaatgagcattttgtggctgctgaaaatgatcaatgttttgatttatgtcccctctaagatttccctgtgactctaaatgcctaggtgaactatatgtgttgggagattgcatcctttgtccaggttcgtgtgtccaaccatgtttctcaaccaagggatttgcatgcatcccagagccccatgcattatcaacacctgccctaactttttgttgcattttcatgttgccttgactaaagtacccattgacacttccattatgacccaccaaactattgtgaacgtttcgggtcacatttataggacctccgtctgcaatctgaccagctccataagaattttgctctgcatttgctcgggaaacataatcaggtctttgcttattcaacagctcattagactcaaccttatttcggctttcctgataaaacccaacacgattttgctggtaacctgaagaatcatcattttgataaccaccagaaaactgtaaatctgtcctttcagcagcagtgctaacagcactcaatgtactaaggcctttgggtgagcaacatcctttgcacaacttcaaaagagaactaactgtaactgatgaggctctctttgaatacattatttgggacttaacataatctgaggaaagacaaattggaaataaaataaaatcagtgaaaatgtaagacattggaggggaggatatcaactgaaacaacaattttggacaaaagattattctgaacagatgaaagtcagaaaggggtttaaatttaacaaataaaagaaaagcaatgttcacactgaatgcaaattgatgtttgtgattattaaaccaggagatcagagttgttccaaaaatttctctacaagtctatctctctaaatttatccccctaagatgtagcaaaataaattttctatttcacagaatgatgccacagaaagcttctaggactacactagcacaacaaattcattaccaaaaagtctaagttgactaaagaacaaagtactaaaaacttagcagataccaagttctatcatattatattcttatcaacaatagaatggtacagatacagatacagagcactcacaaatcacaataaaggagcaactgagagacgagaggaagagtgctctgttcgcgtcttcgtgaggatgtcgtagaatcagaaaacgactcgcgtaatcgcgttagggcaaaaaatttggattaagtcacttttgggtcaaactgggtcgcccaacccgatccggaaagcccaactctcaaacttgactgttgcttcctgcacctccgtagatttttaaaatttacccctttccaaaaaataccccgtatagagcttttaagttttaactttattttttattatatgagttctggatcgtgtgcttgcttttccagaacacgttttaattttattatgacgaaaaatatattaatcattttataaaaataaattttaaacattttcatatttataaaacatatatattttaatcttactaaaaaactagaatatgatgttttaatgtttgggttgggactgttgattttggttgccaataatgagaatgagattgatgcagctttgggccttgactcaggggacggcgtgatccagaaattctcattaatttattttatcctctttttgtttgtttgtctttccaacataatatgcacatgtcaaatttaatcatcacaatatcctattaaatttcaatattatctagtcttattatatatttattatttattttaattatttgttcagaaagaaaattgattatttatgatttaactttaaataggtcacgtgcaatttaataaataaataaattttctatagtgatagactccacaaaaatcttgaaacgaaatatacatataatttgcacattttcaagtgataaattaattacatgtgatatcaaaaaattaagtaacatgtaaatatatatttagaacaaaatgaatacacacatcctcatattaataagaaaaaaatgttataatgtatcaaatttaatgtaataaaaatactttataaaaatagaaatgaagacactggctgttagtgttatgtgtttccactggttatattatactcaattagaaaataattacttatgttatattaatagacaaatccattttacgaaaaattcttgtaaaaaataaaaattataaaattttgtgtttggttcattaattaataataaaaatattattatttattaatttttagacataactcttaatttaatagatagtaaaataggatatttattctaaatagtattttttattcattaattaagatagtctatttgaaacataaaccaataataaactaataaactttaaaatgcagagaagaaaaaaatggtagataaagaaataaacaatttgttaaaaagagagtggtacatgaagtgatggtagaagagtgaaaggttaatatttgaatacaattcgctaacttccgtgtgagagaatgagaagaactgagagaaaagattttccaaagtagaaaaaaaaattgttttggatttgcataacttttatttatttattaaggaggacataatagtttttttttattacttgttatagatttcaaaactgaaattgatttcttaaaaaagttgcaattgattttaaaactacccattttaattttgtttttaaaactgattcattaaaataaataaaaactgaaattttgattttaaaatcaaaacttgtttcgttaaaaaaaaaattaaaactaaccattttaattttgatattaaaatttaaattgattcgttgaaaaaataaactgatttaagaaaatttgaaaacaattttttaaaatttgtaaaacaaaaaagaataggagaaaataaaaagtttagtaggaatgaaatatataaaaaaagatagtccataatagaaaaatgcaaaagttaaacacactatgtattaatcttaaaaaaaacactattaaccaacaaaaataaaaaaataacaatcacaatttttaagaaatgaaaaataaaagaaaagtatttttcttgcgctatatatacaatgaaatttaattgtgtatacaaataaactaatacatcttaacaattttagttattgttggatgtgataatatatctaatgctttggtggatgaaatttttaatctttatcaatcattttcttttcactccattgtatgatgattttaaaactcaagaacaataatcaagttacaatatatgataataaatcgagacatgtaacaggtaattaatttaattagacacaaaaaactagtattttgatgaagtatgaaaggcatagcagttaagcaacaagagttgcagtaacagtatgtaatatggaagttgttctcttgcatttagacatgaatagtaatttgaagtgggataaaatttaaaatgtgaaattctcgtcattaacttctttctatataaaaaaaaaaaccttcacaaatgtatacaacataaaaatagttgtgaaggatcttggagagtaatcccacatcaatcaaatccttgaattactgttaataaataaaaatactaaaatgttatactttatgtaaatacagacaccaaataaatattaagtaattgttattataaaataataaataaacacacctcaaattagtgacaacaaatttattgacttcaaataataaaaattataaagctaccattatatatcctattacactgacataaaaaataggaaaataaatgtggataccaaactatctgatttcctttatagttatagacaattgaatgatagtaataatgttaaattttattttttctacactgttagtttatatattattttgaatttgaagttttgagaagagagagaaaaacactacaaaagagagaaaagatatttttgttgtttctaacctttgaaggcgcttctcctctctttctctttctgcaaccaaaccaaaaattaggttttctcgatcttcttcatttgtcactgctctcaccgtttcagggttttaccttcccaacacgacccaggtgcatccatggctcttctctctctctgcaatctgcatgcctctattattattgctatcattctttcctcgttgcttcggctatggtgtttttcttttcacgttttggttgttttcgtgcttgtctttcaaagacattgtgtttggttcgccattttgcttatgctatagtctatttgagatttcgaggagaatgaacttcgttttatgcatccatttttttgttcttctcatttgtttagtttgtgcttttgcatttttgagactttgtcgattgtatttgatgtgttctgctgatcggcttctgctttatgtgatatcgtgatgtaaatatgtttgcaacggttattgatcggaattcgttgctttgcagggctggttctgagcaattttgttcgttttaaagagtatttatctgtttcagcagttttttttgttttatttttttaattgggggcgacttgtagaggtgttatcccgatcctggaaaggaggggttttccctttgaattttgcggacaactgttgactacgagaattgttattgactatgcgaacttcatgggctgatttggctgcaaattctgcagctgaaaacgcaggtcctggttcttctgctaataatgttggaactggtagcactttagctcctacgcgacctgtttatgtacctccccatctgaggaaccgtcagccagcaggagaatcccctgcccctgctccagcatatagtgtcccttcctctggtgctggctctagttctggtgctggtaattctggataccgttataatgcgcccagaaatgattatcgtcctgggtatggtggtggtggtggacgcacaggtggatggggaaacaaaagtggtggttgggatcgtggcagggaacgggaagtcaatccctttgaagaagaggataatgctgaagaggcattcagtgagcaggagaatacaggaataaattttgatgcatatgaagacattccagtggagaccagtggtgataatgtgcccccacctgtgaatacgtttgcagagattgatttgggtgaagcacttaatcagaacataagaaggtgcaaatatgtgaagccaacacctgttcagcggcatgctataccaatatccctagctggacgggatttgatggcttgtgcccagactggttctggaaagactgctgcattctgtttcccgattatcagtggaatcatgaggggccaacctgtgcagaggccacctcgtggggtgcgtacagggtatccgcttgcgcttgttctttctccaacgagggagttatcaatgcaagtgagttagttagatttaccttgtattatgctatgattttaattggacactgttctgcaatgaaaatatatttgtaatgttctaatttggtttcagatacatgaagaggctaggaagttttcataccaaactggggttagggtggttgttgcatatggtggagcaccaataaaccagcaggtttttgtcccttttatctttgtttctctttatttcatactttgtttctcccacaactagttctgagtctatgacattatattcttgatagatgtttcaattattatagctctttctctctctggtgtgtagacaccttgtttcaaattacctagcaaagttgttctatttgagatccaagtttggtaattatggttgtcaaatagggatttgaatcatgaatcagaagactcgttttccgacctgtataattaattgtaagattcatgataaataattagaaatgttttatatagttaacaaagtcataaaactgaaaaacagatttattagcattttgacgcagagaaaataataaacacacacacacacacacacacacacatatataggcatctaaagtaaaaaagaaaaactcactataaaccatagttcaacgcataacagtcaaaagaaagcgagggtatgcaagggacacttacacagtggctttacataacaacctcattatttgttgtactcatttttcagttttcaccctttcagcacaaatagccagaggacacatcacaatgtccatgttagtccacatgcaaggaacaacaacaaaatatagatataacagcagcaattatgaccttgaatgatcaatgcaagcagcatgaaaacactagggaacacatcatatgtgaagcatgagttgtgtgggtagtcagagagtggagaaaaaaaaaaataatgtgtatgtacatgtttggaagcatatatagtctcatggtttcatagtgagccatggtgtgaaattttgttacatccattttgagcttcagtactgtttggattttcatgatttcaatcttccaataatgttgcaattctgtacttgagaagtttttgcatatgtctgtgtggatattggttggtcaagaattttgtggttatatattgtagtacatttgctggaggtgctgcaccttgtaattaatgagtctcaaacttatcactgtagatgtattctcctgtagattctatcctgttgcaaattttacttaacaggtccaatatggaatctaaattgacccatcaaattttaccgttaaatgatagtaagaaattttaggttttggtatatacccttaccctaacaagttatattttctctagatgcgggatcttgaaagaggggtggacattcttgttgcaactcctggaagactggtagatttgctggagagagctagagtttcactgcagatgattcgatatctggctttagatgaggcagatcggatgctggatatgggttttgagccgcaaataaggaagattgtagagcaaatggacatgcctccaccaggtgccagacagactatgttgttcagtgcaacatttccaaaagagatacaggtctgatatagtctgtaaaatatgctttcatgttaagcatgcttttatctggcatgttgtttttaataagaatgtgtttcttaattttgctacctttcctacttcatggggcagtttggcttgcttccccctcctcctttgttgccccattatctctagggcctgcatatattatggactccttttagtgctggttggaagtctatctcaggaagatgtgttttactttatagtgtaggttgtcattgctctgaaatgcattttccttgttatttgtgaatcacatacttgtatctaaggggtcttgctgttaatctccctcctcttctatttcagaaagagtgcctttagaataatgtaatttggttgcttttaatttgatttgagatgataagtggcttcagaggtataaacaaacaatgcatgaatgcctaattgttgtgtatattataattataacttttaagacctcttatgatttctggttgatatgcagagattggcttctgatttcctttcaaattatattttccttgctgttggaagggtgggttcaagtactgatttaattgtccaaagagttgagtatgttcaagagtctgacaagagaagtcacctaatggaccttcttcatgcacagagggcaaatggtgtacaaggaaaggtactttatttacatagaacttattacaagtgatttttagagactaaatgaatgtcatgaattgattcaagttgtgttaatgcatagatgatttggttggaaaaaaatgccagaacaactaaaatgatcatatacctatgtcacaaatgaatttggagcttttctttgttgtccagtgtcacatttccaaaagaaatacccgagatttttacaatgactattgtctcattaactattctgacccacttgggatgggtagttctcagtgatgcctatactcttctactcgtgcatgcatattgttaaaagaattaagatgagtagaagatgtatgctataacagatatgaagataagagatcctccttgagaaaacaaaattacaagagaaaaaaaaaaacaagagagcacataaaaacatacaaagttactgacccagtctctttaacattcctctaaaatggccacgagctttatgttatcagcaagtagaagccaaaacaccttatcttgtccccaaagaatttgatcattcatagaattctccttatagatacaagaattacattctgactgtataccccaaagtgtagcatagatggcttattgccaaaaaatttagcttctttacctctaccaaaaccaacaaaactagcagtataaaaatccaaacttttttttgtaaagaaatatctaccggacagtctaaactgattctgagcaacatgcatgcacatgtttggattatggtgttttaattattttgagctctgtcaggtaatgcctttgcaaagttgcatttgaatttcagtttgtatgggggatttatagtgtggataatctattttactcatgttgtgcttcattaagagtaaaacctcgctaaattgtggtaagattatttcattcatgatttttttttttttttgcagctagttttgactttagtttttgtggagacaaagaagggagctgattcgctggaacactggttgtgtcttaatggttttcctgcaactactattcatggtgacaggtcacagcaggttagtctattgcatgaatgttaaaagtaaacagctcttgtaatgggttgtcacacgtctatgatgattggtgtataacataagattgctttagtgctgtgaaaaattgtgcgtgttattgttaaaaatgaaattaaaagtatgaaaaattaaattaaaaatatgaaacgtttaactgaatccccaattccccttttttgccacatttcactttcccatattgctattgacttttgtttatagtcacaattgtttgccatttgaaatgaaacgcatgttccctgaatgagtatgaactctttctttaataattcctttcactctcacaactgcaatctctcaaaccgatgcctttggtttaaccaattctgcacaaattaagatttgtaatctcacttagaaaaagagctaatatatctgacaaaaacgaaattctcattaaaaatgtaacccacggacagtagttatagtatgccaagaaaagagcatgtcttaggcctcttagagcatttgtatttgtgctctccatggtatgttcttaagtggctcctccctcatttaaccaccagttgctaaaatttgagggataaaaagtgtctttaaagtagttattcattttagcaaccaatcaataaatttttaagcaacagaaaaaaagacgcccttagcataatagtggagaaggaaaactatatatctaaattctaaaaacatctaggaagaatatccaacctgactgtctcatattaacagagaagcaagagaaaatgagaaatcagaacagagaagagaaaagattagaatgtgtgaagttacttttacctgaacagaggacaagaaatctccatagctaataaagtgggttgaacattttatttgggttttatttagagatgacttgatacaccaaatagacgggttgcaccattgcattaatggaagaaactattttgttatgtttcttctgcaattttattgaattccaattttctgtctactgcattcccgtgactctaatacaaaacacagaatcttgagccttgcaagattcgcaagtcaaacatttcaagactagaagtctagaacagctatcaagtggttattcctataaaagaattgtttttggttacaggcaatattattaggtttaaaatgattctgttatattctacatccttttttggggcacatcttttgcagtcattctctgatattattaccctattatttgtttgttcaaacctggagctttcaaatattcttatgtattttttatttttcccgggttttttcattaatagggtcatggtcctggattcttgcatcattttgctttgtagttagtgttaggaaattgctattcaacttgctaccctcatattaaacccttttacttcatagcatttactaacttttctgttggttttgaattgcaacaatattattggttaagtatatacttgttagtcttgctgtgctcatcaattctgaaatacctgcaggaaagagaatcagccttgaggtcatttaaaagtggcaacacccccatattggttgccaccgatgttgctgcacgtggtcttgatattccccatgttgctcatgtggtcaactttgacctgcccaatgacattgatgattatgtacaccgaattggaagaactggacgagctggaaagaaaggtcttgcaactgcattcttcagtgataacaattcatcgctagctagagctttatcagaactgatgcaagaagcaaatcaagaagtacctgcttggctctcacggtttgctgctcgatcttctttcagtggaggcaggaaccgccgatcaggcggtcgatttggtggtcgtgacttccgaagagagggctctttcagtagaggttcctcagattactacagtgcgggaaacggcagtggtggtggatatggaggctcgggtgggtatgctggtggagggtatggtcctggggtcactagtgcttgggattgactttcttcttttcatagcattacataccatcttaggtataggcgtggatacgcctacgggatggttttactccccccgtgtttttatgatcttcaatttactcgtgtttcaagccatcatcattttgtactattttacagtgctaatcattgtggggaatgggtttgtgtatgtggtctagtagccacatcaataaaggttgtgtaatgatggtgggtattggtgattactagcatattaggagtttcttgtcgacaactttttatacccttcattttgggtggtaattttggtgggagactggtgggagattgtgcaaggggagagaaatcgagctttttgttattgccgatcgtggttatctgacttatctctctcaaagcatgctctttccagtgtcaaccaatttatgttggaatttaatattttcccactttggcaaaggtttttgtaatattatagcggtggttgaaatgaacaacaggttcccgccgatgatttcaattgaacatacactagtatggtaacatgttcattatctttgaatactatatttagggagagatgaacatagaccaatggcaaaggttatcttattacattgcacaacagagcgtgtgccacattatcaaacactgtttactcatattttcccttttcttaattaaacgagtttagaagagagaatgcctgcctttattttagtatgttctctacgtgaatttgtggtaatttgtatgtgtgcacagccagattttgctttttatatttctaagtaaacttcgctcccaatggtttcccagttttatcattcatcataggtgatgctcgtaatttttctatatacataacaaatgaaacaaataatagaggttcttctccctccagtttgacatagtggattattatattgattttaggtgttcggccaaccattttatttgtatttcaaaggctacatttatgataaagttagattagttttgtcttgtctattcaaagatagcttgaggtcgttaaagaagtggaccgaccatggactctcaagttgatgatcaagtcaataattccgattaaaatagaaagatactcgagtggagaaaaattacgtatagcacgggacccttatttatggacgtgtggatgggatttactatttaagacccataattgtcttcataagtagaaagttctattctaatctaagtcgactaatgtaggacttgtcttccttattaaaccttagacgtgggaaagaaagaaaaaaaaaagagtacatagagaattctatcccatttttaatatacatcccttattcctagtaattttatggtaacattatagttttgatgttattaaatcattattttactttttataaaaactgaatagggataacaagaataactttgggggaaacatagatgctaccatgatatttactatttatataactttttaaagtgatatttaaattcaacccactccctcaattaggggtgttcattaaattgagttgacctaacaattcaatctgaatatatatatgtaattgattttttttcttaagttcgactttatttgaatgaattaaattagttcaattcttagatttatattttttaaaactggattaacccgaattaaatcaacctttttattatgtgtgtaattaattatcttggttcatttttttaagcaatcggatctaatttgaactaaatcaattaaatttgatctctattgattcaattcttaaatttatatttttcaagtttaaattaacctaacttaaatagactgttatttttttgggtgaaaatgggggtttgagattacaaatatcttttaagatcattataaaagataaaaactttctaagtatttagtgcaaatttatattcagaactaaaacctaaaactatttatcaaactaaattagttcaatgtcatttagtccatgcacttatagtaaactacaattaaaaatctaaattcagaaaaaatttggacacttttatcatttttataataatttgtgtatttattagatctataatttttcatttttatttaatattttgaaaaatatgttattaacttcataatctgaatatatctaatttattctttcttaggttagttctgtttgagtttatcattttttttctactgattaattttaagaatttaatcaaaatgactttggtaatataatatattttacattatcatccaattataaattaacatatatgatgaatttattaattttagaataattatttctaacctattaacataataaaattactcatagtgcatgaaagttagattctcttaatttgaaaattaaactgttaatttcaactagtaattcaaatctttttcctccaaaactcgatcatcggaactcgcaaacaatgcaaacaccaaactggccgtgagttaaaagaaaagaaaaatgttaaaagccaaaatgtgttaaagaaaaagacaaaaaagctgttcggacttcgaagtagccatgtgatggccaatcttcacaatcccacaaaaggatgatattttctgcgatcaataaatcaaaaaaagaaaaccctctctctctccctctccctcctttgccttcaaagttgggttggtttgacccatgaactgcaactcatttattaaagaggaccatcgtcacaagcgaatgaagcgatgtgtcctcttatgacagttatacaatttatattaaaattccgcaaattcacacaactcagtttaacattaaaataaaattaaaaaaaccactttaattaatttttcgcaaatccccaagagagaaaaaaaaatcacacaatttttgtgaagctaaagcttgtggtttctttctcattctcaaccaaaggtgaaagaagagagtgagagaaggtgctcctcatctcaccgctcttaaagtcttagttcttcttccttccttcaaaactcgaatgacccttttctttgtttttcgttctcttgcagttcctgaggtaaagatacaagcttttctcttctgctcactggatcgggttccaggaattgaagggtaggttcaataggagttgtgttgatctgcaccaagatgcttaatttgcgttgaaaaatccattcatttgcaagactcggcttcggaaatgaaccagttagttgaaagctcaacgaatactcaaagggtatctagagttcaagctccactggtaaaaagtccaattcactccaattttttatctgcatattagttttcttcttttgaatagtatgactttttctccatttttcagttgcagcttcttcttttttcttttttcttttttgtgtggataaaaggttcgattggccagcgctgtgcttgaggttttggttaacttgagttcctatcattctctgcttgtgtttggaagagaggcggagaactaagttgtaacttcagtcaattgggtagtctatgaaccttagagttcttaaatgggaagaagctctcgtttatttctagggctcttcagtcaaaattagatcttagaagtctcttgctgcctcaacatgcattgtgtgttgactttcctaaattctaatcctacctaaacatgatgttctagactatagagtttcacgcagctaacatttatggagtgccaacctccatcgtccttacttcacacctttgactgagaatgctaccattctctttgttttttggcacctaaaaggctaaattcttaggggtttgaggggttgctccattccaaggttgcatatcactagttcatcagcaggaatgaacccaagacctttttgttgatgcaattcggtcttgctaattacgagttgtacttagctagtgttttacatatggggaatgttaacctccatactccacacccttgacagagaatgttaccaaccaggaggattttatatgtttgccttctcgggtatgtattgggtttgaggcttaagcatgtgtaggtaccaacaagggagtttaggacatttttgtttaggggggaggggggtggaatacttttctttaacttctctaatggatgtgctgagaaagtggaaatctgttttgggctaatgttcccctcttgttttatttttttggctagctagattttcatccttcttctatctacttccatttcttgccatataattttttcatggaatatttttataagaattttccagctgctgtaaacatagtatttacaagtataatcttagtacatagctgcaatgctcatttatatctagcctttgttctttgttttcatttagctatttgatcaaagagtgagcttagttttttattgtcaccttcatatagcatagagatttacttttttcatttttccttttacattgttccccatgattttccatcgaaagctatcaggttatatttgtacatatataagataaattaaattcatcttggtttatatgtcaacctttttttccctgagcatattattcctgcaaattcttctgctcatcaatatcactagctctaccttaagctatttgtcttataataatgggtgttgaaaatgatcagttatcataactcttgtatagagttattcttatctactctccgtcctcatatgtttcccaagattttctgtatttctcctttattgtagttcactaattttttggctacctgatatttcattttcttttgtctcaattaaaaaattcatctgatggtagtatctccatcaagcctgtttaatgaatcatctcaccttatcacatccttttatgatccttcaaatttactgcttgtcactaccttccctcattctggaagtgtaacttacatgatatgtattacaaatgcaggatgtagttactgaaaaggcctttcttatgtggccaaaggggagtttttcattgatttcatttttttaacttgagattattttaagagtaactatttttataaattcactttcaaactcttataagatgtctctctggtgatacccagatgctccttgttttctcttgaaaattctcttatttgtatttgtattttatgtggataataatggtacgcctaacacctttatttaagcctcacaagcagtaataaagtgatttatttgatcttgttttctgtttttatgttactctgaccgagcatcatttgcatgtattttaattccaatatattgcagatatcccttattttttactttttaaaatttgaggatattagacctaagggtttgaatagaaacattttagcagaagctgaggatagctgaagtgttatggcatttgttcaacattttcatcatgaagtcatagttttaaatagtgggtagcgggtagtggtcggtagcggccgaccccaaaaacgctatagcggtaaagccactactgtgaagtccatacttataataaattatccctttgaggcttttttcggggttcaagaagcaaaataggggatgttggaagtaaaagcctaagtctgttttacatttcatgggccgagggcccaataaaaagtgctggaaaaaaaattgctccataacgcataatcctcacatggcttccaagttccaacgtaccacaactagtcagtggaatcaaccaatagaaagcaagcaattagatttcacgatccgtgtctccagtcccaaattgcatctcagccgcttattcaaatttagaaaacacagttcaaagcatcaggagccgtgcgatttcgcggagcgggagaaggagctgagagagagaacgggaagcgcgacggtgccgaagatcttcttcggcgagaggctgttcggaggcttggtggagctgaacgcgctgaggaaggacggcagggaggagttggagaggcggctgaaggcggaggagctctgcaactcgcttctcttccatggagcggtgcgatagcgccgcaagagcttccaaccgcaccgccgccaccgaccgctaccggaaaccgtcacgttgcggcgcggaagtagcggctgggtgccgcaactcgcggttgatgcgagatagcgcgctaaagcggcgctattttaatcatagtatgtaatgaacctatctaatataaccttacttggtcttaagatcttactgccccacctgcagcattgaaaattccatggctatacaaaaattacgtaccccattacccaaaggttcctcgatatgcgaaggtaaggaggaggaatattgtactcagctgtacccttacatatgtaaagaggctgtttctggattcgaactcataatcaacaagtcaaacaatatagccattgaaaattccatgactatattcatatattataattttaaaacttaatatgactatattcatatattataattttaaaacttctcctctcaccattcttttattttaactctgtttctctcttttgccttattttcgatttatcattgggttcatctaccaccgaccccaattaatttgggttaaaggtgctgttgatgttgatgttgaatatgacctttccaagaaaataaagatttcagcttaataaaattaataatagtttattgtttgacaagtcaatagattgtgaagttattggtcttgaacttccttttattgttttcttgctgaaaaaaagcagtatagaaagtaggaactgttcaattctttggaacctgaagttggaaggagaagtatctaaagcttactgtgtgcatgtgaatatgctctcggacattatgcatatacatatttttggtgaaatctttttgatattttaatggtactttcaacttactgcattgagaattttacaggttgactctgtttcttgctactgtaaggtagattcaggcctgaaaacagttgttggggcaaggaaatttgttccaggatcgaagttatgtatccaacctgacataaacccgaatgcacataggagcaaaaactcacgtagagagaggaccagagttcagcctcctctcctgcctggtcttccggatgatcttgctattgcatgtttgattcgtgtgcctagggttgagcacagtaaactgcgtttggtttgcaagagatggtattgcctcctgtctggaaatttcttctattcactcaggagaagtcttggaatggcagaagaatgggtttatgtcatcaaaagagatcgtgatggaagaatttcattgcatgcttttgatcccatctaccaactgtggcaatcccttccacctgttcctggggaatattctgaagcattgggatttggctgtgccgttcttagtggttgccacctgtatttatttggtggaagagatccactgaagggatctatgagacgtgttattttctataatgcccgtactaataagtggcatagagcaccagacatgctgcggaaacgtcatctgtttggttcttgtgtaataaataattgtctctatgttgctggtggggagtgtgaaggaattcaaagaactcttcgatctgctgaagtttatgaccctaaccggaacaggtggagctttatctcagagatgaccacagcaatggttccctttattggtgtagttcataacggaacatggtttttgaaaggacttggatctaatcgcagtgtcatatgcgaatcctattcccaggaaactgatacctggatcccagtgagtaatggaatggtcaatggttggcgtaatcctagtatctcactgaatgggcaactctatgcacttgattgccaggatgggtgcaagctcaaagtatatgacagagcaacagattcatggaagaagttcattgatagcaagctccatttaggtagttcccgtgctcttgacgctgctgctcttgttccccttaatggaaggctttgcattatacgcaacaatatgagcatcagtctagttgatgttttgagtccaaacagacgtgtggaaagcaatcctcaactttgggaaaatattgctgggaaaggtcatgtcaggtctttagttagaaatttatggtcgactatagccggacgtggtagtttgaagagtcatattgttcattgtcaggttcttcaagcctgagatccaaactcctctgatgataatcttggctatacagttaggaaattgttggtattttgggaaaatcaaattgaaacaggtttatccactttcctgtgtgggaaagagattgtgctttcattgtaaagatgaggttaattgttgattttggctatagaatgaggtcattcctttacaattatgaatagggggcagatattgtaaatgttgtttcactcaaggctgtgccttttcctttctttacagtatattaggtttgtaagacatgcgtttccgctgtatatgatttattagaaaacatcaaaaaacttttgtatctttggtcaagttaatttattcagtaagcagggggaacagaatatcatatccccatgttgtggcaaaagtcattccaatggatggtttgaaaatcagttgcatgttttttaagagtaatagtatagtatctgcttggataatatttttctaaaagctagtgtcaaatacagatttcaaataccaacgctaatcaagtctaggagaagggattagttcgagattcttgttgggagagacgtatgcaattagtgttaaactataacttgagcaaaattacttctttacttatgatacaaatttattaaaagtaaattaagaaaaaaaggtagatgcacaactagtcttttccctgaatgtttggtggctgagaggaatacaaaaatatttagagaaactctgaactttatgaactactgaagaacttttcataaatccaaaattatatccttcactattgtattattctccattttaagaaataatcgcactttttttttttttttgcgtatgtgaagtaacaatcacactactattatttagccactgcagcaattccattcagctcaaatcactcatgcgcctctgtttatcatatcctgaaaacgtttgaatgaattttctctctcaatcttcagttgtttgcggcagttgttgacgaatgcatcagccattttgttgatgtcttctttctcattctcaaaaactatttgtctgctcattaatagcttcttcctatcgttactttcattgctgctcctcttgttggtgccactgccactgaagtcatttccatgatccattatagaagataaggtaaaacaaactctaagctcagagagagagagagagagagagattttgctgtagaatggcttcttgattcctgaaagagtgaaagttcactatttatattacaatctcagcatgtgtatagcatggccataggccagagaaaaaacacagaaagtggatagacttgaagagaatgtctttatgattgtcgtcaggcgaaaagagaacttagctttgtgagtggtacgtatttaatattactctacttgccgaggcatcatactttttgaactattgttaattcaggtaaacttgacttcaaaaaatacttcaatgggaacattgtttaattatcatggtaattggtagctttcttaaaactaaacgtgtaatttgttgtttagtaagacttttgacgtgtttaaacaggtggcccgaattgacccttggtcaagatatgtattagataatacatatatttgcctacttcttaaactttaagcagttccattgttgaaacatagctttaacgcatatgttacgtatcattcaattatctttatgttttttacttattttatttatgcatataaaaaatactccttaaaatcaaagaatacaacttttctgtgtccaatttgatgttcaagaaatgttttctaggggctaaagcctaaatgacatggaccaaggaccaaggacaaaccttccttcaactgccatgcaagttagaaacttcgaagttctaacagtgaagcaacacagaaaagaggttcatttatggaaggaagccctttttccgtttccttttcctttctctatatccttcttatttatactttttatgtatgttttcggattagtatatcatatagtattaagaatatagccaggcatgccattagactcttagtctttcgagtaacaaattttactttctttttaattataataagcatacaatattaagtattttgaatatttaaaagacacttgtggatagccgttttatagatatgtaagtttcttttccgaataacaatataagtagattacatgatggtagttagaaaaggttttatgttaaagtagaagagggaagtttgcactgaaaatatgttcggagctttttgaccaatcatggatgatggatcactttcataactataaactaaaataatatatttatatacagacatgttgatcatgtaattcattcttcttagaaaaatagaatgactttaatatacttctaatccctataatttactcttttttattttaattctttttgaaacaaagtttaaaaggtctctaaaactcgtatttttgttgtcgttagtctttgcaattactgatcaatagataatttgcatatccgtgtattacatagttactaaaactagtttgagatatttttactcgtctacaactataatacatggaatatatctaaaaaagaaaaatattaaaagtatttgaacaagataatagaaagaagagtttagtagctaacgcctaacagtgtagaaaaagaaaaggaaaatatttgttgtacacataccttgagagagataaagaaaaataagtaattgatttgatatataatataatttgataaaagagagaaagaatgaaattaaaatcgttgataaagtgtttaaaatttgtggatattgaaatataattactagtatcacagtccatcactatataaatatcacacttttgtactctacttcaattcaaaagtttcatctcaatttaaaattttcatctcatttcattttatttttcgttggaacaaagtgtagcttaagaatttcttatgtctcttgtttaccctcgacgttatccttcacgcgtaacccggaagaagaaactatagtattcgaatatctgatcatccctttctctggcttccttcttccataaggaacctctgaaatctgaatccatccattgcctatcgatgtctgcgattgcgatcttaccctttgtctgaatctttctactctacgttctaatggcagcagcttcagaattagaaccttttcaagacaacattctccattgcctctctctccattctgacccatctcttccaattccaatctctgccgtcacatatttccccaacagcacctcataccctcccaccttggactcctacatcagaaacctcagattcagattcacttcccccaccactccaaaaccatccttcatagtggcaccaacccacgtgtcccacatccacgcctccatcatcttctgcaaaagcttcagccttgatttgagatcagaatcagaagtgggggccacgattatgatgatctctcgtatgttcagaagccccatttggtattgttagttacctaacccattgatttaagggttttaggttttttttattttattcaattttggttttttatttagttttctttcgttaatttttgtttatcattttttaaaattattgttatatacgtgggttacgtaacccattggttttatttgttttatttattttgttttttataatttgtgttatttgaatttgttatattgtattttagtttttggttatttaaagaattaaaaatttgtttgtttaattatttaaaaaagcaagtcattttgaattaatgtaaattagtttaatattttgtatgtaatttttatatctttttatttaatatatctgaaattaatgttataaatactttgtattatgaatatttatttaattgtttttgtataatatgtttctaattttaaattttaaaatttaaaatttaaaatacttaaaatattttgataataatattttcttttaatatatgaaataagttatatttaatttgtttttgttaagtaatttttacaaatataattatgttaattaagcatttggaacagtaatggtaatttaattttgtaagagtagttgaaaaattaacataagatataatttgaatgacttatatttatgaaataaattgaaattaattatatttattatgtattttcatgcaaaatacgctggtccattacaccttaaataataaaatcatttcaatctaattgtatgtatcaatccatcaaagatgataataaagccaaaaaatatatattctgtctctcatatttatgttgtggagttgtccaggtttgatgggttatgtgaaatattttgtctcatttcaaattatctcatgacacaatcataaatatgtctacattatgaattaatgaccttattttgagggtgtcataagatgtccataagaaactgtaacacatatatcataaaattgttacatatttatacaccaataacaaatataaaaaattacttaataagtatgaaaattaaaaaataaaccccttttatgtttagtttatcaaaattaatatatcttattttatatataaaaaatgcttattattaaaaaaattcatcaaaaaaaatttattttcaaattacaatattaaaattactaactaataaaaatataaaacaattttaatatatatatatatatgggtacgaaagtcgtaacctatatacatacatataaaaaaaataaaaataaggctactaaccaaaataaaaagaataaaaggccacgctactaaccaaaacaaaaaatctggaagccaaactcaataaaaaaaagaataaaaagcaaaaggtgtaggtgctgctacaaatgaataaaaaagcaaaacgtgcaggtgcttgtaggacttttgaatagtaagcacggtaaagtcgtaaatttactactacttgaacagaaaataaaaaataaaaatcatgatacatgacacgatgtctcactaaaaagttagcacgacttatctctaaataataatttttttaaaatttttactcctatattaaaacaagaatgccccttatcagtcaaaaagccgcaatttgcataggtatggcctgcgttagtttgcaaatagggcaagcaggatttgcttgcgaggtgaacaggcaagtcagggttcaaatcattttcacattggtttgcaaacctaaataaaaatatttttaaaaaagagctaaaagtctaaaataacaaaaaagaaaatattacatgggttggttcagtccaactcatgggttaaataggttaacctgaataagcaagcatttaaatgggccaataggcatcacaaagttgggtttccgctagttgtaagttaaacaacaagccttcatgaaaataaacattaaaaaaagcctaggaccatgatctatgtagccaactttaataatattatgcaatagtgtttttaacttcttttttataataggacaagcaatattattcgattacgacggacaaaactcttcgtatttaatgcacctgcatacacaagatttaaactaaaaaattgtgatgaaactggagcaatctcaaaccagctcattcaccacttggagatagtgttttgaactttttataatggaggcatgtgatttttttgtattggatagttttttttttttttcagaccatagacattttttaatggagataatcatgtttaattcggatataattaatgtggacgcatattaagtatctagcgcaattacatatatgtgactcaaatttgaaactagtggttaaattaaaataatcttattcagatttacgtacagttgtcggatagtttcattattataaattatgaatttatgagatttaacaatatgataaaacttagaaataatttcttatatgctttgtgttgtttttcaattaaaattaaattttcattctcgtatttcatgtaataaagatttatattaaatattaacataatcaatgaagtgaaactttaattataattaggtaaataatactaaatatatcttcgaagatgtatcttctaagttttgtgcttcttagtacataataattttttaggcttattttatcttaaataaataaattaaactcgcttttagcaaacttttttaaaaatatttattgtttgcggaaatataactttattatattcattcagaaaaaaatatctttattatgctcaaaattcaaaaacaaaaagtcacatttgaaacttgaaagctgctgactgctgactgctgactgctgagtttagcattgttggtacggccacgcgtcccacgaacttggatgttataaaaagttcttgaagatacagtttattatatattaatgaaatatgatttattaaacgagcaaatacctggcaagctccagaagaattttttttataaatcaccgaaacaacacagtcatattaccgaaacacaactttaccaacgcataaccaattccacaaattctttttataaatcaccgaaacaacacagtcatatattacatgttgaagattcaggttaagcatataagcaagtccacttccgaaacctggattcaaacggactcaaaatttcaagacatgtatatcgcgagcgacatgtgggtccaaacccaaatgtccaactctatcaaagactttttggttatttctttcatttttatttataaaattcaagtttaaatttaaaatgatattttttctttttataaaattcaatttataatattttttgtagtaattattattagactaaaaatatctctcattaaaagaaaagataatgtattaataaataattaggagagacatgaatattaatgataaagtgttcacatgttaaattgaatcatatttaacaaaacctatcactcaatcccatcaaatatttacgtattgggtttggttaggtttgtaaacaaaaaattaaacccaacctagtcctgatgataaattggttgactcgagtaaagttaattggatctaaatattttaaaatatatattttttatttgtaaaaaatacaattttaaaacaataatttatttttgcgcaaagctttatatgtatataatgactaaatatattaaaaagaaatcaaattataataatatttgactaatagaattaattatttcaagactaatatgatattttactttagataaaaataaaatgttatattaacataaaaaatataaacaaaataaagacaaaaataaaaatgacaacttaaaaattcatggattgtttaatttaataatttaatacactacacgaattaaaaaataatattttttacatttaataattaatttacatataataaatttaattatatggtatgaatttgttcaagtcaagttcaatattcctaattaataaaaaaagatagttttagaaaaagttaaatttttttgagattaattaattttttaatcattatataccgcaacagagggagtaaaaaaatagtttttaatttttaatttttgataaaataaaaacaatcgttcgaaataatggatgtaagtagttgttggtgtgtttaaaattgaaaccgagtctcttcccgaaaggagacaaagaccagacacagagcgagagagaatcgtaactgaagcggtcactggaagttgtctctacagccctctctctctctaacgttttcagccatggcaacaacacccccaagccgatcatcatcacacgcgtttgttgccatggcaatcttcacgactctgttgtggtgcgcgtgtgttagcacggcggcggcgaaggagagcgtgtacgatatactccccaagtacgggctcccgagtggtctgttaccggacaccgtcaccgactacacgctcgacgaggatggccaattcgtcgtcgttttgccgaagccctgctacatacagttcgattacttagtttactacgagagcaagatctccggcaagctcagctacggctccatcaccaatctcaagggcattcaggtccagcgcctctttctctggttcaacgtcgacgagatcagggtcgatttgccaccctccgacagcatctacttccaggtcggcatcatcaacaagaaactcgacgttgaccagttcaaaaccgttcgttcctgccgcaaatccctctcgtgcccccctcgccttccacgttcaattcaggttcgccattcttttactcttttcctaatttcttgtttagacgctcgatttttgttatttttggaacactagattaggtttaattgctctaatccagaaactggttcgaaaagacttatacttaagtaaacatcgaagctaagtatggggaatagtcaacgaattttttttaggtctctattttttgaattttgactgaaatggttaaacctttgatgctctgtaattagtttcatgagaggtgtgattcaaatcaccaattatacccttacatacatggttaccagacacccacggagaggcacattatagcacttgtatgctttcagggtttcttagtgtgtatgtgttttacgacatgcgtatccacatgctcaggaatttaaagggatcatccacttgaattagtctaggaatttcgagagattaatttttctagttctcgactaaaacagagtttttgaaaagttgaaggaattgactcaatacagtctatatattgccctatgggcaatacaaggaactcaaactatgcagtggacctaatttatagtagtacaacattgaataatattgttgggattactaagggctctaattcagtcggttaaacaatgtacgtgaattattgtaaattcagtaatacttgagttcaattccttatgaataaaaaaagatagaaagttgttgggatcagggctagtttcgcaccagttccttggttttaagccgtttctgcttgtattaaatgcactttaaagttgaaggcagtcattgatctttccttgcgccaagggggaagtaatgttatagagttcactctacttatggccaattgtgagtatgtaataactcatgaaatatttggactcctcaacgtctcttatgatatgcccaaaagggtcacgagggtgtgtagtgtagtgtactgattgggtctgtggatcgggttcaacgtagtagttgatatctagtggctgaaatagggaattgtctgtgtctgatgcaggatattatatgccaagaattgcacctatgctaatagcttgagtttttggcatgctgacaaacgctcttgatcatatcacctaatatgagttttttgtgtatgcaatatggtctgagcatgggaagggtaggatggttaatatgagcttttcaatcatctgttgctcttgtaaatgaacaaacaaatcctcaaaactgcaagttttccactaattagaggcatacactagttaagtttgtccatattatcttataaataaatatcatctgcaaccttttttcccttgtttggtattttttctaatgcagtcagagaaatactaactcgcataaaacttctggaaatttgcagctacctgctccggtcgatgaaattcccatgcttctcactgagtagatccagtttcatactagctgttgtatttcataatggaatgacgttttaacctgtcactggccctctattgccttagcttatatttgtcaaagtgtccaagactcgcaaaaccgagtgtggttgcgttatattatatcctcgggagacctttatgaacatgatattatgtacatatttaagctgagacttcaacttcatgtgtgttgctgaactttcagttgctggtaagatttaaacgtgcttatttaataatgaatgccaaagtccggtcttggctataacaacgattgggatgttggcctttatttaccctgttaccttactatcctcaattgttttccacgtgatgatctttttttctgtgtactagggtgattacttttcctgatttgaatataattgaaatcacgataacctcctcatcagtgttaccaaatgttttcttaaaagtttaatatttaatcagtaatatatataattagggtgacaaggagagagaagagggatattttaagagtgtaaaaaaatcaattagcttgagcctttttgtgtcttatacagtgggccttcttgtcagtaagttggactcaacttgtatgcaccaagttgcaaagcttgtttctttttagtaagggcatattactttggtgtaggttataaataatacacatttatgtaagttgataattcatctatttatttattgacatgtggctgcttttgtcatgtcgggtaatgaattttaaatttaatcagatactatctaattaattttgaattaatttaaacaaatctaataaaatattatcttatcaatttaatgtctaaaaaaaaaataaagaactatatggaagatacaatattacatgtctagaaatatgtaagtttatcattaatgaaaataaatacatttattatatagacatagcacacttcattacattgatgcaatttaatatctttgataaagataaataaagaaatatatggaagatgtaatgttgcatgtctagtaatatgtaagtttatcattaatgaaaatattaatcaaaataaactaattaatgtagtaattattaatgttagtactcaattatataactatacatgagttgttaaagttaagaattaagtagtgattaattaaatatgttgatagaaaatcgattagctagtcatggcataaagaagtatttattaaagagataaaatttactttggtgattattatgcctcaaaaagaattaatatctgaatatctattgagacttgagatatatatattttttaaccaaaaaaagaaagtagtgattaattatacaacatttaaaaatttatataaatttatcttttcacttaaactattcaaataagacataatgttcaatatttattatttacaataaatagtgtgttcatttaattactcaagtatatgtatatgttggatttatatatggtactagacatagcacacttcattacattgatatgcaatttaatgtctttgatcaaataaaataaactatatggaagacgtaatattgcatatctggtaatatataagtttattaaatgtaataatgattgggtggagaattagagattcatttcatgtaaattttatatgtaatgttagagagttttaattttgaaactatatatgttatttggaaattatatgatggttatatgaattatttatcttaaatttataaatcttgcaaaaatgtcatatagatttaaaatttttattcctatactataattattagagtgagtatttaatttgaaccacattaaattttgaattgaaattttttttttattttgtaataattaattaaacaacaattgttaatataaacaattcactatcaaattatcaactctaataaaaataaattgttaagtaatatttcttaactttaaacatctcatttaaacacggacgtttgaagatggtctaagttgtttttatgtcaatcaatagttcagttgattacagttgctataaacccgtaataaatgtctcattttggtactattaaataaatgaacacttagaaaagatgtcaacatcgatccaaccaattacgtaatagcaagtgtaaatagagggtcctagcacaatgatatttaaagcatacacattgttgaggtcaagtaacgggtccccttcaatggtttcaattagttggattattaatcacgcagacaacggaggatgggcacacactgaggcaaaaataactaaaggaaaaagacagtacaacctagtaaaaataaatcacaaattgcataacatatacttacatgcagaacatgcaatgaatccgagaaataaatagacacaaccaccaaaacatcctactactcttgatctcggttcaaactacgaagaggaacaaatgagaaatgaaaacaaacggtaaaatcccacaaagcacctctgtcaccaaccacctctttccccacccaccaccgctgttgttgttcgtgcttgtgcttgttccctttgcagtcgcgctattagctgcagtcaattttcagttcaaaatcagagactacaattatattttggtctcttaaccgtcacaattctataattaatttcctcgtattttcaatcgtgtaaattagattctataattcattctgagacccaattaacagaattgaaaataccaatatcagtgagttcacaattactcacacccattcattcaacctattgaattagactcattgaagaaaaaaaatatgaataattttgacaataacatcaatttttctttgtatgcatatgaaatgagccaaaaccacagccacaaatcatgatttaaaaccctgatgcggacaacaaattccacgatagttaaaggaatgaataaaaagtggaattacgtataataaaaattaatcaacaatatttaccactagggactgaggagggactagttttgttggtcaaggctttttcaaacccctcaaacaccttagcttccgtggagttaggtgccaaatgcaaaagatctgaaaacaacatataaaacatcaaaattgggtaccggcacaacataaaggtaacaaaataagtgtcataaaaagattatgtgcgtgtttggagtggcggcaccgtgaaaaaaatcgtggccaatctcaggatcgagccacaataacacatagttgtttctcaaaattcaccgtcacaccactgtttttggcccccaaaatcgattttatgccgtatccaaacacacaccgtatagttacacacttaccgacacactgagttatattggtgggtgttttacaagcatctggtaaatttagagcaagggtgacgttgatcttgaggccaagactcgggtcatcacgatccttgatgaggatgcagaggcacctcttgctcttcccaataacctctttgataccagagcaacaatccatggtggggactttggcttcaccaccgacatagggaagacaaccagctagaccaagaagtttgtcggtacattctgctttgtctcggttgatgtctgaggttgcaaaatcgaccaaaaggagcaacaaggctgaggagagtgctagattttttgcccctatggaacgcattttggagttgcacaaagaaaggagagagaaaaatagtttggcaactgagttctctgttcctagtttctagtgctttgctttgcttgcctgccacttatgaaccttattgcacgtccataaccacatttgtttgcaccttttttctttaattgtatatttatcctcttttaattcatttaattaatgcaaaaagacttatttgttatatttttttcttttagcttttgtgaagaagtaatagtcattgggcctatttggatacaagattagaagtacttttgaaaatttatctactgaaaaaaacattatatttccagtagaaaaactctcaataataacaactgataaaagacaagcagacaattacttatccattcattttttgatctctttaattttaagtagaagtaattttattttttagaaaaaaattaaagtaaaactcgttgtttctttaaattaaacacatatgatcctcttaccaattttttaaaatcttattttctatccaaatattgaaaatttatggtaattttgataaaaataattttaaaagtttagaagtcatgatttttaaaaaaaatgataaaataagaatgacttaataagatttgaaaaagaagaaaattggactttttgaattttgggtatttttttcatattttagttaaaaatttgaatataaaaaaagagtttcaaataaattatctaactttatttaccaaaattttgaaaagaaaaaattgttgtatttttaagttaaaaaatataattaatagacttaattacccgaattagaagtgatgtttggttcgttttatatgacctaattcacaatatctcttgtattaattattttaagattaaaatatctctaattaaaataaaagttgtaatgtcaaaccaccacaagagagaggtgaaaattgtagttttgaaaaaaaataagatatatatatatatattgttataaactaaattaaacacttttttaattctaataaattagataattggatctaataaatgagactagagggagtattttttttttagaaaatgatttagcatttacaattttaacaaagttcaatgtaagtttgcactctgtactaacacccatataactaagattattaataaaggaattcaaacctagttagaaattaaacacttgcagtatttttttaagattttctataattaaaagtgattttttttataaaaaaaattaaattcaatttcaatctgagttgaatgactctttcaacgtttattttttagtttgtaggaattactaaatctgacgcatttcttatttttttttataggtcttaattaattgagatattggtgaaaatattttgattctttaaatatttcgacgtaaaagctaatcagttatgttaaagaaaagtatttaatgaataataagaaaagatacaaaatgttactgtaccttaaaattttggagcattgaaaacttagtaaatactcgtattaaataagaaagcaacaatgcagcattagactcaaaatagaataaatattacacaataaaaaaatttaaactcaataaattcgtgaaaggagtaaaggtctgcgttagaagctagctgagaccaaattaatgtgcaactaaagcatctcaaattctcagtattctttcgagtctaactgaagtcattcctcgtcatcatcaccagtgaaagatgtttttgactaaaggaacttaattatgattataatattaggctaatattcaatacattacacatattctctttataattttattattttcatttttatctataattttttaaattgtttgtcattataattcatccgaattgaaatacgaaatatttagtattagtgggtatatgttcctttcgaagatgatttgtctgtattactaggttgactgacgtacgtaagggtgttcgtgatttggattagatcgattttaaagcaaaaaatcatctgatcaaattctttcagttttatcatttgatcatctattcggtttaacttaattatatcaaatgtctgttcacttatgtgtaaattagtttatacgatgaatatccaacattttcctctaattttttcttctaaattatatatcacaaaacatgtcaatcaattgatataaatttagtttaagtttattagtagttttgaatttgaatcatgagcatataacgacaataaatatttagagtaaaaattttatagttcgtgattgtatattcaacttaagcaaaattgttatttgtgaaatgtgtggtttttaccaaataaatatagcaagattattgattttaattaatttaaaaattatatctagattaaattttaatttattcagagtgtaattttatttatcaaaattaaactctctttatatattatttttgtgaagattagtttcttctaataaattcaactttgatcgggttcaatgccaactttaagtaaaaaagtacaaaaaaataaaaatagaatacactcctacatgataagatgaaatatgatataaaaaatagtaatagtaataataattaaagttgcaccatatcgtttgctggccggtataactaaattaacatttaattacactaaaaatatttatttatacaaaatatgtgctcagatcttcttcatactcaagttggtagagtggtggtaattaactatggcgcgacaacaatgtcgatgggggtaattaggcggtgattgctgattaaggagtagttttgagtaacgtgggtggtgacttggtctcactaatcacaaaactagtgatagtgttgctaatcgtttcacaaaagattttctcataaaagagaagacctaattcaaaatatttagtaaaatatattatttaatttcttgtttaagataaaaaaaaaaaaaaagaagactatttaatcttgtttgtcaagcacgatcctccaatatttgttgaccaaacattatgacatatcaaaatattttgtcatattccaataatgtaggtgcatgattatgtttatcagttaattgatattgatattataggtagtgatctcgttaatactcgattaataagatcatgcaaggatcaaaatacgattcgatccaaagaatacataatcctcaacctcaaacaaaaggtgtgtagaaattaagagtataaggattgaaatatgaactaattaaagaatatataatctcctaatttcaagtatatgattcgtagaggcttaagagtgtaaggatcaaaatataatctgacccggaggatacagtaatcgtatgctgatatgcaatggtggcattaaactagttttattgaattgggttcaataatccatttggttgagtgttaagctagtttcattggttgaagagcgagtggctggctaaatcggttaaagtaccgtaaatgtatttaaatgaatatatataaaataaaaatactgttatgtaataaacaaataattaaattgtgaaaatagtttaattttgattagccaatttatttaattttaacattgttaatcgtttagacagtcagcagtaagaaaaaaaatcgattacatttcgtaaagtgaaatattttcaagagtttccattcaatatgcatacaaaaatacaaatagaaatattgattttactctacggagtaattttctgaccatagtagtaactagtactaaacacaaataaagaactttccagagaaatcaaacgacggaatcagtgaaatgttttctactatgaaaaaggccagccgaatagaaggtgttaggtgtgcacatctttagctcggggatggatgtcatggagattagatgatcatgaaaagaaggtaggtggggtgtttaattgaaatcagacgattacggcaatgactgatataaatataaatctatctatcatcgttcataatgagaaagaaataaccataactgagtcgggggaaaaacaaataccaatgccgaatttaggattttatattaatttttatggaataaaagtcctttagagcctaaaaacattataaccactatttatcttatctttaataaaaaaatattagtctataaattaggattaacagaattctaacaattttttgggcaagacaagaaaggaactcgccctttgacaccacaccaagggataagagctaattgctggcgatgaagaattttattttaagagctagtgaataaatataaattggaaatggatgttcatgggttaaacttactttttatagtagttttttttaaaaaaaaaaataagacatgaaacttaaaatatttttacatttttatgtaattacaaataactatgtatagtaaatttattaattttgataataattattccaagtgaaagttggaaacttgaaaatgatgataaaagaagtatgccaaacaactgcaaaacaacaattagcaaagtccatgtagaaaaacattgttgttacttgtgattgatctgtcgggattggaaattttttgtgactaataaaatgtaaatgagttaaattatttgtgaattatttgagtttcacttgtaaaatatttgatcaagcttatttaattaattaaataaattcaaacttaaaattatacttgattatttaaatgagtcaagttcaaattttacaagttcaatattaatagtttgtttatatataaagagaaaattaaaattatatatatttcaaaatatcatatcacatgtttaatgtatattattaaattcgtagattaatatatattgttatttttttacacaattattattaaaataatttattaaatattaacttgataatgtttaaaaaaattatttttttacaaattaaaaataattaaattttacatgagcttaacaagtcaaattcaaactttattcttttttaataaataaagtccaaatttttaattagatttatctaaataaataaattaaacttgattaatctttttttataaatcaaacttaaattttaagaggtcaatttgactaaagttaactcatttagacccaccgatcaagtgcgcaagtagtcgtttctataataatggccctatccgcatcattattgccttggaacgttctcaactcgcctctcacgtctatcattattaaagcatatagagtgcacaaatcaagatttgaatcaccatcaccttagcctctaatcctctatccaaaagtgctgttggttaaatttgatgttagaaggggacttgccaattagggcgttgaaggaggtgatggtatactggcatagtattgagagaagcaatgtccaaaaaaatctgtccttaacatcatcttcaatgacccaaccaaaataaagttcttgtgatgggaaagtttgcatggttgtcatgagaagtaacttgataagaactgattcgtcgaaactcaatcaaactgataaataaatgatttcaagtttgaattatatatacaataaaaaaatatcatgaaaagaagatattttatataaaagtgaaaaaattaaatttaaacaatataattaaacatgaataattaaaatttaacgttatatgatcacttaaaagttatataattttttatgttaaattttaatcctttatgtatgactatactattcaaatttaatcttttaacttccattttacagtttgttagctataaatatacacaccatttgtgtgtatatagacaaggaaaaattattcagttcttgatatggtagttaatttactatgattttaaaacaagtcatatcagaatgtattatgtattatttatcatatataatattatctgacttattttgtcatatcatattattaattaatttaattttttgttttttacaatgaaagtctaaagatcattttgtaaatttgatatttttatttttatttaatatattttaaaaagacacattaatctctcattgatttttaatcttcacaattctaaatctagtctttccttggtctccacgaagactttttaattttaaaatgttcgtgttctactacgttcatgacgacttcctctaaccgctgattaggaatatactgtgacatcaaataatttatttataatctgtgttgaaatatttaaaattagttatttcttaaaatatatatatatatatatgaatattttatttaaagattgataagaaaattttatattataaatgtgagatgaaaatggaaacctcaggagatccacgaggttttgaagacgcaggaggaggtgatgttgtaggttgggtcgaagagtcacattaatctattgtgaatagtaactcatcatgaggcaatcaagaaggccacagtacgtaaaatctaattagatgtagaaaacggtggcgtctagcatgaattatcccatttacggacttatcgatgaattatccatttttacctataatagcaggtcatttattggaaggaaaacaaaaaaaaaatttgataacaccaaaaaaaaaatataatattttaatagacaaatattatcgaatgaataggttgcaggtttcaaattacaaacggattacttgctgaaccgataaatcatttataatttttaatgataaaaaattaaattacgagtaaacgtaaatgccgatggattaataataatcttaaattgtttcagttggagttaacttagggtagcactttcataaataacatttaaatttaattattataatatataaaataataatattaaattcattaaatcaaaaaataaaatttatataaacaaatcataaaaataaattatttaaaaacaaactataaatatttttaaattaaaaaaataattaacacaatataaaataattatagattttttaaaaatagttaaaatataatataatttaatgatataatataatttgtcaattaattgaaaccatcttttctttatattaaatttattaaataattattttataaataatattcaattaaaaaatttattaacaaaaaaaatatatttatatattttttaaaaatgtttaaaatttaatattaataaaattacgtaatatataataaagttaaaaaaacaagcttacgactttaaagtcgtaaccctttacttgacgcacccccctttttcatatgttacaacgtattttgttaatttttttctttcttttctatttgacccttacatcaagattgtcttcgttcttttgcaactcccactaccaaccttgcaggactcactgttttcatcgaaaatgaccattaacaaaaacctgcaagtccaattaaaattaatttgaaaaaatgaacataaaaaataacctgtttttaaattttaataacctatttttacttaaaaatgaccattaatttttttaaattgttcgacggttcctgcgactccaatttctccttcaacgagggctgcgaaaaggtgtcacctgcgaatagcagataatatatttggctttgattccccggattcagctaaatcattggatgctgcatatgctcctacaattgcatcaaaaattccttgggtggctgttttcagaaaccatgaccaggaaggaaccctctctagggcaggggtgatgaaccatattgttaagatgaaaaaacaccttatctaaattcaatcttctagaagttcatataattaatggttttgcatgggaactataacttggatgttggaggagtagaagacactgattttgaaataaatcagtgctcaacctgtactttgtcgatagtggagattattcccaattttctactactatttttggttatgatttgatcaagccctcccaacaactttggttccaacgaacatctgcaaagcttaaggtgctgccttatcccttcatgttgtaggccaccaagccagttgaaaaacatttcagaaaccaagaaatgaagccaaaaaaaaaaggttaaaaagacacactggtagctctcaaaaccagagcatagagtttacaaacaaccaaaatccgataaggaacaacttaaaaaaattaaaattaaaatcaagagctttctcaatcaaaatccaaacaagccatgtagaacaaagcacaacaagatcctgatctacccagaagagatggaggccggtgtcggggaagaagcacaacggggaggagagagaaaatgataaatttattgaattatattaaatttttcgatttttttattattatattttctttcgctcatgaacctttttttttttgtgttgccaattttttttttgttttccttccggtaaatgacctgctattgtaggtaaaaatgggtggttcatcgatgagttcgtaaatggagtggttcatgttagaatcgaccgtagaaaacagagaaatacatgaatgaaataaaattgataagcatgtaaatatgaaggatcttaaattaagggcacttgggatttccttccttggttttccaattgttatagcatggatattcctccttgtgaccataggttcctgatggcataaacatgtattacaacacttgtgttgagtcactgagcaacgataggcacatgcatttccacattctgcacaattaatgatgtcatcaagattttagttgtgaccaatcaatacattaatctttttcctcgttcttttcatctataaaaagtttaaatttaaataagttttgaacaagtaccttcaggacgaagtgatcccgccccaccagcctgtggattatttaaaaaataaaaaaaacaaagaaaaatgaattaaatagacgttaaagttaatgatgcatctaggggtcaacaattatacattcatattatgtatgttactccaacaaaaatgtggcttgtatgtgaactggttatagcttccatgtgaaggttcttggtaagtgttagttgcaagaggtagtccagttgcaagcacttttttccttattactaataactagcaacaaaatgttgttcagctgttgaatagaaatcaaaatgttactcagttatttgtttggagcgtgctcttttcaggattaagatagtggtgcctgatgaagctactgcatcaattgattacgcaagagatttgattctgtagaaaaacattaggctgagtttgaaaattgtcttctggattctcttcaaaactttgtgcttctctttaatttgtttatttagttttgctttcgctctatgtttgctttggtttgaatgggcaatcacgagttctagtttgcatcaatgattgagcctctcaatgggtttactcctttttcttgtaaaagcaatgctaatcttagattatggagtctctctatttcagcttcatcaattgccaatggcatcattgatagtctctcgatgggtttactcctttttcttgtacaaacaatgttatagagcaactagaatacaatgctataagaaggcccgatcctggggcagggccagcggggcctccgcccagggtccaaaaatttttgggccagtaatttaagtaaaattttttattaaaaaaataaaataaaaataaattaaaaataaaatctatgttaggggttcattttgtgtgttaggggcccatttttttcatctcttaattttaatattatttgtatttcaaaaaatttatgtgtcaggggcccattttttttcatttgttaattttaatattatttgtatttcaaaaaatttgtatgttagagatccattttttatgtgttagaggctcatttttttcatccctagttttaatattacttgtatttcaaaaaatttgtgtgtcaagggcccattttttccatctcttaattttaatattatttgaatttcaaaaaatttgtgtgttaagggcccttttttccatcccttagttttaatattatttgtatttcaaaaaaaaaatgtgtggtaggagcccattttttccacttcgccttggatcaaaaaattttcaggaccggccctgactataaggttgtcaatgtttactcctttttctttttaccatcttgaaatggaccattagtatctttgaacatttgttagcattctcctatttataaacattacaactttaatggttagtaagaagatacaattgagttttgcggtttgttagcccataactatttacagcatttgagtgtacacacacacacatatacatatataaacataaacggaccctccagaacacagcaacatattctctattcctcgccacaagacccttttaattatcgttggttgataatgcatattaaccttaatttatacattttttgagatataataccatttttttttcaatatgaagagtcacaataatatagtaactcatcatgaggccattaaggcctcagtaaaatcttattagatatagaaaagtagaaaacagagaaatacatcaatcgtgcaattgagttgataaatgataaacatgtaaatatgaaggatctcaaattaagggcacttgggttttccttccttggttttccaattgtcatagcatgcacattcttccttatgaccataggttcctgatgggacacacaaacatgtcttacagcacttgttgcagaagaacagacatggcttcctgtgatgagtctctgagcaacgatattcacatgcatttccgcattctgcacaatgtaatcaagatttcagtcatgatcacctcaaccagattatatattaatcttttaatttcctcttcttttttttttttcatctagttaagctataaaaatgtttacatttaaagaagtaatttttaactagtaccttcgagagggagtgatccttccccaccagcctgtggattttaaaaaaatagtcaaaagacaaaaggattcatagacatcaaaatgatgaatccaggggtcaacatctttttataatgttgttaattgttagtccgtgaataaaatccatgattttttctttttcttctttttactatcaaattaattttataactctcatgtgtcaacatttatatgtaacttaattatcaatttgatttttaaattattttaaataatttaatttgatttttaaatttttaaaaataaactaatttgatcccaaaattttaaaaataattaatttaattttcaaattattttaaataatttaatttgatcctcaagttatttaaaatttaataatcaaattgatttattttcaaaaaattgagactcaaattgattaattttaaaaatttggaaccattcatttttaagaatttaaagattaaattgaactttttaaatttttaaaatttgagaactaaatataactatttaaaataatttgagcatgaaattgataagtaaatttttatacctacgtgtgtgtatatatatatatatatatataatagataattatatgcaatggaaaaagaaaagttaatcataaggggcaagaaatatataattatacatatatgacgcaggaaagcgcagagaaactcaccgaaacaatttggatcacagaagccatggggaggatgagaagaaaggcatatcgaagacaaacaattttagccatagttttcgccaagattagtcaataacttctacttttatattttttgtttctttacttctgcttttataagcagtgatgtgatcaaggatttacattaagaaaggctgtagatggcaattcactaactttgagcgcctactttgggataaaatcagattttgtttaaatgtagcaacaaaatccttccaattaatgcaaatgctttaagtcaactattaaatgcatcgattggttagtggagaatttttcaatttaatgagtgatatcaagttcaaatactaaatatatagtttgttaactacttagataattcttataactcataatagatatactcaaatcaaatagaattattttctataaactaccctttttattattgacagcatactacctttatttatatttatatatacaaaaaaatcaacttgaacataaacattaatataatattaaatgttattaatgtataatttaaatagacatataaataaatagattttctcttacagtgtattgattacaatattatgaaatattatatatactaaacattaaaagcattgttataaaaaatttattacatttaatgatataataaatgttaattaatatatatatatatattaaaatattaagtattttttattttacttaaaaattacctaataaaacttttttaaaactgattttttttcttttatagcaataattattgtatttattaaatattttattaataactaacatcaataatagtattaaattttatatttactaaatataatgtaattattagatttaataaatgtaatatatcatatgaatctatatatattaaaaaaatcaataaaaatatatcacttacatgaaaacaatcattaaaaatttaatatataaaataatatttagttgacatgatgtcatgttgagcatttttttagatttaattacatagtctttatatttacacaatttttacgttttactttttacacttgaaaattactcatttaagttcatgtgtaaacaaaaattttgctttatagtttttattgttaaatacaatttaatgtcgttaacaacatgatatgttgcatcatgttgtctaaaacattaatatgacattgactttaaggtgtttgcacgatacgttttagtccttatacttacactactaatttttatgttttaatccctacacctacacaatacattatttttaggttttggtccctatgctttcaccttacatttttgtccatagaaaccaacctacaaaccaagcatttcattcatcatttcatgtcaatgagcatgcattttccttatgctaatatgtgatctagaaaacaaattaactggcaacctacatgtttttaagtgtttgacgcaacaagattaaactaatgtagcaagtcactattattgtaaggaatgtttgaaccaattgctacgcttggttacctcgtcttatcccaaaagtgcatttgaactctacgtccttgagactctgatttagagtcaacaaattagttgatgtaaaacaataaacgtatttaaaagaaatcgaaaccgcaaaatatataaaaggaaatgttaagggaaataaaaaaggaaatagagaggaagggaagtaggaggagcaagaagagatcatataggaattaaaacataaaaattgtgcaagtagagatgaaacataaaaatagttcagaaactaaaccataaaacacaaacatgtatgtcaacactacattgtcacactgttaacgatgttacattgtatttaacgagttgtttttatgtattgggactaaaacataaatattgtatagatcatatagagataacaaaataattaattttttttttttaaaggacatgaatggcttaaatatttggtagagtaactgaacgtctggactgaacataaaaaagtcggtgctcatttaattgagataaataaaactaatatatctaaagttcatttattttatgcaactcaagctggaaataggaaatgcaaattgagtaaaggcagcaggaggaggtaaaagagaggccgagtcaaatgtctgaggtaatttggagcatttttaatttttatagtggtaaattctaaattaaaattttatattatttttcatacatatgatagtgtgatagtgtcatgtaaaattaaagatttataagtgttttttctatttttgttatgatagatcgatctcactttgagatcttaggaagaagaataaaaattattcttttttgaacaagaattttttcacaaaaactcgttctttatattagaaatttatttattttctttattggaagatataataactcaagattcttgttcaacatcttgtactaaagatgctcttagatgtgatgcaacaattatggttacatgacatttttttaatgtatttttgttatttgggaaattttaattttttaagttttaattatataaaatttatttaagagtataagtattaaaatactagtatattcttaatatattcatgaaaaatcaaggttgaccggttgacattacaaaccaaacggttataaagaattaagaaggacagttataacggaaattacatataagaaatgctagtgaaataaatgcaaccattctttattgtaaaatttattgatataaaattcacccattctttattttaagtgaataaatgcgttaattaatttattaacaataaaaagtcgtatttattgaaaaaaaataacttttgaattataagcaacatcatttaatataacgattacttaaatcattaaattaatgaaaatttctaaaataaaatgtaaatttgtaagtcttaattaaaatcaactttttaaaaaaaattaagatcaactaatttgattattttactaattttaatgaatgagttaattattttttttatataaaacaccagaaatgattttttaaatatctgacaaaatataattattattattataagaggagtattagtaccatcaaacgcatacatcaattgagtggattgttcaaacataactcattggtcttggaatttaaatttttaaatatgtaaccgtattaaatgttggaagacaaaattttggcacggctatcaccaagaaaaataagaataagaaaagtgattaatgttaggagcgtttctctaattaaaataatatgcatatttatgggtgattgacttggaccagtgttcacagccactataaattcttctgtgctgaacacttgttctttataccaataagcaaattaataagagtaatttgttcaatggcagcatcatcatcatcaacagcaaaagtggtttctctagtgttaatagtagtagggagcatgatgatgaatattgtggaagcaaacacttggtgcgtggcaaggagcaacgctggctacggagcactgaagtcagggttagactttgcatgctcacatggagctgactgcagagcaattcaacccggtggcagttgcttcaatccgaacaccattcaaaaccatgcttcttatgcctttgactgttactatcagagaaatggcaaaaaccctggtgcatgtaattttggtggtgcagccaccattgccgtttctgatcccagtatgtacatatcttctcttttctctcttatttatgtgtgaaaatcattgattaaccatatgttgtttctttctgctttgttttcatgtgtttaggctttggacgttgtgtgtacccaccttcttcaaggtatatatatatatatatatatatatatatatatatatatatatatatatatatatatatggcctattttctttcttttcttgtaatgttgttttttaaattggtcaaaccgtttaattctgctcctcggtcttggattaaatgaattttccttctcaaatttatgtagtttttcctgctatctcttgtcactcattttatttatgaatgatgacaaagattttcttccttttaattttcagcactgatggaggagttgatacaacactcacggggcttccaatgaacagcaagatattacaagaccagaccaacaaggaggattgaatactgcccaagctaatctcaataacaacagagaaattatcaacctgttattttatgatacaaaaatttttattaagagaatttatataaataaataaagatgtatttatttatactttgtttcggtttattttaataagttcattagtataatatatacatatatatatatatagtttatgaaactaacttataacttacatgaaaataatttaacttagtttcccctttcgattataaagacaacttagtaacatgcatgaatgcttgcatgagaaacacgtactaattaggtgcttaattaacaagtcatatattttaaaactaaaacaatttgttataattatgacttaaacaaaatgcaacttctgcttttttttttttttataaaatatctaaataataaatcacttttttcatacattcttagaaaacttaaataagagaatccataatctaattcaaaatttattcaagtcatttatgcttccaagtgggatccaagttcactatgatggaagaatgtggtaaaggaaccggaaaaaaaaaaggcaattgtgcagatttttcgccgaaggatagggggtcaacaagaaactccacaagtaaaatgtccgaggcgactaggtacctctataattattcagttaacttgttgaacattaaatgttcagaatgtattttatatatttttattaagtaactgttaatgacatttacatttagttcactcaataataaatgtcaaagaatacattattaaagtttctctattaaaaaaaaatcaaagattgaccgtagctgacataagcattttaaagaattgaaaaggacagttatttataacttaacttttgtataaaaaaaaagtgagaaattcaattgcaattgtacaaaacaacaatgtccctttaaatttattaattttagttatttacaagcacgaactgaagtcaaaaataaggtaagcaaagttgtgaataacagaataagtagtatagttcataaataatttaatatactttattaaatattttaaattttataattaatactaaataattggtatatttataatataataaataatttgataggaagaattcaaccagaattaactttcaaagaaaaaatctgacaaataaaataaataaattttagttgagataattatcgtttgactttttttatcagtcaatattaattagtttttactaataaaaaaaaatcaaacatagaacgtcttctttctctgttcaacctttatataaggccttgattactgttgatttattttaagagaattgaagttaaattcaaaataaatacaaatagtagcacgacatgaatttataaactagaacaaatagcacagtcatgcatatattacacttcagtcaattgtcatacaaaatatatagtacaactgaggagttatactcgtaaattacgaacctgaagttcaggtctttataatagggaaactcatcgcttaatgaaataagtaatgtctcatcagtatcgaaagccgttgctgaaggcccaaatgaaaaaactgggtcgctaatataatttttttaaaatataaataatattaaaattaacagataaaaaaaatgaatacttaacacataaatttttgaaatacaaataatattaaaattaatggatagaaaaaatagatctctaatacacaaaaaatgaactcctaagacataaattttttgaaatacaaataatattaaaactaagggatggaaaaaatgacccctgatatatgaattttttgaaatacaaataatattaaaattaaggaatgaaaaaaattggtccctaatatacaaattttttaaaataaaaataatattaaaactaaaagatagaaaaaatggaccctaacatataaaatggactcctaacatagattttattttttaaaaaaataaattttatataaattatctgtgaaaaaacttttagaccctggccaggtgccctgttcaccctgtcagggccggccctgcaaacgttgcaaatatttctgttggaccatgaatagtacttttaatctaacaactttgggcctttagaaactactacatggcccatgaaaacatttaaaaattaaactcaaattcggattctcacatataaatgtccacggcaagctctttggtctagaatctaagtttttacacaccatctagaaaagaggaatgccttaagtttttaaatactcactttaaacaaattaggaattaatttaaataacttatattcttccacctaagatattaggattagaatataattgtgaattggaaataaattacatgaactggattgtttaaaattattatattgaaaaagggaaaaaatcaagttcaactttgattattcaaatcatcaatttcacaacaatattgtgattatttttttaactattatccaatacaattaattggtaaataattttgccaatccttagtttctaagttctaattgtccgaatatacattaattctttgcgagataatttggatgtaaaaagtcatattactatttcgaaacttgattttatttaatcacacaaaaaaatctgagcctgataacataattttgatatattgttgagcaagccaaaaatttaattttacaaactcataatattagacactaaacagaataaacttttaccaattttaataactaatttaatcatttatttgaatagcaattgtcaagattaacagttctagggctagaccatatagttgttattcaccccattgctttaacgattacttttacaagctttagttctcataatcaaacgagtctttcatttaacacatcaaataaaagtagacaaactagtatcaccccgttgctttaaccattactgatgaactgtcgtggcttggatattttatggacccaccaatcttttgtgataatattatagtcacctaaattaatatgcaaacccaaatctttttcctattcaaacacatttcagtcaattactatcattttgtgcaaaaacatgttgctagcatttatttacaagatttacacattccacaccctcatcaattaaaaaatataaggttaattaggtggttgaaaaaaaaagtaaagagaaaaatatcacaatttaaacttctctattaacaataaatcaacgattaacatttatcgattaaaaaatatattctcaccaacctcacgtagatctctttcaagttcttagtcataatttctctaatgtccacgataaatgtcatttcaacctcctccatcttgtttatacatattgatggaatattaaaaaaaggaatcaattaaagggtgatgaattaccatcaaagtccaatcctttggacttttctatatgattatttaaaatccatcgaattattgtaagtatcaaatgatattcatttatcaatttattataaaatttataatttaggaggaaataaaagtaacaaatataaaataaaataaataacatgcactttattacaaaaaaaatgcactttaaatatattattttattctaacaatcacatataatcatgtaatgtaagaataagagtgttttttattgattgataatataaaaacttttatattgattgtgtatatttattaaactcaataaaataagtggaattacgaagaaaaatatataatatatagtgaaaataaagttatactaacatgtaattactaacaattatgcacgtgtttttttttccaatgtacttcctacgtgaatccatatctttatatcatgttttattaaattgaacgattattcaaacacccgctgcataaaaatatattaatgattagttttaattagttaatagtgtaatttttcttataatcacactccataaaattcaattcttactaaaaaagtttaattttcatacattattaatatcaatttattttacattgttagctaattaaaaataatggtagatataatttttaaaataattacgctaaaaataacaaaattattatccatgataagttgtgttttttttttttacaaaatagtatattttgcttttaaaattaataaagtggtatactttaaaaaaattgtatgtaatgtgtaagtcggctttctttcctttttgtgaaatcaatttatgatggtctttttttttcacttttcttgtggtttattaatgtcacctttttttcaggaaaaatcgtcaaaatttgttttcacaaaagcaaattcgactttcagaaatttaactgacaccttgtatgcaattatatatacatatatatatatatatacttttttgataattttaaaaataaaatatcataaaaatatgattaagtcacactggaaacttctgttacattaatgatgtatagactattttgtctaaaagaaaaacatgataaaaacatatttgtaaattaagtatttataaggtaagtatttataagggacaaacacggaagaaatattttaagaatcaaaagtcaaataaatttataaaaaaatacaaaacacagttatttttcagagggaaaacgtatttaattttttattattattgataatgtaaaagtattatactaaaaaaagatgtcttttaagacattaattaaagaattaaaaaatatttattgtataaattataaaaaaatgttaaaaaatcgacataatttttcagcttccatttttaaattttttttaactaatatccttaagttacttgttaccatttttgcctattcaaaaatatttattagggagaggatgggcgttatggtatttgtattttttctcaccaaaagaaaagaaaaggagagaccgtgggaattgtatttcagaagctagctagcaaacgaggtttgattttcatactgcgtgcacagtgcactgcagagagacattaacgttagaacatagaaacctgagatacactatcatgctctgataaaaagaaaaagagaaaccaaaaagaaagcgaaagcgccttctattcccatctcttccacactcactcagtcaccatatataatataattttctcttttttctctaaacacttccctctctctctctctctctctctctctccacctttaccaactaagcaaagcaaagcaaagcaaacaatcacacctagcactctccctaatataactttctccaatggcagcaccaaagccggttcctttactgttattaataaccataataacaatgggtctaagcaagaatgtgttgggtcaagcgagttggtgtgtggcgaggagtgacgctagcaactacgcacttcaaacggcgttggactatgcatgtggggctggtggggattgtcttcctcttcagccagatggactctgttttctccctaataccattcaggcacatgcttcttatgccttcaacagctactatcagcgcagggcaagagcccctggctcctgtgattttgctggcactgccaccattgccaccagtgatcccagtatcatatataacttttctcttcatttccatttttgtttttcagtggatcagtgtcatctcatttttatttatttttatttgttttggtgtttgtaggctatggatcttgtgtgtacccttcttctgcaaggtatggcctttttctgtatggttttactctgttactaatattatacttttattaaagaaatgctgatattattctctaaaatttgttgagtatctcaagtcttgtttaatatatcaagtttttcttattattttaactaacaataaaagtgtgacaaggaatgtgtttctaatacgcctattgatattaatattatatggtatgaagagttttattttattgagtgtggtgtgtagagttcagttacaattggtgaaagtgaaacctactgtgtttcttgatgatgaagtaaatggattctcattctcattatcagttttttttttttttttttacctttatttctctttggtacctttcttctgtctggtttatatggcgtccctaatacgatagagacgacaaggaacgccgatggagaggatggttgttttgtaagaggaaatgtttgtttgaatgtgagttgaatggtctgtgacgcgtgtcactgtgcatgggggtgggtaacgtaattttcctccttttctgttcaaactttcttttatctgctgcaattacccaaactattttacttatagttttttggtaacattggtttgaatttttcagaaataaaagatttaatcatagttaagtgtaaacaggcccttatttgtgtgcctctttcgatcaatcttacagatggcgtcgcatattttacatataaaattttgaaactaaaatcaatttagacatataatttataattaacatttcttacgctaccaagtttgtttggatgtgtgttgaaaatatgcttatacacccttttttgggcataaaatatgtgcgcgtatccttttattcggcatcaaatcgtataaaaacaaagtagcttccatatgaacatggatccaattgaatttcaacattggaaccaaacaggcaatttgtgttctctgtgtctgattcttggttcttcaaagttcaaattttcaaaatcttgggttgctcaattttggtccactgacactgtgtgctctctcccagagtgtgttggttacttttttctgcactttgtgattagaccgttggatgagtctgtgtggcccacttcatccaacggcttagattcaccttaaccgtaccttgctgatcttcacactcatgaatcatgaccatcatttgtacacattattagtgtatttgaataactcataaaaatcaatttactccataaaatcacggccagattatgaaaaagtagaaataactttttcttgcctttgatttaaaaattaaattgattatttttcattatcaatctaacccaaacaagtcttatgtgtgatactttttttttttttataacatggtaaaagtgattgtgggaatatctgatgcaagtcatgcaacggtgtagtgtagtaataattgatgcttacgtttatgtcagctgttatttctttaccattaataaataatctgtggaaaatgacatacctagcaccttcttcagatgttctttctcaatcctgaaattgacccatccatgatccaatccacatttccatagatatgagcattgttagttgcgcactttgcatcaatgggtgaaatattctcatccatcaattcatctacatttcaactttctttcatttgttcattcatctgattcttgtttctgaggcttttgtctttattgcaagttaatagcatccatttgcatgtgatggtgaggttggaaagaaaagctataattgaatttttacttcataagggatgtggtagtgcagttcatggagactcaattggaaaaaattgaatctttatttggtataattcagtgtagaaacaccaactttatgtcaaagagtaattggtacatatttaatcagcattcggtgtatttcacacatcgagacatatttgaatatagaaaactatgattgagattaatttacaaatactttttaatcacgtaaaattaagcccgtaaaaattttactcggtgttttgtaaaaagaaagacaaaaaagtagatacagggtacatagtaaacgggtttgacataactttttctttagtatcttattgaagataccgttttggtagtactgtagtagggtgacatatattacatgaaaggaatttttagatcgataaaagagtgctgaataatcaccataaatgtttatttgatttgcaaatgtacttaattaatgtgctaaaagagtgctgtacctagacatagcaataagggaaccatgcctgttgtacacaacaggggggggggggggggggggatcacataataaagacgctggttgtgatcaaatcattacttggaatgtgtttgacccctttagatttattatgactcagcatgtaagaaaattgctgatagagaccacggacaatgatggggccatactagtcgagttctaggcatattttgccctctcacgtgtcatgatgagcctttatgtgagtgcttttgatcagttgagggggatcacacccacatggttattacaatatactattacaacttttacttcagctccatggagagtgacgaattaagacttaagagatgcatcatgcaattgaagaagaacaagaaagaacattttataaaaaatacaagttattcagtgaaaggctagtttttgggaactgatttttgtgttaagccatgagaatgtttttcattgatcccttaaattatagttgtactttatggagtctaaaagttaacaatttgatttcgtatcatgttcagtgctgctggaggaccaaatacaccaaccacaacccctccaatgaacaacccaaatgtgccaacgtctaccacatcaccaatctttggtgggggcaacactggtggactaactcctggaatgagcactccattccctgacagttctagagcacattcagaagcaacagccacatggtttttagcttttttttcctctcttattatattcattatctcttagcctatgtaagatcttgggccaggcttacagttttgtcagaagttgaaaggctccctttggttgtttataaccttattttatgcaactacctcttgcaccgccactattttaatgtataaggttatgaacaagttaagcatggcaaacatggtttattcaggaaagagcagagctagattgtatcaaggcctttactatagggctcaaatttaattcaatagttcaatttaattgttctccttgcaaacattattatgttttacaaatagtgcaatatcgttagcttatataattttctttttgtgttttttcatgtcagttttttctttcgattgcattatccttttatagcacaatcatttgggagtgtgtttcttgttagcaaaaacattaaataaactattgctaacacatcttgatgagaacgtaaaagagaagcatgatataagataaaggatgatacaagacaagtattcaaggtgtgagaaagacatgctcttttgtatatttagactattacagttaattcaatgcttctgatttagaaattttagacatattttgattatttcctgaaaaaatttaatttctttattcaaagaaaaaaacaatatattttatttgaaattcttacaatttaagattctttagaattataaaaccctccaaatacaggatcaatgaatttatatacttcatgtaatctttacgaaattgaattcttattaatattaaatttaaatcatttattttattattagtataaaatattatgtaattataatacaaaatcgtcttaccactaattactaatgaaagaaaaattacaactttttaccattgatttttaagttctcacaaaaaatttaatacattacttttgtataatacatcaataaaaaattaattattttctaaactttcaaattagttgaatattaattgagcaagatgcataaagtcattataaattttttgatttcattttttcaaataaaaaaatatgtatgcttaaactttatgtaagttattgtataaattctgcttaaactgcttcggaaatcctaagcggtcacatgcatcattagatataagatgaagttatgaaacaaatttgtataaacctcattaacttatgagttatgacagccaagtaacaaatctctccatagataccttcgagcataagttaaggtaaataaataacagagtatctctttaataaacaaacggtagcactcagacttcgaaacaagaaactacaattatcgagcctctgattataacagttgcctcatctaaagaactccaaaaaagggattctttattgcagagtctagttcagatccagctgaattcaggaccgccatttcaactttgtccctaggcaaaaacaaaaactcaccaccatcgatcttctcaaacccacaaatttctagaaattcaatgccccctctcaaggaaccaactctgtcctgtaaaacacacccaacataaacacagacttaccataaatatatcgtatttaaatgatctagtggtaggttagtattgaaaacccaactttcgtttagacaagagaaagatggggccatatacctgaaaagattggttactaagacgtatcttcctgaacttttcctcatcgggatttctggcaacattccctacataagttagaagagtttggaatgctctcttcactctggcgtcatcctcctgctccaagaataagtgaacatgtaaataggctaaggtatcacaatatttaagcagaagatacttttaacaagcaatttttgagaagcattgatgtgaggtaagtaatcaaattcctttagcagaatgtaaaatgcagttaacattatcactactgtatataaaaaaatggcctcattttccagattgcatggcacgtggtatacagtatacttctctggccatccaaaataaaagcactagaaatcaaaaagaaaataattgaaatcatatcaagaagttgatgataagagaatataaatttggtccttcaaaaagataatgcaaccaaattgacccctttgagaagcataaaggtaatatatgaagctaaaagaagtttcttaaagaagcataaaaataataaaattcttttcttggcttctgaaaaaaacgtaatattctttcaaaagccaaggtaggccagttgtccctcatgaacacaaaaaggttatgcaattgcacttgcagtaagaacctaaatagaaagattcaaggggcaaaacttttttggatgtaaagctatctgcataatttgtaataaaatatattatttagcatcaactgattgaggttgctatggtacctcttatgctattaccattagatgttcaattgataccggttcattaactatcgaatagttattaatactgtcgactaaacaggtcccggagttccccaagaatgtaccttgtggttctgcttgagagaacggaggcactccctcatttgctcagcttttgtggcaggcctaacaggcacaaaactctgcaagcacaaatttcaaataagcatgcatgtagctggggaaaaaaaatgaaaccattatttttggccaagctcatacctttttctcctccacaacaggtgcaggtgaaggtttggctgctgagagttcctctggaggcaatccaagtctccgccttctttctgcctgtcataatagagaaacaaattgacttcattcaaatctcccaataaaagatattcaattttccattccatcttttgaaagaaaagactcatcgtactcctcaagtcttcctaaaaacttgggactaaagtcctctaaagctactgtagccataaaagtagtagtagcaggctccaaaaattgtttttctttgccaaaaaaattgttcaaaatgcatatttaatttgatcagcaatgacactaagtagactgtcattttctaaatgggttcttctggtataacatatatggaaatatgcattgcggaaactttcattgagcacaaaacattttgttctgcacttgatattccgagttagtgcagtgcccaaatcattaatttcttccattaaaacaataaaattggcaaaacagaaattagccttttcacaaaacttctttgaagtataattcattcatatgcagattgcagaacacaagatttgtgggttggaggataattctaccattttgatctaacctataattcaaataagctaatgccaagcggaatgcagttccaaaatgaaaccaatattgtcaaccaattcaaaacaatataaatctatcagatctaaatatattttatcccaaagtacggtcttttattcattttagacaaccatgcatagcaaatggtggcttatctttcaatatctttattaaatacacaacctgaattaatgtcccacacttctatgtattgtgatcttttaccagagactgagagaataagttaaacaactatgttttcaaagtaaatgatcttgatggaaaatgaaaacaaatctcaaaaagtattatcagtatccaactacagccagatggcaaaaaaataggatttaatgcacataaggtatttggtgttcatattataattctaaatagaggtcagggacacagatttaagtatttggcgttcatattctaattctaaatagaggtcagggacacagatttaagcatttggcattcatattctaattataattctaattaaaaaccacttatatgatctgactcttgagtcagataagaacaggctcgataaaagaacaagacagagcaaaatggttaagaaatgttggaaccttgtcttcttccaacttttgtttgattttctccctagcccttttctcttcctctttctctgcttttctcaaggccaacaacctgcaagaggaagcaaatttttcttgtagctgagtgcattcaaaacaaaacacaagatgtgtgacaacaaatttactagcttagcccgaccgtttcctctcattctcttcttcaatccgctttgcttccagcaactccttgccaatgcgaattctctcctgcattaaatacatgacagataagaaaatgaagatccaaagtaattaacaaatatggacaaaagtatcaagaaatactatattacaatgttataaactggtccgacctaagaacatatatacaacaaaaattaacccatgaatttttcaagataactaaagagatattgctactttggaacacagtacagatacatggcagcttgaatatcataaaatgaaaaaacacacacaaatcagagtaactagactgtataagagcagaaaaattagtctaaaagatgtccaacattttaagccaataaccaattaaagatgacctgatttatatgtgaagcttttttccctcttttagcatatcttttgtgaagtcttgagattcttcaaacaaattacataggctttaagcattggctcttctatttctgatattgagttcaattaatttcaatagtttaatttcacaataacctttggagatacttaaaggttattgtgaaatcaactctaatgatttgtcttttactagataataaccagggtgacaaaaccaatgaattcatgaaaccttcatggacacacaaatgggcaagaccacaagagagagagagagagttcttaaacaatgcaggagtaatgagttaaaattggactttgaatgattcgcccacgaattaggttgtgatgaaattcttggtctgagtcaaggagatgtgaaaatagctaataggaaaagattaatatgaattgaggggaatgcaaactagattcactaaaactgctttgaatagttgtgttacaacttaaaaaacgcaggcattatacatctataataagactatggagcatggacctgtttggactttggattacacttctaccaaccccaactggtgttgggcatcttccaaaagtatcttattttctgtgcctgggcacattttatcttttccaaaatctaaaacaaaggggtcataaaactactaccaaaaccctcaaaccaccttagatacaatttacaaaacaagaaaacaataaaacttcccaaaatactattaacagcctagaattatttttttttacatttactaacgtgaacttcaattcaagaatatactaatacacagatgactgagatgaggtaatctattacttttaatcaacctaaactttaccatgttacaggaacaacaattcatttacaatatagactttgatataattaaaaacaataattgacaaacaaaaaaaattattgatttttgaagcaatactacatcatgtgctgaggaccaactctcccaaaagcttaagctattaagtggaggctcataaatgattttatatctctaacatgcccctcagaagagtcatttgggcttgcaatgtcactaacaagctcactctatcttgctctgaaattcaacctttgaccaggtgaggcaaagcaacaagtatggaacccttccataatggattttaaatacatgtgtatatcagtaatgaaagtcacaagaaataagtgagaatcaaatggatgaatctgcaatataccttttctctttctctctccattctcttctcttcctcttctttcttcttacgagctctctcccttgagattatagtttaaaaaatcaatgattacatagactacaaatataccagtaataataaatcggcttaaaagtaagcacacgtaaactatagttctggacacatgtaggcatgtattaaactacaaattttcaaaaacttcatatgacaatatcaactgagcaaaagttcagaaggccagaacacaatgcattgacacgaatttggctaacattaatactgttatatattaatggcatgtacataacttgcacacaatgatagaggacaaagaaatatgcagacacatttctaatctctaacagttaacaacttcaagacttataaatcagggtgcaatacccaatgatattaatattaggtgttcacttaatcagcctatggtactgacaaaaataccagaatgcatcaactgtttcctttagaggtcaggtgaaagcagaatagggattaccctaggtcatcatcatacattacttctatcaaatgaatcaatacatatctaaaattattctctagaactttgtccataacaatattaaaactctaaaatagcttcataacttcgccctttagtatgaatgttatctgaattcagttttataccttagttcctgctgtttggccttcaattcttctggggtaagcgaaggtttaggagcctcaattttggtgttggcaggtacctgagtgaatcattaatcagcaggttagaaactagagtgtgacttaattacactgaatgcattttaagatttgttcataatatgaactagtcttatttttgttgaagtttgcaacatcagatctattactcatgaagtaataagcagttaagcacataatgacaataagtgatattaaaatataaatattgtaccaagggcatctgatctatgtcaggatcattctcatgctctactatccaatttacggcagactcaaggccagcattacctgtagaagggagaaccaggtttaatatctagagactcaataattatcaatgtccagatataaataacattaatggtgtattgaaaataccctttaaattgactactcatgtatcctagatccaaagactgtcatccgtaaataaggaaactaagatttacgtctaataagttttaaatcaaatttgccatcatatataaatattataaactttgaataaacaagtccctttcctggctatattgtactcacttctctctgttaacccaccctaatttccaacaatatcataaagtttccttcaaaaaagcaaaaatagatgctctgtgatacaataatgattaatggatacaaatatcaatatttttttaaaaaaatacgccaaaaatatttcatgaacgtccaagaatgtcctgtgacaaaaagcactattagaacaaatggtaattacttaggtataaatgaaacagctaacatactccataaatgtcccatgaagcattaataactacagttctctattccacgaactatccaataaaaataaaaacgtaattttcaagacagaacaatgttgttaaatggcacagccatggtcaccatggcagattggcaaccgctataagcaacttgtaaagggaggcctgcttttcggcgccatgggcgtgtttatatggtaggatttggccttttgccattgataacacttggacagacagaaaaagtaaaaaaaaaacaataacaatcaagccttatcacactaggtgggatcagctccacgatcaatcaacacactagacctaggctctattgcaaatcatattttcaataaaacacttcagggcaaggtaaactaaattggttcttcctctatttcttttacttggaccatcctccgtttgatccacttaaactacacaagcctctattggtcttctcacattttttttatcagcaaagataatattatatatatatatatatatatatatatatatatataataaagatgagtacaagtagtactgagaaagaaaaacacccccagggagcctaccagaactttggcaacctaatacatggtaacagcccgaattaaggtgccaaaggtcaacctaatagtaagctcacctgaagggtctcacatgagacagcaaaaaacaagtaagaagaaaaaaaatgcagaaataagagaatatctctatcttgaacccgtaaagaacactacacaactatggtcaataacaaaagaataggactgcatgtaaattcaccagagtaatgaagcgcccgtgttgcccgtgctgttgaaaaccccatggattcaagttcctcgagcagcttcttgtccacttcgggaacaaccatttctgcagtttacaacataaatcacaatcaggcaaaaatacaaaataaaactacatcaccattaaccactgagcttataaaccattttaggtttaattattcgtttggtccctatacctacacaatctttccgttttagttcttacacctaaaactactaccagttttaatccttatgcatacactttttaatcagttttagttcctggcatccaaagatcgtagggattaaaacagattaaaaaatgtatatgtaagaactaataagagttaaaaagtgtatgtattggaactaaaacgaataattcgaggtatagagactaaactgcaaagattatgcaggtatgataaccaaacgagtaattacgtccttattttatagattaacaatcatagattaggaatattaaattttaattaactaaacttaaaaacaaaaattaccttcactttggtcagtggatgcagcagcggaagggttttccgacgaagcagttgcatccaccttcggagcctccaaactaatcggtttgacggcctcggaagtcttgtcaacgaactcggtgtggccggttcttttcgtgtgcaaatcactctcctatgttcgtgatccaaccaacagtaacatattcagttaataataataatatattaataaaaggaaattgcggtattgaaccctaaaatgagaatcgggaaatgttgatcggagagagtgggactgacggttttggatcggcagggtttggagcaaacggagcagacgaggttgagaaccggttcggtggattcggagaagttggagtgggaagtgagttcggcgtgctcttgcgcttcttctacggttctcaacagagcaccgcagtcaccgcacttgagagaaacgcctgccattgattctgatgcagcaaacgcagtgcaagtaacaaatttcaacaattggatttatattttgaccaatcagcagcacctacgacgactgcttgcccttgctttctcaggagtaaagtggagatgcaacaacaccgctaacaaattattattaatttatcattattattcgtcctaaaaaattattttagacgttaaaaaatttcaaatatatattttattttcaaaatttatatatctttctaacaataatatcaactgaacgatttaatttaatttcttatctattttaatttattattttttaaatctttaattctaactttattttgaatatttcttaaaagaaattattaatgattaataataacaatatgtcagaatataaattatttataataaatttaaaatataatttatatgttaaaaaatatttattttttataaattttatttataatatgatttaaatattataaattataattttaaattataaaaatatttatcatgtgcaaggctaaaatactggttattctaatttataaagagaaaattgatgtatttatcgtctacttttccttcttaaattacccttgtgattactaacattatttcacaatttagtaacttagtttttttaatttgttcctacagttttaatatatatatatatatatatatagtttttttaatctgttcctactgttttaatatatatatatatatatatattaattttggttcacctattaacccatccaatatttaatggaaacatgctaaaatgttttcttactagtaggaaaacatgaaaagaaaaagaaaagagaagtcaaattctcaccatggagatgtctgctacatcgattaagcatgtgtatgagttagggacaaaattctcaattttgcaaaggcaaaaaagatgatgatttgtcaagctagtccgcatatgagttgcttgctcgataaatatgttggaataaaagctaccgatcatatgaaatgtactcctcaatttcgcatatgaaaatctcgttgcagatgaaaataaataccatccttgagaaagagctcaaatgaagttttttttaatctatacacacttatttcaccacatatttaatctttgagaaagacaatcaaaaccctcatcaccacttatttcaccattctgaaaacctctcttaacttccttaatgagtttctctcaggcccaagcctttatttttggggaaaaaatcctaacacagcagttagataaactttgagcttaattaaaggtcttcaagaagtgattataacaatatcttttctaaattttcatggaatgaatttagtggatgtgattttattaagggttattgataagaaaatgttggaatttttgtgcaacccaattgttgtttttcatttagttatttattgaggaatgcaatttcctctaaagtgtatttgaataaagaattttaagtgaggaaagtaatttattagaaaatttaaaatattttaatctaaaattcattgtttttatgtttttatatgaaaaattgaaatttttgaaattttaaaacataattttaaataactaaaaatgtagaattttaattttcttctaaaacatgagaaattgaaattatcttttgtcgctgacgtccccagcgccaccgaaaggacctgacgttgctgcagcgggacaccaacttggcagtgccacttactctcccccattgacggcagtgacggcgcaacatgtgatcccgttctcagatggtccactacaccagcggacgcgtgtacgcgcttatatggtcaccacgaggagtcagtgcagtggtagatcctccatgacatggatgatccaaatgtgatgaagtgccacgaaatatactatcagaatagcgaaatccaagtgttgctggagttcatggacgaaaggtcgttggaggggaaacacttcctgcaagagcaacagttagcagatttgtcttagcaagattctgcagggactgatatacctgcatcgacagcacattgtgcctagggacatcaagcccttgaatctactgataaactcacagaagcatgtgaagatcgctgacttcgaagtgggtcgaattctgaattagacgaaattttgaaaatgaaaaaatttaatttctttatccaaacactaaattttgaaaatgaaaaaaattcaattgaagcatttgaaattcttagaattaaaaattctttagaattttaaattgtctcatccaaacatactcctaaggttttcataagaattttcaggattttaaggtgaacttttttgtgtgttgaaatccaattcttcattgtttttcttgatgagaattttagcatgataagatttgagaatctaattgataattactaaaaattatgtatttttgttattttaagggtcagtcattaccttttgagaaaaaatgataaatatatattaaattcttggaattaaatgaaggatattaccattcaggatgaaatatttatgacttaaatgtgtttttagtccttcaaagttaagtcattttttaatcgttcaaattcaaagttgatttttttagtccttgaaatccataaaatgttatttttagtcattttgtatagcacgagcctaacatagaataagaaaaatgcaatttgtgacaacttttgacaccaaaatttgattttgttttgtattttaaagtatacttttggtggttaaaaactgccataatcaagttagtaaaaaaatataaattgcttgaaatttttttattaacttgattttgaccatgccaaatcatgtcaaaaattgtgagtctcttattttctgtttggtttacattttacacaaggacaaaaataatattttgtgtattctaggactaaaaaagtaacttcaaatttggcgaattaaaaagaaaatgactcacattcgagtgactaaaaaacatatttatgccaatatatctgaatgagatgagttacctccattttggatggaaaaagttattggatgttgttggatataggctaatgtaccttagtataattgggtttcacaatgagtttagatgtgtgaatttggatgtctctcattgctttaagtgtgaacctgcacaagttaaatttggtagcgaccttaggtagttaattacaagaaataaaacttttaaaaaagatttgcaatctcttgtgaactaatagagttgtactttattgactgatagtataattttattgaagaaagggatcattgttcctaaggaggaaaatgttggggaaattttctagaagaaactcataagaggaaattcatcatacactcaggggtcatcgagagatattaagatttgaagaggatgtattagtgaccatcaataaaagaaaatactattatataattattattttttcttttatcttatttcttttttttttcttttaatttatctgtatttattattaggttcatctatcacttatcccaattaacttaggttaaagtagttgttgatattgatgttgttgataattaactttgtatctaggtgtctagtattcacgaaggataagcactagctcttcttcatgcgataaagtgggcttaggaactgcatttcaataaagtggttatcgaaatagattggcaacaatagtcttaagtatcagttgtcagaagatgaagttgaatgagtttgataacatcatcaatatttgcaaaacattgctaagttctaaactagactacaaagtttattttattcaaaagcaagctaatccagtgactccagttgtctagggcatctagagattttgctggccttcaagtgtatcatacttatcctatttgtatggtactttttgtcaaaatgatgttgacatcgttatcattgaaataatggtgattttatttacaaatagtaacagttaaaaatcgccgctatatatttttcttatttacaatataaacatgaaaatatttcgaaacgagcaacacaccaccgcacaccccaatcactacgacccatcgccgccaccccaattgccactaaccaccaacctccaatataacgtgaatttgtccccacaaccgcaaactaccttgcacgacccacaaccactaccagcatacacaaagccaccaaccagccatacactaagtgaagaagtgcaatggagcatgacaccaagaggcttgatatgcaccataaaaatcacaagatttggcagtggttgtggtcggggttgagatctggctgcacctcgtaccatcgatggtgatcgcacacaaatggagtgacatttctgtagtttgcaactgaggggaagaacattgtagagtgtggacggaggagggaggagctaagtgctgatattttttctgtggtttttttttttttaaaatatagtgataatttttaatcgtcactattggtaaataaaatcatcgaattttaacgacatcaatttgatggaaataatgaaattgatatatttttaagaatttgaggatctaattagaacttaaatttttttggaaattaaattaaataatttggaaaccaaaacctttttgtaaaagaaagtatgttaagaacaatatatttaagagtataatgctgaattttttcataatcactttccctaccgttgcatagaatccatttcctcacttttgtgatactagaaaaatccaaatacgcgagggaccaaatgtacaaaggcaaaaaaagtaccgcgcatgtttcccacgtgtccactatttcgcgggcataataaaaaaagcctaacttttgcaacattcattatcgaggaccaagacgcgattttccttctctgccgtcattttcccaagaaaatcagaagaggggtcgatgatgaggttgagacgctgatcactcactcactcgaagacgatggtgagttcgatccgcgatggaaccaagccagattctgtcattgcggaccaccacaactgatcctgatcatgtgaaggtcattcagtgggacgacttccagcacgatcttgcaaggttggcgagtctctcttccgccctccacgaagccaacgagaggaaacggaatcttcagcacaagctcgattccctaattcaggtagggttttagttttagttttggttttaggtttagccattgcaaaatgccgaaactgggtttatgatgacgatgttatcctgcgtttcttgagttacggaaattgtgtttgcgcttttgacgagtttactgtaatgaatgaaaagttaaatggaaatgaagttggaatttagtggctggagggaaagcgcgtttggtctcgtggaaaatgcgagcttgagtggggaatcgtatcgcgttctgtgtttgattacgaaaattcttggcggaaggaaatagaattggggaagggagacgaatataattgcatttatttattttgtttattactaattactcgttgcctgtttgcgaaatagggttcaccttataagcggatacatcgatttatgcctatgctgttttattacgattttgttttcggattgtggtttttaagttggtgagcaagagacttcaaatctcgatcactgtttagtgggttgaagtttattatggttggactggatgatctcttctctctctctctctctttgttcttggtaatagtaagcgtatgtttggaaatccgttggtggggtgctgtgcttaagttggtggaaggaaccccttcatatcttttgggttgaagtgtttgaaatttgtttccaaacgtactggaagttaagggggagggaatgtatgtgtttggttctggttattttggaaaaaaataatctccctatgtcagcttccgtagagaacttttgaaaaaaaagctattattttcttggaaaaatttggaaccaaacatgtgtgtaactccaaggccaaggcacgctaaaggtcttgatgatgattcaaggtgattttcatgcttgtgtgtatgtttggggcagggggggataggagattgacctaagccttaccatggactgtggtgttcaggttttgggctgtggtgtttgagttcgttgctggggggctttaatgtccatcactgtgtaatgggaaatgatgggattgatttttgttgtatttatcataaattaaaagcaaactatttattttctttttgtattacttgtggcccatttgggctctccttataagcctattcaatatattaaccaacctagaaacctcttggaaaggaaacaccagcaaaatctgcctttaaggcattaccagggaagtcagaaatacatgataagttggtttttgattgtggtatttgagtttataatggttggactggctgatctctcatttctcttttctgtatatggtaatagaaagcttggggggggggggggggtggtaattgtaggtgtttggcaccacttattttggaaaaataatctgttttttgccagcttctgtaaagaacttttgataacaaagtgattattttctcagaaaaaatgggatccaaatgtgtgttaattccactgccaaggcatgctaaagtccttaatgatggtttatagtgatttttgctcgcaggtgtgtttagggtagaggggattgtggttattttttggttttggacagtggtgtttgagttcattgctgagaagctttaagtccatcactatctaatcggaaattgggggattgagttcgttgcgttatatcataaattagaagcaaattgtttattttcttatttattagtggctcattttccatttagggtttaagcagatccttcggttcacaactaggctattttattacttttttggttttggattgtaatgtttaagttggtagctgagaggggcttcaaattcaatcattttacacatcctactattttccatgatactacggatttattagcaaagaggcggagaaatagattaattattccatttcaattccaatcgattcaagaacgagacaaagagctaatgttagcttccagtaggagggttgaggtttattatgattggactggatgatctttcatctctctttttgttcttggtaatagaaagttaaggaggaagaaaatgtacatgtttgttcagcttgttttggaaaaatagtctcttttttgccggcttccataaagaacttttgattacagtgcggttattttctctggaaaaattgggaccaaatgtgtataattccaagggcaacacattttttttatttatttatttgggggtgggggcagggattgaacctaagccttacaatggactgtgatctgttggttttgggtagtggtgtttgagttcattagcgagagacttggaagcacacatcactatctaatagggctgaggtgtattgtggttggaccagttgatctctaatttttcattgttttgggtaacaaaaaaaaagttaagttgggggagggtatgggccggggtacctcacttctttttgttttctttttttttttttgggggggggggggggtggacctaagccttacaaacgtggctttgatccttattaactaaatcaatctttgttggcttcatttctttgtcaataattagttaatatggatctacaatacacttgtttctgttggtaattatgcttttaaattttaccttttggccttgtcagtttttttttgaaagccttgtcagtggtaactggaaaggtctgtggacagagattggagagtcatgttaagatgacgtgtgttttcagtctgtttctttacctttgattacttatgaacacattatctctgactaggcactttcttttgtcctagtataaatatttattacttaatcttcctctttatcagaataaggagaaagaactacataactttgattataaattatagtatgaggcatatttacctttttttggagaggatttaagagaaataattttctgatgatcaaacatatgattttacactgatcatttcatgttttaaattttatcagtgggtctgagtaggtgtacaatcattagtgtgccatgaattttttctgttgcatatcttggatcttaactggttaatgtgtccaatatgagtagatccatgatatctgaacaaagggaaatgcttgattcccaaattccaactcagaatagcctgcaaagcgtaatagtcagtcacgctatagtggtgtcgtggaatgtcatgtctatggcctgctccaaggaagcctgtcatgtcgcaactcaccgttgtgcctggagtggcatgaattccggttgtcattgcatcaaagacgaaaccccctttttgcccccttgaacaatgtcatttggtgctgtttatgaggggcaatcttgggatttttccccctccccctcttatatttgatcagaacacaaactatttcccactttcactcctttctaaggttaaataacacattactctcattaatctcttctctcttcaacgcaaaccatcttacactgagctctcaactgcattgctggccaaaccgtagcactctggagtttccagccaacccacaacctgtggaactctggcacaccattctgtggtttctacttggttcacatcctttgcaatctgttctgttcacatcaaagggggtggtctcttctctcttcgttgtaaaccatctgaccgaaagctctcaactgcgtttccagccaactaacaatctgtggaactctcattctgtgggtatatttttttagcgcgcgtgcacatacttgcacattgttttaatttataattatatcaataaattttgtaatagtagtcatcccactatctgctatcttgctgtggccgttttggggttggttgctctgtgccgttatcccagattgataaccatgctgctaagattttattttagcacaccaattcagtcttgtcagggtattgagtggtttagtttttgtttacaccttgggatgcttttttgcactaattgtttccaatatataggtgcatggttggttttttgtttttttactggtccctaattaatgagcccgcctaacaggtcaatgctgaatcattgggttggttgaatgaacttgaggagatgcgtcaaaaattggaatcaaagaaaatggtgatggagaatatgtctatacgttctaggctggcaaaggaggaagctagcaagcaggaggagcagcttagtggtgcagtgcaatcacttttggtggcagggggtactctttctgtaaccagcagaaatctccaggtgagtttatgtcatattgtagttgaattttcatataatatcttttctttcctggaaataattattaaatgtaaaaagttcagtagttctagggggaatgcattgttttttttgaccagcaaaaataatatgtatatatatatgaaaaagtttctgcattacaagaggtattgcaaaaagaacctagtgttcaacagaacgaaggaggtttaaaccatgaaggcatggaaaagacctcctgagttctgacctataactaggataacaaaaaatacagcttaaaactaccctcccctgataacaaaagcctctcccatattagaggaccagaagtggaaagggaaagtaaagccatcctccaaatgtttaagccaagaccaacataaaaaaagcgcatcctccatcagattttgactgttgaacgtcgcagcatggaagataatcctattcctatgacgccatatagtccaggtcaatgcaacccaccaggtctgccatctcatcgatctaattccaatattcccataggaggagtgttgggtgaagtgctctataggggttgctgacgatacacttacgacctttatccacgacaagcattcccaccagagaggtatgatcctactgcagctgaagaataagtgggatacgtcctcctcactatttctacaaaaggggcaggtgttatcaataatttccatattccttctacacaggttcatcttagaaggtaacctatccttgcacaatctccatacaaagcatagtgccttattaggaacttttaatttccataacaccttgaagaaactctcatgaggcaaactattcagttctctgtcgatgtagtggtaggcacttcccactgtataacttccactcaaatcagccgcccatctccaagtgtcttgttgctgtaagtgtattaccacatgttgaatgtccttcatgaaatttacagcagcagcaacttccccctccatgaaatgtcttctccagctgagctcccattcccatccgtcttgagtcattttgcccatctgatgaatgaaaaattgttgttgattagaaagctggtacaatcttgggtacctttccatcagggtgattccatcatttttccatccgtcctcccaaaataaaatcctgtttccacttcccaccttccagctaatcccacttctaatccagtgcctctcatcattattacacaatgagctgagatccctccaccaaatggactctttaccattccttgtaatttcagtcaagcttctccatcccccatattttgattgtaacacttgtgcccatagtagctgtggctggtgaaaaagattccagaaccatttaccaagtaagggcttgattaaatttggttaaatctttaatgcccagccccccatgctcctttgattggcagatcagcccccatctaacccaggcaatcttcctttgctcatcagttccaccccacaaaaaccttttctgaatcctctcaatgcaagctatgaccttcttaggcgccctgaaaaaaggcaaaaggaaaataggaatcgagtttaacgtagactttatcaaggtcacccttcccccaaaagagaaatatttctgtttccatctagctaattttcgctcgtattttttaatcaagggttcccacgtctcaagacgtcttgggttggctccaataggaattccaaggtatgaaaaagggaaaaccagccttctacagttcagatatgttgcagcttgagttatccactgatcatccctaccaaaaaccccaaatctgctctttgcgaaattaatcttcagccccgataccatctcgaaggtcctcaacatcaccttaatggccttcacatttttggttgatgcagtaccaaaaaacaaggtatcatcagcatactgcaacaggctgatatcaactccgtttctccccaccttatagccatcaaacaggttttttgcctgtgcctctctcatcaatccagtcaagccctctgccacaatattaaacagtagtggggcaagtgggtcaccttgtctaaggcccttttgaggtgtgaattctgcagaggggcttccatttaccagcactgatatggaagcagattttaaacacccctcgatccacataatccacctaggacagaaacccatcctcttcatcatatatgacaggaatgtccaactaactgagtcatatgccttttcaaaatccaccttgaacacaagacagcttctatttgatctttttgcctcatctactacctcattagctatgagaacactatgcagcagctgtctcccttgaataaaagctgattgtcgttggtcaataatagatggcatcacctttttcagccttgcagctaacaccttggccacaaccttatagacacagcccactagtgaaataggtctgaaaacatttaggccctgtggatcatgtgtcttgggaattaaagttataaaagatgcattaccacccttagggattgtaccatttacatagaattcatccatgaaacggagaaaatcggctttgatgatatcccaaaaagctttaataaacttgaaattaaagccatccggcccaggactcttttcgttaccacactcccacacagctttcctgacttccattgcatcaaatcttgccaccaaactgtccaagttgtgttgttcaatggcactgaagttagtgccatctaaattaggtctgtttagaatgggctcctcaaatttcttcttgcagaacatcctaacttcttctttgactctgtgaggctcatcagtccagctcccgtcagccaccaagcctctgatcatgttactattgcgcttccaatttacagtcatgtgaaagtaagtagagttgcagtcccccaccttgatccacttggatcttgctttctgcctcaagattgaggcatttgtctgagcagcggtccataattcctcctgtaactgttttcgcctcagcacctcatcttcagtaaaatgcctgtcatccccttcagtctccagcttgttaagttctgactgtagtgattcaatcttcagctgcatgtctccaaaatgtgttttgtgccagaccttaattttctgcttcatgttcttaagcttttcctttaaaacaaaaccaccccagccactgatctgctttgaattccacccttcctgcacaagcttcctgaatgtattatcctgaagccagcaatccaaaacccgaaatggttttgggccccaatcagccagcgatgacctcagtataataggacaatgatccgagaaattccgatctagaatgaactgagttgtatcctgccatttagcgatccattctgctgagaccatggctctgtccagcttgcttttggcagacccatttggcctttaccatgtaaagagtcgcccgatacaggggacatcatctacttccatatctgctatccattcattgaactctcttacagtgccttcatcttggtatctctgacatatccctactctctcttgtggtcttctgatgttcttaaagtcccctataatgcaccataaaccccccatatttgtatttctcagctgtcttagatcctcccataaccttcttttcatagataactcacaaggtgagtatatgttgacaattgtggctttgctgccatctgctacccatgtcccttccaaataaataaatccagcccctgaaatcttgttatccaacacaaatgcctccttgctccatatgcatagtaatccaccagccttattgattgctggaagatattcccaattgttatcggcatcaccccacaatgccatgcacaacttagcatcaattatatcttttttggtcacctcacaagggggaatgcattgttgtcttgattaaaaagattgattcattttattgatattgaagtatgtgttacaaattgacatttggagtattgttcttttttgcttttgactgattttattttcaattgaatagagtatatcttccttagctccacttgtacctgtccttcagaaatgaacttcttgttttatttcaaatttcctcattttttaaaagctttcttttctctattagtccatgtaagaaatggtatttgacgaatttatttagctgaatatatatatataagttatcattattccttgttttaggggaagggattattgtttgtattttactggtgttattctagtagctagaaagctgatgatgcttttattataggaatcaagtagatttctgtctgaagaaaatggttatgttcatctgataaaattgcaaaagatgctcaggaagaggcaacaatacatgacatctcaaatttcaatgctctatcctgttaagatcttggttggaccagcacaagagcaagagcttgaagcatatcctttaggcagcctggcaggtaatggttagctcaataatagtcttttttgtgtgtggatagtgcccctaaggtaaaaaaatggcttcggtcatgcaaaatacaaaacttacaatttaaataaggcttaaatatgtttttagtcctttaaatttgggtaattgtttttttagtccttaaaaaatgtttttattagttcctcaaattttcgaaaagctatttttagtccctctatttctttgcattaatggtgtcccaatttgtggcgatttctcatcactagaatttttttaatttaatttattggaaaaatgatttgtgccagtttaaaatcgctagaatatgtaaaaaagcgtcacaattcaacatccatgtttttatttttcttatttaaaataccaaaatatgtaaaaagcggccaacaatccatgagtcaaatattttggcgatttaaaatcgctagaaatggttttttaaaaaattaaattaaaaatatttattttggtggttaaaaactgccacatttgaaaccataaacacaatgaacaaagagggactgaaagtagctttttgaaaatttaagggactaataagtgtttttttgaaggactaaaaaaataattacccaaatatgaaggattaaaaacatatttaagcctttaaataaactaagaaacttgaggtactggatggttcaatcattatcccttaatttcttactggcaccttggatatagttcttctgtaagttgggctgttgtgttgaaaggatgtctttcattctgtacttcgtctgtctgatgtgtgtgcctcatatcttgttcttttctttcatgcttctgcactagttttgctgattgacaacggccttaaattataattttataatttagtttggtactgtagattttggtatggttgatcctttggatgctctagaagaccatagctattcattgaatgttaagtatagtttatcttctgctaatttaaattatcacaatttttttttgctaatattcactgcatttctaagggatatttttgctgaattttattgtaaaagtttcatttatttcattactcagggacttctgctggactaaaaccaattaatcaaggatccttaacaattcatggtctgcatttgaatgtgctatcttttaggaagatgagctttttcactgataaaaaggaaattcagaattctgctacagccctaggatatgttgcacatgtaagtattagaacctacccggcccttttttgcctcagaactgttcatgttattctttcttatgccttttgtgatccatttccaaaatatgtgatgtacagcttctaaattttcatatacatatttggtttaaatacctttttccatcctttactaatatagtggtttctaaattgtcatatacagatcatggtttaaatacatttttttttatgatctttatgatctttataatgtccaaaccttctgttttttggtcttccattacaaaaacactttcatgactaatgggaagagccaaaactaaaaggtttgaatgttaacaaattagaaacataaagttactgggattaaaaccgaaaactagtatatttgaagggacgaagaatgtatttgaagccttcatattttgacatgtcttgtatatggcaaacttaattgtcaatgctttttcgtatcatataccaaacttctgtgttccagctgcagcatttcttattgtagctcaagtggatgatcgttgagctaataattattgaaatgtcttccttttcgaaaatttatttatttattgaaatgttctttactagactgattttctcgcaggctgtttcacttatagcctcttacttgcaagttcctttgcgatatcctttacggttgggtgcttctcattcatatattattgataatgcaccttcaacagagctaacatcttctgaagcttcatcaaatgcaaacataaacgccaaacatgtggaattccctctttttttagaaggtcaagacaccacaagagcagcttatgctgttttcttactaaataaggtatatatttctatttatttttgctttgtagttactctcaatcgttgagtttacgtgctttgtttgaactaaggcaaaacataacaggggtagtcttatcttgttcattgtctccttcagaattcccaagaaaacaatttagtgcatttttttgctgacactttctgccccttatcatttatctaatttatttgtttggatcatggactttttatattcgttgatgactttatgcattaccatattttgcaagattgccggatctgtgttttgcttttgcatggttagagtttacttcccatttgtttcacgtaattagctttctggctatgatttttgtgttgctttttgtaagagaaagtattctactttttttgggactctactcaaaatttccaacatgttggttgattaagaaattattttggccttgcttgtgcttttctctgtaatgaaaagagactgaattggcagatttccattttactatgagaataaagcttactactgtatatgttagctaactggaagtgaggacgggtcctcctccagaattagtttttttttttttttttctattttttgttttcccaactctttgtttgaaatttgatttttcaaaagtgagcaattcacttaagagggcagagtaacaaatctcagttgtcaatgagaaaatcaagagtcaatatcgcatgcacatgcataaccaattggggatgtattggaatattgaccgttgcttttttatttatttatactcaacagctgagattacttactccagaggagccaaatgcctttgttcgtttcatggcatgaaagattagaagtttgttttttagttatgcttacatgagatgctttaattctaagaaacatctgtttaaaaactcatctcttgtttttcccccaaagatttcctcctaccaaaaaacaaaactatgattgttctgcagttgaatttccattgtcaagaaatcatcaccattaaaaatgcattacatacactgaaaaataaaataagttgcaccttacaacattttagaccatttgattttaactgcaggaccctgcagtttacaaacaactgtaggtgatcctgttcccaaaattgagtagcaagattaacatttactatattgacaggctgttggttttgcattggtgttggctggcaggttgtcttagacttttaattctatattatatctcaaatatggtctcccatacttgttagtgcctttgttttctgtcattaatttttttcttgaagtacataggcaacatgaacataaaataggggtaacagaaatgaggatgttaaggtggatgtgtggatatacaaagatggataagataagaaatgaagatatttggcgaaaggtagcaatagtactggtgagtgaaaagatgagggaatatagactgcggtggtttagacccataatgagacggcctctgaacaaaagtttgttatcaagaacttgacacaaagagaggtagaggtagaccgaaacttacatgagaaaaagtagttaaacaagacttaatggagtgagatataaattggcggacggtgtgtcttaggacgaaatgaggaaaaattataatcttggtggagggttagactcatcgttatctctatatttcagatggtccctttttagcctttttcctcttcatctctcccctctttctttcccccttcttttcttttatcgtattttcccttccgcttccacttttttttgaacctctttgtatctatcattggattcatctaccatcaattccaattaacttggattaaaggtattattgatgttgatgttgattttttttttgaagtgtggttgtttgaacgatatttgatatatattgtactgtgtacacattatccgtcctgattaaccttgacttacagctcctttccctcgtgcttttctgactgtaggatttagaacagcttttgaatttcgttgatgccaagagtttgggaccacgccatgtattggctaatttgagagagcttttaaggactatctagtcttcagctttaatagacaaattgatctagtagtattttttctctattgtaacttccttgtaaattgattttttttaaattcttgtccgggtgcaatttttttggtgcaccttccattgtagcattgtgatcaaaatggagtcaaactttctataatggatttggtattctttgaaaaaagagagtatacaccactgtcaaaaatatattctttgagaagaacataaatgtcatacattcctgcaagcatatcatgtataaggcaacttttggaggaatacataacattttgcgaaatcaaggatgaaatccctgttcggatgggaaacggtgatgtaaggatttatcgaattttgttgattttagtacgtgatgtgattagtttatttttcagtttcttcattgattgattttgtatatataatatttgtgtgtcaaaaggcttttctggaatgtgccgcacatagaaattgatttcctggaatctgcgcctttgttgtaaggtaccaactaataatgttttagggtgtgtttggacttctattgagaggatttaaaagtatctttgagagtataatttggagtcatgtttagttattctctaacaatatatttgagttaaattttttgcttggaaacttaattttggaaaaacaagactttaaatatttttgtaaatttactttgcaaacttaaagttgacccaaacttatgtttataaattttaattaaacatgcacttaaacaatccatctctctctagggtgctattcaaggtaaatcagaagataggagaaaggctgtcaatattttgtttcagttttcttaaaatttaaacataatggtaagtgaataataatgtaaaaatctaaaaattttcttcttactaaatttacacggtaatacttactatacttctaatttaaatagaaatccaaaatttgccgttttcttatactatttttgaattaaatgtcataattttttttacaatttcatattttttttacattgaagttgtaaaatattttacaattttgattttttttagttacgactttaaagtcataaaggagtttttttattgaagtcgtaaattaatttatgattttaattttttttaaatcgtaaataatttctattttaatatttaaagaattaatgtatattttatttttttagatttatttaatatttttatatttttatgattttatttaatattttttatatcgttttatttattttgtaaattaaaacttcaatttaaataaaaatattaaaacatattaaatatttgttaaacaaaaatattaaaatattttattgttaacattaaccaataatattcacttataatttatcaaataatattaattttttaaaaaatttaactaatttttacaattttcattaaataaattaataattttgtataataatattaattttattttataaattattttaatattaataataaaaaataatttaataataaaagtagttattaaaataaaaaataatctaatacataaatataaaataaacaatacaaatttttaatttacaaaaaagataataatccattataataataaagaatataaaatattaaattgaaaaaatatatttaataaaacaatataaaaaatagaaatattaccttatttaaaatataaaaaatgtattaaataaaataatatagaaaaaataagaaaatattaaataaaatcatataaaaatatagaaaatatattaaataaaataatattaaaaatattgaataaaatcatataaaaaaatatagaaaatattaaataaaattaaaaaagaaagcatacattaattcattaaataattaaaataaaaattatatataatttttttaacaattgaagtgattaatttatgacttcaataaaaaaaatattatcctttatgattttaatgtcataaaaaaaacttaaaccacattaaagtcgtaattaaaaaaattaaaatcataaaatattttatgacttcaatgtaaaaaaaatgatattataacaaatgttacgatttttaatttagaaattataatatatgctatgaattatccaaaaattgatgttagattaaaatttgtcccaaatggtaaaatttttttaaaattttcccttttggtactttggccaagaaattgagagagcttataattaatgagaggtcagtttcagcactacatttaatttagtaggcttgtagcttgttgcatcagaaatctaaagaaggaaagctatcatgctgtcataaagagaatcaatttcctcagcagcaatgtattgtcaccaccttatgaaaagcaagagcagtagtgaaattggatgtcaaacatcaatttaaaaatttacacaatagagtttcagtacatggagagaatctgaatcacctatttctgggaactaggagctttgaaaaattgcagcctttgctaaatagtactactatcttttgattattttcccaattcattttaaaattctgaaagagaaaaactgcttgaagaagttaataaatcaatttatcttaactaaatatcacttctctttctctccctctcccccctctacctttttttgaaagcctttttctcagcttcaaacttctctctcttttctatgatttcctttactccgctatttccaggtgagtttttttttttttttatgttttcatttttatttttgtgatttttccaatttttatgccaggttcatcgcttgattagctttttactcagttgaaatagtttgctgatagctcttttgaagagctcactatcgcgtatttatatgttcggattgcaatgtttagtgaataaatttgaagttctaccttgaaaatacatgctacttgttttctaatcatatgaataatcagttttttttttttgtgtgacttatttggtaattgaaactcagtactacttaaggaacctttatgtcattaacgagaaatttatttaggtagtccgcaagtatataatctcaaccaatctttatatggtagtagtaagtaccaagaattttcaattgataagaaaataattaataacatttaagaccaaaaaaatatatatgtcttataaaaattaatagggatcataataggtctcgagccctaataatttatcgtacttaacaccttttagaaaactgaaacaaacactacaacgtacaggcacaatcataaaaggtttcagctttcatttgaaaccaaaaagttcttgtgctcacttctctgtccttttggtgggtttattttttctctttattcctccgcacctttctcttcctttctgatccaagaataaaattaagaaaatgcatgtagccctcttcaacttagtatggttttggaggctttgtttcacattctgacagagaaacaatttttttttctacccatctcaatagtttttgtgcgattttaaatgctatttgggaatgagaccttagcttttggcctttatagttctaatataattaaaaaaaattgttttattcttcaatattgtgaaagaaactcatgattggtggaacttttttgttttccatttaggttggtgaaatcatacatctctcccctttgtgtgtgcagaagaagaatatggctaccaatggtccacttaagagaaaatctccatcagatgatgagcctgtcaatttaaaaatcaaacttcaggtgtatgcctgactctttccacaatattcctttgttttttcgtaataattttttagcagagtctgcacatatatacatacagtatgcaccaatcttctataagtatgtattggccagttgttgtagacctgtaatgtctataaagatattgattgtcatattgaacgaaagttatattcatgcatcaaatcattattacatgatattttttttatgacaaatgttatatgaaactgtgcgtaaaaccgttctgcctaaattttgtaagcctaattgtacttttagttttttttaggtatagcagtgcgattttaatcaccgaaatgtgattttactattttaatcctctcatttcaccaattggattttaaaggtagcacaaatatcaacaacaaatttttgttaatatatatgaaataatatatatatatatatatatatatatatgtgtgtgtgtgtgtgtgtgtgtgtgtgtgtggaggattaaagttgtacaaatgtgttactttagactcaattagcacaattggaacatgaagactaaaatcatgcaattgcaacacctgagattataaccgtacattgttatactgaaagacccaaaatggaatttgaatacaacatttgagttctcaccttaacttttcttcattgaaccataggatgggcgtaatttgttcttcaaggtgaaccgggatatgaagttaattaatgtattcaaagagttctgtgatcgacagaagttggattacgagaccctgaagttcatttatgacggttttaacattaaggggaaacatacagcaagaatggttagtttctttcataagaagtcacacaaagttcttagtgttcatattttctaatatctcataattgagaaatgttaataatgtaatggattttctaatgcactcttttacacacattctttatgttaatgtgtctttcttataaccaatagtaaaatgtgtggtagaatgtgttaaagagaatgatactagcactcctcatgatttcttctttatttagttgagattataattaatataaataagacataatgctttaggttttaatatataatatcatcacatagtaagtttttaatatatcacaatttctaataaaacatcattcaaagtattttttttcataagttcaacaaaaataggacattggcagaatagtatatatagatgatgcctaatgcataggaaatcagaaaggcacttacaatattctttaccttctttacgtctcatattgcactatatataatatgtgaaaatgatattaatatgcccttctaggaggctgtaatatacaatagagatagtaaataaccaaaaattgtcacaggtgatttgatatttaggtttcttactgaagatctggagtttaataaattcccgtcttaagaatggagttgcaagtaaaaatattattttattccaaaatagatcgatttgatggaagaaacacttgttgaatgtcaaataaaaatcctaaataccttttgattaaaaaagaaaaaaaattcagttttcttaaatgattagcgccatatatacgtactactgcagtttgaaatcatcaatagtgttgtgtattagaggttatttcaacctatttcactttgttgctgtgcatcgctactgttagtgtagaagtaatatttactactaagaaagaagattgtggtaaaatatgcactttctcagtaaatgaaaaaaaattgatttacaaaataaaataattcgtcaattttgtgtgctatttgtgtatccatttaaattattttcaatacaaatcaagggaataaatccctgttcttttacatatagtcctttttttttttcctttcacacaactaacctatagtttaatttttttatattattgtaacttgatattccagcttaatatggaagatgatgccgagatcgtcgccataagaccccaaattggaggtggtgctgcggcactttgactcttaaaagcattagctaggaaatgtttgttgtactgcttagagtttgttaatttgcttaactgacatggtacattatattatcagaaaaagtacgcactttaactgtttgtatatcaagtttatatgttaaacttgagtagtattagtaacaaatgtactgaacaaaattgaagactaaggactaaggagagtatttttagtattaccattttattagtttggtgactctccaaatccggccattccagtgatgaaaactttatcagccttctgcggtaccaaactgacccttaggtttgaataataaacaataacaaatactaataaatgttttgaagacattgactaaaagtttaaaaaaaaattattaagatgcataaaatacattgttcataattttttttacttaaaacactagttagtgatatccatcaataattgaattgtagatatatatagtgcaatggaatgatgtcacgtgaatatgaataaggaataatgaaggtgggtgggggaagagaaatggacatgacatgtatgtgggtgtatagcacaagctaagttgccaaaaacactcaaggaattataggatatggtgtggagcgtaggtactgtaaaattatgcataaaaatagaacaaggagagtatttcaagggctgatcgaatagtttactgttttgtttcttttctctttcacaattcagcagcacataggcatatataagatgaatgactcttaaactacaagaagttacaattagataaagagtcacaaggcacaacactaattgactatagtggacagcacgttactcatacaacaaaaactatgtaaaaatcacagtgcatttgttttattttgaattcctttcgcatcttctgaatgtaaatgaattttgcattttacactgtaaaatacttctaatttaatagaacctcaaaagtttgcttcttattatattttgatttatttatactattttcttcttttgtataaaaatgcaaactgttaaagaaattgaggacgcttttaattaataacaggtcaatttcaagtataggcttgttgcattagaaataatagaaagaatgacaacgttgaaagctatcatgctctgtcacaaagagaatcaattccctctgcagtaagaacacctgaacacagatttgaaaatttgcacaacaaaatatttttagttcttataaatataaaaatatttgaaatttattatgtaaaattttaactttttgcttggaacaagaaatatatttacataatttttttacatcgattatatacagatcaacgtaaacatatgtcacttttacatatttaaaaagtcataatatactttaattttgtgaaaataaaaaatatacttcaaaatttacaaagaaaaattcaaaatatttctatatttatgagagagaaaatatatttaacccaatttaaaaatatgaaaatctacatcactcacttaacttttttcattaacacattttaggaaactgaagaaacaaacactaggagttacaaccataaccagatctagctatcaagagttgaaaccacactggtgtggttttcttctcttcctttgtcaccgattcaagaataaaataaattgcatgtacccctcttcaacttattagtgtggtttggtttgaattgatgttttattttcccactcatctaaaatgttttgtgcaatcttcaattgcatgtgtagaagaacatgactacatccagaggtcgaccatctaatacgagaccttgcagttcctatacgatggtattcacattaacggaaaacatacaccaaaaatagttagtttctttcataacatgtcatgtcacacaaagtttgggtattttttactgtgctatacgttgaagcataagatatgctcagttttcatctgttcagggtccatgtttggtgcttgtttcaatttctagaagactaagtatcttaacatgaggctcttcaaaaaaatatctagcataagttttttttcttcttcttaattttcatatttctaatttgttttgcttctttatttagttgagagttaaaattatgggtgagttcttaaatttaaaataaataaattaaaataagtatttttatataaatatttttttttattttttttaagaaacaaattctatttgtttcttaaaaaaactgtttattttaagtaaaaatagtttaaacaaacacatccgttgtatattttatttaaaaaatacttatttaaaaaaataaagttaaagaaactcacccctatcattaatataaataagacacaaaaatgcacaggaaatcagaaaggcctgccctgctcaatattcttgcataactttgtcttttttgggaatacaccttcggtttacttcaatatgaatttctttaccttatttacgtctcatagtctcatagtacactaaaatttgtgaaaatgaaattaatattgaactgtgcgtctactgcttgtgtataagtaatatttagatctcatattttgcatatagttctttattttttttcatacaacaaacttatagtttaatattttatatttatgtatcatgacttcagcttaatatggaagatggtgctgagatctatgccgcgagacaccaacctggaggtggtggtgatgagatgtgcttggagtttgttttgtttaattaactgatatggtacattatcagaaaaaattacgcaatttaactgatattgaaacatgttaaacttgagtagtagcaactcatgaatgtactaaacaaaattgaagactaaggagattatttttaggattttttttctttattatttgttaccaaggatgagagctcctatgagcaaatgatgaaaagataagaagataacaaatctccttgttgcaaacctcttcctagtattaccatctccttgggggaattttatttggtttgccacttggtggtgtctatggaacaccaaaaacaacattgcttttcgtgaacaacattttgaaggagtaaaactcttataagagactaaaatcacttcttgacagtgattcttgtacaagagaagaaataaatttgtgatctttttatcatagagtatcaatcatttgttttgtttttcctcattgttagaatatcttacatgattttttatttttattttttgtgaataggctttctgtatgtaactttgcaactttatttcttgtacagacttgcctaccatgtgcaatatattacacttttaccttccaaaaaaaaaaaaaaaaacaataactgaataatatacaaaaagcaacacaaaacatcattcaattaatccaacgttgattaaaactcattcccgatcatagccttcaagaaccctagttaagttcatgctaagccttgctaatatcagtccttaaaacaacttaatgccactctaattttgtaacagtttaaaattggtttaatatgttaataggttcccgttttttattcgggaacttttttatttggattcctaagcgatatttttatattgggtctgtggtcttgtaaattttttgtaattaagtttctaaagtcaaaatcgtcacaaaaataataatttagggctattttactaactctaagaactgaattacaaattttaaaagatcaaaaaattcaatttttttttaagtttaagaacttaattaaaatagatcaggaacatcctcttgtattaaatcttaaaattttaagcaaacttaaaatttgtgaatgaataaatattacatccactatttactcatttttataaatttttaatgtatgaatatttaaatttagggattaaattaagaacgaaagtaatcaagttaagaataattggagagttgctagttcatccatgtaatcaacctcgcacggccatgttgatgttaccaatccaatgcgcttcgctgttaatctctcccatcacgattgacaaaccctaaccccaatccccccgaccaaaatggtgaagaagaaggtccccgattggctcaacagctctctctggtcctcatcgtcgccgtcgtcccctccctcatccgctgtcgccagccccttcgaacagccacctccaccgcgtcctccatcccccgccgtcgtgaccccctccgagccgccgccgtgtcctccgtcgcctcccgccgcccacgatcctccgccgacgcagagaatcgatgattcgcctagggaagatcacggcgagggctttcgttccgcgcacgacgtgtctcgccaggctcaattgctggccgaggttccctctctccgccttcttctgtaaaacgacattgaagttttgttgattagtgcttttagtaacagtgttgattttgtgatgatttggtttggttcagttgtcaaagaaggtggtggatatgagcgagttgcggagcctcgcgtgtcaaggtatacctgatgctgctgggatacgttctactgtgtggaaggttaggttgcattttcgttcttttttccccctacattttagtcttttttttaaggagtttaattttcctgcactattactgtaaagatttatacattatcaacagatgaaaaatcatgtcaaatacgacttttaaaatagtaagtctataaacttaccatttatgaaaatctgcgattgcatgatagattcacactcgagtgtagtttagttgatacagtgtcagtgcattctaattaattttttattgtcttcttttctggtgtgtgtgatgaaattgatactatagttaaatccagcttaagtggttgtttggcatggataggaatgcagtgacgcttgaatggatatttaaattaagaaagaaaagtaatagaaatttagtttctgatatttttaggtgaattagttttatttaggaaaaatggagcaaggatttctgcactagggatgtgcattccaaatcatctaaccaaatatgcgagtggtttatttccattccattccaaccaaacaggtcgtgtgttcataagtctaagtaaggatatggtttggttgctattggttagtcaagagttttttcctttattgatggaaagatggacgtgaaatcatggaatgctgttgcaatttatgctttttgatacttgcagcttttgcttggatatcttccaccagatcgagggctttggtcagctgaattagccaagaagcggtcacagtacaaacaattcaaagaggagattttcatgaatcctgtaagttagttgcttagggagctttgatgccttagtgtcatcatcctcattatttttgttaaacttttgttttgttttttttttggggggggggggggggagctgtaaagatgccttaattgtcataagattgtatgatctgaaaactgccagtggttgagctagagctttagaatcaacatcaacatcaacagcacctttaacccaaattaattggggtcggtggtagatgaacccaatgataaatcgaaaataaagcaaaagagagaaacagagttaaaataaaagaatggtgagaggagaagagaaaagaagaagaaaagaatttgattcttgtgacagactatggtttgtagaagagagataattctaaggaatatgtcgtcacattaattatttgaatttaattgtagtttacttggttctttctgtcacaaactcacaatgatagggtgcatgtgtgtcaacgtggaattgatagggtgtatgtgtgtacaagtggaatttttgtggaattagtgatttgtcatgcatattctattctatttgctttatctatttggctctctgaatgtttctgtggctagctagtcagaaatcacaaggaagatgttcaactcgacaaattgtgatactgatgatgccaactgtgcgagggcattgctctctagatccgaaatcactcatggggagcatcctttgagtcttgggaagaccagtgtatggaatcagttcttccaggtagattgtaaagtgctctagtacttaaaatttaaaggaaaaatcatgcgatgcctttcagcttaaaaccgttggtggtattctagcattggtgtgaaagtttcaaaacactcaaggaattataggatatggtggactgtactgtatgtactgtaaaaattgtgcagagaaatagaacaaggagagtatttttggggatgaattctctttcacatttcagtagcacatatttatagatagatgattgactcttaaatgacaagttacaatgagataaagagtcacaatgtaaagagtcccagcaatttttgacttttattgataacaatactcacaactaaaattaagtaaaaattacaatgcattttgacaatgttgcataaactccatcaatattgtctcacgatgcatcagttcgtgacacttttaattttacatgaacaggtgtcactgaaaaccataattcttcatgaaacttcctttaccaaaaaaatatggattgatcgcatataccttatctgtaatgacaatcatttattgtctactatgaatgcttctctaaattttttgacagtacaagaggaccctgtgatctatttgttctaaacttccaataatgaaacgtctttatgaaattgggctaagcaaatttgttaccacatactattaatggtctttctactgtcaatattttaatctttaatgaactcttgtgttcattattgtatcacaattatataaatctcatgctaatgcactataatactctgtgcaaaggctgttgtgaagtaaatctccttctttgcattttgtaggatacagagatcatcgatcaaattgaccgagatgtaaagcgcactcatcctgatatgcactttttctctggtgattcccaatttgcaaaatctaatcaggtcctttctttgtcttgaaattcatacaaactccaaattcaagtattttctgccgtgaaccctttgatttattattactattttttgggggggcattttcaggaggctttgaagaatatattaattatttttgcaaagttaaacccgggtgtacgatatgtgcaaggaatgaatgagatattggctcctctattctatgttttcaaaaatgacccagatgaggaaaatgcagtgagtatatgcttttaatcttttaattgtttgtcatatgatctatcatcattgggttgcattatcaaacacctgattctctgttattgtccttgtttgtaattcatgctctattaacaccacttaccatagtatgttgattttaattgtatgtggtttctaaagattaattggttcaaatttcattttttctttttgattttgcaaatttcatttgaagaagtacttttcctttgttattcttctctgatcagatgcactatatctgtatgcaagtctgtcagtcttttaccttttgtatgcatacattctaaaaagttcatgtttcctcattcatttgcctgatactttccagtgtatgctttaatagaagaaggggctgctagaatggggaaagggaagacaaataaaaaattcacgtgtgacaagttaaaaagtaatcattgcttaggggaattgggacaagaaattttaccaaatgtaattcggcattgccctgtatacataaaatagaaagtatgtaaaatagttaatatgaacatgggaatgttgattttgttgtaaacaatttgcttaggtggcaatatggtggaataatgtagattcattaacaatgtcatgttctactgtattattggttgactctgctcaatagttccctattataatttgcaggcctctgctgaagcagatgcattcttttgttttgttgagctattgagtgggtttcgagataactttgttcaacaactcgacaatagtgttgtgggaatccgttcaaccattacgagattgtcccagcttttgagagaacatgatgaagagctgtggcgccatcttgaggttacttctaaggtaagacagttttagtatatattcatcttctcacagttccctttctgtttaaatttggaaatattgtgagaggataggcatttctgttaaagtattttaattcttgatattataattagttattaattatttatttgtacattgcatgattgcaatatctactgttatgctagcattgtgtactgctctgttataaatttgttaaataagctaaataataaataaacaagtgtggctccttcgtgcttcattatgaccttctctatgttagaattattattttggccactgtttttctgtctgtttatactgttttatgtttctcaactagttaagtgacgggcctttgactagttatcataatacattttttgcatgcacacctgctggatgattcaaccatgtatttgcttttggctattgaacagtttatcagattgctcattttttctggttctgaatgtcaggtcaatcctcaattctatgcatttaggtggattactctcctgctgactcaggaattcaattttgcggacagccttcacatttgggatactcttttaagcgatccagatggtccacaggtacatttcatatttaaccttgtactatgatggacttgcatttagacttatggtccactgcctcttgtataaaaaaaaatataaagctacttttacttgacaaaagaaagaggagagaatttggctctacatgagtatagtatagttcaagagagcaccattgacgagtaaatcaagacaattttaagtttttatcaacaatatattttgctattagactgcttttccaagttgtttttttcataatggtgatctacttcgcacttaactctgcaggaaacgcttcttcgggtatgctgtgcaatgcttgttctcgttcgtaagcgcctccttgcgggtgatttcacttctaatctcaagttgctgcaaaattatcccaccacaaacattagtcatttgctctatgttgccaacaagtttcgcgtacagtcagtctaaatgttgcattttgctcttgtatctctaatttctctttcaaattcagtgcttgtaaatgacttagtgtgagcttgggtgaagtaccgtcacttaattcagtttattcattattttaacttataatttgtacgtaatttttcttggggggaggggtcaatgtgagcttgggtgaagtacgcttataatagcaggaacttattttatttttttattttatactctaggtatttttttaaccttaccacattcaattctgtccactctaaaatgaccaattcattgctaagacattaggtaaagctagttatccatatactagtattatacagatattttttaaatttaaataaaatgtaatgtataaacaaaaataaattaaagtgataagattttaaaattgaagacaaaattgtagaaataagttatcaaaatcgttacacatcaatatttggaaaggaaagatatattttggtataatgtatcaatatttaaaatttaaattgagtaaattgaaatcaaatttaagaagtaatattgtttttaaaataaaaaatttaaatgaatgatttttcgcatcaaaatgataaagtgattagtgtttatggttttaagaatttgaacgaggttttattctaaaattaatgtataaagttattttaaaatataaaagtaattaattgtgaaatcgaggataatattgcaaaattgttctacatttataaatgttccatattgacaaataagtattttttgtaatttgtgtttgattcaacttattttaaaggaattttttttttctattttaagaatcttttaaaaaaataattatttttgtggaagattctacattgataaattatataaccaaaataaaatatataaaagacaattcttattttataaattgattttgtaggtttgagatatgctccgaatcaaaatttaaaatgctattaaagtctacaaccttcacacttgatatgcctaggttctcaacatgagggaaaatgttagatatctcccctcaactaaccatataattaaaaaatagtatatagatgagaacaataaaaataatatataaatgagaacaattattgtaatgtaagataattatgtaggattgagttaaattttaaatttaaagagtgtctttggaaattattgtctctaaacatgttttataagcaaatgattcaatgatagacatgaaataataaaaatgtttatgaaaaactaatatattttgtaactttttgatcacataaattaagttttgacttaaatataattttgatttttctattttttaaaatttgtaattttggtttccttttaaattagagatatttaatttttatattttctaaaattcacaattttgatctccttattttttttttctcaaaatccgtaattttaatttttctattttataacataaacatttagttcttcacattcataaaatatgtgatattaatcttccgtcaaactaaaagtgttaattactaagatattaacattaattatgatgtaaattaaacaataatcttatatcacattactaaatttgggtcacaccaaattaatttcttaccaattaacaaaaattgtatattttataaaattagagaattaaatgtatttattttaaaataggagataaaaattatagatttttaaaagtatgaggactaaatgtatttattttaagacagaagattaaaattaaagattttaaaaaataaagggaacaaaattacgtttaagccttaattttttgattattaaactataaagattaagcttataagactaaaccaaacagatgagataataaaaatgctacggaagtagtagtaggtgtacatgaacatcattgttgttttgtgtgttggggtcaatcataatccgtcaaaggcaccgcaatgaagcgaatctggtaaagcagaaaagcgtagttggtgaaattcctgggatcccccactggacggagtttttgttgcttagctttgctttcctttttctttcattcattcctttaatcctctcttacactatacgactcctgttccattccatcatcactcattcccaaacgaaacgcagcgtttcttcagattcagacccaacctcatggtacgctacgcccttatcaatgaatcctataagtaatctctgttgtgtataattaatttttacgtttcaggcaagcacgttgcggttatacttgacctgcattcggaacacgctcgaggccgcaatgtgcctccaggtatcactccttcttcgtcaacgccactatcaatattcgtttcttttggcatcaacaaaataatcacttgttctgttctgttgtttttttctcttcttcgttatgcttccagaactttccctgtcaagaagtcgaaaggcataacaagcccgaggttgaactcaagtacgttctctctcccctctttacttcattgcacatttgctccatattactgttctaaatctatttgataatggaaaaccatatactgaaataaaaaatgtattttaattccacattttccacatttaatacgacgattcacacgatgttgttcttataaaaaatcaaaagtggtcgattttgtgaactctgttggtttatgtgcagaaccagccctgaactcctgctcaatccggtaagatccatcttaattcatatcactgtgtagtaatttccacttgctttactaatgctgattagtatgatttaagattacgtgactaggtttctgaattgccaaactgctatatgatattttcttttcttttccttcacagtatgaaaagagaagttagggtgccaggtattccttgtgggctgtggcaagtagttgatagaacctttggccttaggctaaagaaagtaggcaagtcaaatcataattcatggttgggttttttatgttaagaatgagactggtgttctattataaaacctcttccttcttcaaacttcaaattggccagtatttaggattttggagtctagcttttgcgaaatttgtgatacttcactccaaacttctgtttgataaccttctttgcacttgtgttgtctattgactttgttcgttcctttaaatttttcttcttggaattctaaggtcattgtgatttgtgacttgtgagggtaatggctcagagcttttgtgaagtgttacatgatcaaattttgacaaattagaagaccttgtaaatgccttttctttatatcttcttcacatgcaccaataggttggagaggcttaaccatctgtttctcagaggtaatagcttgggaaatttggtgcagatagcctgctctttgttggaaggagtggatttgtgcttcagcacttgagttgatggtgttgtgatgggctgttttacagattccaattagaaggaaagctagttgtcactgtcctatatattctctaaacactagtatttctggattgagtggagtgttggacttcaacagataccttattccaccattttccttgtgatggaggcttcatgcaatttataatgctagcttaaggtgaaattataatttgtttccgaagcatttttcatctgaaaggggaaaaataacacaaaatgagacttgtctaaaaacaaaggagaaaaataactgtatcataaataaatactcgcagccagagaggccagagagagagatcaacatagaaggttgtttagtggtgaggatgtgggatgaaataatatattgttagaaagataggatgcaaatgctcctaaaaataaatgtttatttttttacttttttgggataatagtaaatattaattgaatgcaaagacatgatgtacagttttggggtgctaagcggggctagagatccttttttatatgtaaaaaaaaaaaagagagatgaaaacatcaagcaaaagtggctgaaaaattgtaagaagtgatgaaaacaaatattttagctgtatgactagatttaagatagcccatataatttgtggttaaaatttaaatagtgcctagcattcaattgtaaacaatgaggttaatgttttaagctaactattatcatggttattatgcattaatgtcttcttttagtctaccattctaaatgagtatacttcattaggattaagcagactcttgtaggtggtaattgtgtcttaataatttcttctcttgctctaccttcctaagtgatatattacttttgcatccatgctttatggaaaaatgtgtgcaattgtttttacaggttttgatatgtcgaaatgaggccgaaaaatgcttaatagaaacatctatcaattcattgcggataagtctcaaggtaaatctttttcttttttgtgagactaatgctttgttaaaatgatctaaaattgagtctatgtccacgatgatgtaacaatttcttcccctaaccggaggctattaaattttgggtgtttttttaagacatgaactgtccattaaagctcaggatatctttcattaacttaatgatttttctttatgcttcttccttttttatagtttgctgttaatgtactacatatcaacaatgtgtaaagcttcagattgatgtactgtgcagtctctacttctcttgaatattgaaacatgttatacttagtgtgttggaaatttagaataactaaatagaaaataggtaggtagagaaggtgagtagaatttgaaaataataagagaaaaagtttcactgtgcttggatggaccactgataaggtggctgaatctgaagtgaaaattaaattcagctgggatgactggaattgatatgcaggcattaggacagtgcatttaaactttgtgcaactggcacctgtccaaaaattaataaatttcaatttaatgcctttacttttacggtcaggaccgataatcttagaaattccaatttgtgaggtccacatatatgatgagtactgcaaagttgcaaatgagtgttataggggtttgccagaacaagttgtctatattctattataatgttagattcctttatatcagcttacagtttaattttatcagcaatttattaaactaatatttgaatgagagtttgttttcaagcatcaaattcacatttaatttgtccctaattcgttgttttaattttattctgtttcatcctgtgcaggtgaagcaggctgatgaacttgaaaacatactgaccaaaaaatttctaagatttctgtcaatgagagccgaggctttccaagtactgaggagaaagcctgttcaggtttagcattaatttacatagttccatttgtcttagtaacttgtcagtgatcattgatgtcatcctgttgcttctgttggcagggatatgacattagcttccttataacaaattatcactttgaggagatgcagaagcacaaacttattgactttattgtgcaatttatggaggcaagaattttgttgaccctattacttggatttgcattttattttgcggcttatagtagttatctaaattagggatactgtatgatctatggagtgactatggaaaacattagcaaaggttctatggaacatgattctcccaggataattgatgcaaagaaaagcataacttgcaaaaataaaataaactataaaaaaatagaacaacgttttgatattctttattagatattagatactagaccttatacattaactttcaaatagggtaaggtgtataactgttttgcttacagacttttcctgccaattacttgtacttgtggttgatatttggtgtaatcaacttaaaagatttactgataatctgaaacagagcaagatgatgtttttgtttgctttttctattaccttcccaacatttaaagtggctactttcattgatctgttgtacgttatataggatattgtaaatattaaaaatttgctgtcttctatgttagttctgcttaattgtttgtaatttagtataataatggccttcaaattgcaggacattgataaagagataagcgagctgaaaatgtcggtgaacacaagggggaggcttgtagctacagaatttctgaagcagtttatctgatgctttagactagttagaacttccatatccgtgtaaattgtactattgcacgtctagttttcacttcacttatgaagtgcttggtcctttgagccaatggtttgtgtttttattatatttaacagaagtgcagaataaattttgtagagtttagtacagtatataaagaaagatatgacaaacctgcatgtcacgcggagaaaatgaagctacagcagctcgcagttagcacatttcctttcccgtgtcccacggtttcttcggtttagtaaaacttgttaaaataaaggacaaatcaactatttggttttttttttttttttttttaaatttagtcctttatctttatttattttttattttttgttagattagtcttcgaaatccatttaagatcgacattgttaattattcaagaatattttttttgttaaaaaagaagtgaagagaagggagaaaattggataaaaaagtttatttttaaattattaataacgtcaattttaaatagacaagaatcaagttgagaataaaaaattaaattgaattaaaaaataagataaagaatcaaataaatttttaaaaaagttaaatgattaaattgaaaaaaaaaataaggattaaattaaattttttaaaagataaatgatcaaatttaaataaagataaatgatcaaatttaattatttaatctcaaataaattaagtcattaattattttttttttcgaaatgaaaatatggttgtcccatcttaaatgaatttcacttatggttttagacctggccggtcggatcatgattcgctagctggactggtttgagtctatcaatggatcttttttatcccgtgtaacccagtgcgacccggtcgggtctatggtccaaccgctgatccagcaaatcggactgggtcgctatttgaaagaaaaacaaaaatgtcttctttaggcttcgtccgctacttctgcttctccttccaagcactcacgtcacatcgttttcataggggggtgggttgtgggggggggggggggttggccgtccgtggtgggggtggggaggtgagtttgcggtgcggggaggggatgttagggaagatctcaacggatttccgaggggtaggtgagtgttggttgggggggtggggatggggggcatgggggtgccgggggcaatgaactttgtcacgaattttttttttttgggggggggggggggggggggggctgctcacatttcacgatttggtgcgggaggaaaagggatgggtgggtttgcacatatcgaggtttttttttttttgagggggggggggtgttaaatgattttttttaagaaaagtgttggtatcgagacctttttttttttggggggggggggttaatttttttttaacaaaagtgttttaaactttgaattttaaattgaatgaatactttttaagcctgttaataatagataaatggtgtatataggagtttatttttctttattttttagatatataaaatttgtttctaaaatactcataaattattaatataaaatgaaaataaattaagtataagtatgtatatgatatagagatgagataatatcattataattttccttgactaaaaatgagttattgagtgagaattataattctataattttgtattgatgattttatttcttatatttaaacttatttagtttatgttataaaaattttaaatttttttgttatatatcgagtcatgcgagtcaatcagtaacctatcggttcgatcattgacccaatgatccagtaccttgatcgattcgatcactggttcgatttttaaaactatgatttcacttgtatcaaacttaacaatatatttaaatctaagcatcttatagatttgaaatttgagttttccaaatagttcagtttaagagaggaaagatgggaggtgaaatgagaagaataaaacgaaaaatcacctaataaatctattgtttagggttttggaattcaaaaccaattaaatgagttttgtgagaccatttggggtcctcctcccttagttgaatggtcgttggccaatgggagtcgagcttaatagctttcatatttttacggtgcaacactgaatgtataattgtgaggagagaatgcaagaatgtgcaaagcgcaaaattatatagtaaaaaagatggttatgttggaaaaaaaatcagtactacgggaatatgtattccttttgataaaattatgacaacgttataggtattttttgttttaaatttcttgaggtaaaaatatggtatactaagcgtagtaaccatctaaagacgagatttgttcattctcaagtagttagttttccagttgctaatttgtgatggatcatgatctatagttgaatttctactttagagaataccatcttttaaaacttttttaataataaactgaatagaaaataatataaataaatatatttacaaaaatttaataaaacaaattttaaaaaatacattataattaaaagggtattttatggaatttggggttacataatttgggaaattattctgaaaaagaaaaattaattagtactataaagacattagttaagaaataaaaagtgaaaaaaattatgcaaaagtctgacacttaattttgtcatcagtgcatatgtggcatagttgtttttttgttttttgactgatggcatagttgttagtaaatctatatttattaactttttgtatgagttagttcctttaaaaagtgagtagtacaagaacaaggcatgaaaaattatttgtaaactaggataaatactgttcgacaacaaggcatgaaaaatactgtacgagacaggatacaaaacaaacagaaacatgccaaattttttaaaaaattactacttgatattgtataactgtaaaataatatataaagttattctataattttattaaaaaaataaaattaagtatctatctagctcagttagtaaagtgtaagattcttaaccttgtgattgtggattcgagccccatggtgagtgacttcttttttttatgattaaatttaattaaagtatttgaagtgtcaatacagtatctgatatagatatgcatccgactctgacatggttatttagaagtgtccgtatttctaagtttgtaagatgtttaattttagtatacatgcaaaaaggcctttcatgtctcttcttttcattaaggtataaaacagtagcagtaacattgttttgtttttttattataaaaagggtagctataactataagatatctaataatggtataaagttaaaaatagaaaactgtgtacttggataaatatgtactgttatggtctgataggtatgttctgtctcaagcatatattgaaaatagctatacaacctctaaagattatttatttatgggattgagtgctgttatttcctcgtggtctaacacaaaatttagttgttttctgttgcattacaatatcgaagaatagctcacatttgcaatctctaacatgctaacaaaaaggaaaaaagttggtgacagaagttatgatgccaatacagctggctatcgagccatcttccttcctataactttctctttattgagttttattctcatttctctctttggtaacttggcattgtcagcaagaatgaatttaagtgcaaatgagaccctattcttgtcggttgataaaatcaattttttcacctataatgtgtgcactgttgctccacccaatattgtttcagatggcttatggggtggccaacttaatggacggactccattgaaatcttcactcccattgtttgagttgcaggtgcttgtactttttgctatcacccaaatctgccaattcctcttaaagagctttgacttccctcaatttatcccacaaatgatagtaagtattcttcttttactatcttttatctttgagccatagcctatataaattaaaatttccttgttcacatagttaattaatgtttctcataaaatagagaacaaactaatttaaaaggattttccttatggtctgcacatcatggcctaaaaccaatccaccatatatgaccaaagtgatatgatagaacataataaatagtaggtcattatagaccacacgcattatataatattaggtggtcaattttttttactaaacgaattgacgtgttttctttttaatcttggattgatgagtgccatgcacctctgttttaacttttatcaaccttaagattttaacaccatatttacttaagctcccctttacactcctttagtattagccaaggttttaaaaaaacgagttgcaaccataacttcggccataatgttaagatttttggagtgtctataaccgtaattgtaaccacatcggctgcatttgtccacaattttccacaatattatagaatcagatgaaattgggaccaatttaaaatcttgatattgcctctttaacttcttttctctctctaggtgaggtcactcagaatatttgtcacgtgtagcatgcaatgtaaaagttgtttagggaaaaatgttaatttctcatatttcatccatatgccactcttgcatctagctgaattattaaattttgccttttttttgtccagaatttttcatattaatacaaatagagtgttgtctctcttgttacttataacttctgataaactaaatcaattttttttttaatctgcaaatgttagtttattagcaaagggatcgaacccacgatcttttctctcatcccttctcccttttcccttaaccatccaactcactttatatttccttgttaaactaggccaatgtcatgtcctcttggagacacataggaagactcattaattgattcataacttgtttccatttgcaggttggcctgattctaggccctgctgttcaggtagagatgctggacaaatacaagaggaaattgttttcatttccaagtcaggacacacttgcaacaataacatcaattggttatgcatttttcatctttacaagtggggtgcaaatggatttgagcatgataaccaggacaggacacagggcatggaccattgctattattggattggctgtgccgatacttatttgtattccaaccataatcagcattgaacgtttaattcttcctgttgaatatcaaatctttaatgttactactatagttctaccagaaactgtaatttcatttgcagtagttgcttccctcctcaatgaacttaaaatccttaactctgaacttggcagattggcgttatcctcagtactggtgagtgacatattaagcaaaaccattatatgtgttgccaatatctttatggatgccaatgaaaaccagaatatttttgtgctcttggtatcattgattgcctttggcatcttggttccattattttttcgaccagcaatgttttggatcatcaaacgtactgcagaaggaagacctgtgaatgatggttatgtctatgctgtcatcacaatggtatttgcattaggttgggttgcagttcaaatacatcaagaattcatcctaggagcttttatgttggggttggctgtgccagaaggacctccattaggatctgcattggtcaagaagcttcacttctttggtaactgtttcttcttgccaatatttgtaacttgcagtatgatgaaggcagatttttccaagcacttttcatcaaaagtagttatgatcactgctttcagctctcttttcactcaccttgtcaaagtaatagcatgcactatacctgccctcttttgcaagattcccttcaaagatgccttgactcttggcctcattttgaacgttaaaggcgtagtggaagtcggcatctatggcatcttatatgacgaaggggtaatatatttacttccaccttaacttgtctttcaataaaattaagggtaaattatacttataatttcacactttctcaacttacttccctacgcttctttttgtattactaagtaaccccaattctttcttttgtcattgaacacaccctccctccctcccttttttttctttaactacagttttagactcactagtcacggttctagatgtggtaaaaacaaaggtacagagggtttagtgatacaaaaaatataggagtaagttgagaaagcgtgaagcatcaatggataaaatttaatttaccctaaaactaaccataatcttgagtttgaaaagtcttatcactatcttctatatttaatgcaatataaaatttcatttatatgtgcatgcagactattaatggtcctacttatggagtaatgatgatcaacataatggtcattgcaagcttagtgaaatggtctgtgaaactattgtatgatccatcaagaaaatacgctggctaccagaaaaggaacatagagagtttaaaaccagactcggagctgagagtagttgcctgccttcataaaacacaccatgtatctgcagtgaaaaatttccttgacctttgttgtccaacaacagaagaccccatcactgtggatgcattgcatctaattgagctaattggaagggcctctcccattttcatttcccatcgcattcaaagaacgatttcatcaagtggccacaagtcttattcagatgatgttattcttgcttttgacctctatgaacatgacaacatgggtgcagtaactgcacacatttacacagccatatctccaccctccctgatgcatgaggatgtttgtcatttagcattggacaaagtggcatccattataattcttccattccatctaagatggtctggtgatggtgccatagaatctgatgacaagaacacgagggctttaaattgtaagctcttagaaatagctccatgctcagttggaatccttgttggtcgttctgcaattcatagtgactcattcattcgggtagcaatgatttttctgggcggaaaagatgaccgagaggctttgtgcttagccaaacgagcaacgaggaatccaagggtcaacttggttgtgtaccaccttgctcctaaggaacacacaccagacatggagtatatacgagataatgaggcactaaaacatattaagaaaccacacttaggaaatgtaagttaccaaaaagtcatagtgaatggtggaccagagacatctcttcttcttcgccaaatagtaaatgaacatcactttttcatagttgggagaagacatgagttaaactcacctcagacggttgggcttacaacttggagtgaattttcagttaggtgtcattggtgatttgcttgcttcatcagattttgaaagcagagcgtgtgttttggtagtgcagcaacatcaacatgtaaaagaaacatcatagtgggtggaaattctagtagccaaacaacatggttactcttttcacttgtacaaataatgtagatattctttttatgctgcttgtgtttcatggttgttgcattaactattttttttccaaatgattatttgctcttttatcttctttttttatttgctttgatcttttatattttaaaaaaataatttcaattctttatgtttttaaaatattcaaaaatgattcttttgtcaaattaaagttaacaccattaagtagtatacagatactgaaccgtcacaaatgaaaaacaaaacaaattttcaaattgaaaatgacaccctaattcccaaattgaatgtacatggtggacaacgcttccctccccaactcgacgtggatgcaactggtctcatatttctgcgtcccattttccccaaggcctctatctcactctgcagtggtgcttctacaaattctcttcctcaaaatgacgacgtcgtcttgctggcacacgaatcgatagaaatctggttgacgaacgttctgagttgttgttatgttaatggggcgtggaagagttgcagtggtaggtttgttcttcgccgttggaggagtcaaggaggaggatgttctgtagcttgaggattgaagagagacaggttgtcgatgccatcgaggaggaggagattttgcagcttaaggtctgacgagaaatttaggcaattgggtttctggtgtggtgagtattggatcgaggttggggtggcgacgcggtggttgtgcactgctgcagcttgagatctaaagagagaagaagagaaaggaaaagatgatgagaaaaaaacttacatttttttatgattttgaatcgttagtacttttatttcattaatggtatcaaatttagataaacagatcattttaaattaattttaaaagatatattatcataataaatttttgaaaaaataaagaattaaaataaataaataaaataaaatgaaggcttaaacaggataatctttttggcagaggtatggtctgtttgatgtttatgtaaggttctgtagttgtgtcaaaatgatgaagttgataattacagaaactatgccattggaagacttgtgaattcgcaagcaaacaatagtaaatttgtctacttgacactttttcttaagaaaaataaggtttaaatacgtaatctagtgaacgaaatccgttagttgcatggatatcaactcttcaagaccacataggctagttagaagctggacgagagcttaaaatgaaggtagaagcaagcacttgaatgccaaaaaaacagcagtggcaataatcattttaacgacaacagtgcccaaggtggccttctttctgtccacggtttatgagcattaatttcgatcaatctacatttttaaaagaacaaaaaaatcttgtcttctgttggagttttttttatcactctgcaacttgcattgcatctaaacttagaagtcgttctaatcataccagaaggttgaatttaattgtattcagtgaatgacttctgcttattctcctttttttaaagaaaaaaatcactttagaaaagaacaaagtcaccaaaacgatggcatgataactatgtctatattaacaaaagaaattatacttctatgtagtaactagtaacataaatttgatggttgactacaataccgatcaatctttaatctttacatgtcgtaccactgcaatttaactaaaagatgctcaaaatgttaacactgtttttaagaaatcaactgtttttgggctggggatgggaggagggggtccaactcccaacggtgagtcttacaaacccaagattttgtcattactggaaaattatcatcgaacttaactacttaagtccttatttagtaaaaaaaattctattgacaacatcaacaggtaaagcataagctggatctaccggtttcagccctggatattcaagaagtgaaagtcctgcaagcaaaaacacaacttaagcgtccatagtttacagtgtaaaagcaataggcactgtcagaaaaggaaaaatagcgatgtctagcttataattcacatatatgctcacttaaaccttccaaacaactaaaataaaaatagaatcatgttaaatatccagttctaatgaattattataagcatgttgaacaatacgattaatcttatctgaattcggaacataatgctagcaacttcacaacatgaatccacaaggattctataaaaatggtttttcatctctctttttagaaacaggatgaccgaatgaagtcactggttaatatcattcccacattgagtcatgggaatgggagagattaggtggttccaatacaaaccaaggaacccctagataacaagattttagcacaacaaatggaacaaaaaaaggtgaaatgatggaggtactctaccagccaccccgaagaatgtatgaaagacatccacggcatcatctggcctgtccgaaattccaccattttctgtgtccttacagtttcaacatacataatatttcagaaatactacctgacaataattaaaaccccaaaaagaaaaaagaatgcagagttataaacacagaaaagacactcaactaactaacctggcagtctaagatgaactttataagcttctccttacttatccaatgtaccctatcaatcatgatcaggctagaaagaacccaccatgagtagcagacctgagaagatctaaaacctagtaagagaaaggaaaatctacagcactaaacctaaatttgaaaagatttactcacatcaggaagtttctcaggacgcccattcagacctccagatttaacctgtcgctcgcataaccaccaaccaagaaggtctttgtcgacaagatctagtgaccctgttatggcaagggcccccacacaacagaaaactgacaatagtaaaagcaaatatattagaaggatgatttaagtccacaacccatttcattctttcatttgaaattcagaaaacagaaaaattaaacagacaaattcaggcttaacatgagtaaattttgaccacaaaagaacaaaaggaaagtacatcattcctatcaggaaaactaccaagtagttggataatgtaagtactaggttacatagctatactgtgctgccaaggagaaaattgattcttatacccacaaatttaagcaacatcttaaaatttcaaactatgcccttcaccacataaagcactcccttcatgtgggaaagaagcacacaatctttaaaggaaaaagtagtattagtacacacattgaataagtaacgtagggaaattaataactaactaaagatcatgaataatttatgacatactttgaccagcatgagattccccaccaggaatgcacccaaaaccaccatccatatttttgcaacttataatgtacttcacagccttctccaaattgattttatccaagcgatgtaatattgatagacaacaaatagcaatatatgagaacctaggacaaataattcagtggattttagttaaaaatacagtaagctcttacatgatcaataataaaaaagaatcgtaagaaaaataccgcgtatcaacttcaccccacatatcccccgaaaaggatccatcttcattttgcagactgacaatatctgacataaatagtaagaaacacaagatccggtatgctttctagtttattaaattttactcttgtagttttagtatcgaactgtactaaaattttttctttctaagaaacatatcaagcaattgaatcataacatcaaagtattttgccaactgaagctacatatcctgataaaaaaaacagatctacaatagttaaaaaaattgcaaaaataacaaagcttcttctgcagcataaaatatttgttaatacagataacgggaccttcaaagtgaggcaatatgtgtgtaaggatacaacttgtgaccttatctacatcaataacatccagcttatcaaagagagccaacacctgcacagcacttagtgtatagaggatgtgcggatcatgtccaacatttccaccaaatcccccttcacaacaacacattttctcataagaaactatgaatgacactgatgtctaaaagaatataagggaacaaataaaacattgaagaacctgagtcatgctgacaactcatcaaccatgaaacaacctcatcaacatcgacagtatgaagctttcctagaagatccagagtggtcaatccccaatatgccccattcattcttagatgctccattacgacagattcaaagttatcttttctctggaaaccataaaaggacaacctattaagcattaaagaagagtttacaaagcatccatgtataaatgggtaacacagcacaccttttcaactgataatatatatcgaacatgtttctcagtcgccaactctcccatctcacgagtaaactattctattccaacaacacaacaaaatcagaaatattagaatcaaagatttaaaatgaaattttgcagtgcacccatctcagtaaagaggatgaaggatgtgggtgaaccaattccaattgaacaaaaaaatgaaaacttaccgaactccttaatcaatgtcacagtcagaatccagaagggtcgcgggagtgatacgaagtagaaacgctaatgctctattagtttgtgccaaggtcaagcgaaagcgaaccaacgctgttatccctaattaaaagttttattaaaacatggaaaatttcattgttgtcaagtcatcaaattgatgactaatattatagttaattttgagatgaaattcttttatactggtgtaaaaggataagtattttacaaaatctaccgttagattgaaagcttatatcatgtagattacatgtatcaaatttcacaaaaattcgaaatcatttgaaccctaattgatatttatatatatatataattaactgtatatgtatttctaaaatatgtgaaaattagactatttgatatcactacacaaatgattttggatttttgtgaaatttgatatatgtgatctacatgatataaactttcaatctaacgatgaattttataaaatacttatccagtaaaaagttattgaatggtgtaaaactttactataaagttttacaccggtgtaaaatatctcatttctaattattttatttgaattgactttcaaataattagcggtattaatttgtactttcgataccacggttaagagtaatgtcatatccttttgctatattttcctacaaaactttttagcttataaattattataaataaataaatattttctgttaaaacatgggcaaaggccaaacagaaactagcccagaccaatttacataactagcatcagccaataagactggagcaagaaaagagggaatgatgtcaaaatactccattatgtatacataaaacacacatgggagtgatgggaccaaccaactcccttcataaccaaattcacaactgagtttgagtcagtttgaatcagcaccttgcgaaatcctctaacaaattcctataacattctacacatttagaggatgttttacaggattggagtcgatactttgttagttcatactagaagaacgagaaacaatgttgcagaccgtctagcgaggactactttttctacttttgattggatatggattaaggaagttcctcctcaaatccaactctttgtaaaccatgacttgagggctctcacatgctatttcagttaatatgtccatgattttacttaaaaaaatcttagttaatcaatggtgctcaattgaaataaatgggttggtgttacttattttgtaatgttgcttagcaaattcttttttatttttgacagagttagcaatttttaacaatacaaaatgtcttcttgtgataaataatcttgattgaacccaacgactgatctgaggggtgggagtagaggagccttgccccctcccttaggatttaaaaattaaattttaaaaaatactaataaagaaaaataagtttttgaattgataattgtttttttttagtaatagatgatatctctattttaacacgttaaattaataataaatattattgttaaatttattatttattaaataattatttatttgaagttatttaaatattgtgtaatttttttaaggttattaaatattactcataaatatttaataatattatgtaactattgaaatgtttaatttagttatagttttttcttatatataagattcaatttaatttttcataattaaaaaattagttattttaaatttatatattttttaaaacatcattattaatgttttttctcataaatacatgttaatataatatcttttatgttatttggatcatatatatatgtatgaacaagataaaaatgattaattgtggtggagaaattttgattattgagtgagacattgatgattttcctaaaatatatgagattaggagggttaattaattagacattaggctaaagtaagttgtcttgactagaagacagtgaagtgaagtgaagcgcagcagtataaaagaggtttgtgaagtgagtgagagcggaagcagagaagacagaagaatgggttcaaaggggaagaagaaaggttcaccggaagacattctggaaaccctaggagacttcacgagcaaagagaactgggacaagttcttcaccctccgcggcgattccttcgagtggtacgccgaatggcccaacctcagggacccactcctctccctcctcaaaacccttcctctcccgcttcagctcctcgtccccggctgcggcaactcccgcctctccgagcacctctacgacgccggccacaccgccatcaccaacatcgacttctccaaggtcgtcatctctgacatgctccgccgcaacgtccgcgaccgtcccctcatgcgatggcgcatcatggacatgaccgccatgcagttcgaggatgagagcttcggtgcggttattgacaaaggtggactggatgctttgatggagcccgaacttggcccgaaattgggaaaccagtacttatcagaggtacgtttctctactttgttatttcttacgagttcatgtttttggtaacttagcccttttatttttgtcaggtgaagagagttttaaagcctgggggaaagtttgtgtgccttaccttggctgaatctcatgtactaagtaagtttccttaattttgtttcaccgtgaataataagagaaaaacgtgtgatacgtagagaatacaattgaaaacactaagaaggtgtgatggtgtttcaattgcagacgttttgttttcctttactcttattgaaagattcatggaacaaggttcatatgtggtacccacattttagactttcctttgtgtattagccataagaaaataatacttgaatgtgaatgatacttggaagagggtttgcacaaaacccttcctaactcctggacgtcttgctaaaaaagaaacatgctaccaagaagctatcctgtgttaccttaagaattaattgtagtgcacttggacagtgtgctttgttactctgcattgcaatgaaatgattttctggaactgtttttgcattttatctttttcattttttacgtgattggtttggtatcattggaggataaatatcactatttcacaatttccagatctacttttctcaaagttccgacttgggtggaaaatgagtgttgatgccatacctttaaagtcttctggtaaacctagccttcaaacatttatggtggttgtggagaaggagctgtctactttagtgcaccagattacatcattgctccataattcatcacttcattgtaattcaaaacaggtagactatctgggctatttgtacattctgtttattctcatggacataagagttttcttaaaataaggatttatggatgattaatgctacatctgttagtggtatagaactatagatagtattactctaggttattaatagagaaggggtagttattttgttaaaggttgtagggtttatgcagggaaggggaaacagagagaaaatgctctgaatattttgacattgatttgatgtgtgtaagttatgaagtactaatgcctatttgtacagagaattaggtcttatgtttatgtcttgcccccccccccccacatttgtgcaaggtttctggacttcatgaggctcttcaaaatgagaatcaaattcgtgaaaaatactccagtggctctgatatattatattctgtggaagatctgcaagaggagttgacaaagctttctcaaggtcggcgattgcagctaactctgggtggacaagggtactccactttttcttacagagctgtaattcttgatgccgaggaacaggccgacccatttacctatcactgtggggttttcattgtgcctaaggtgtgttttagcggagatccctttagatttttgttcatgcattccttctaacttcataacaagaaaaaaaaaaaaaaactcgcatggtatgctcatgaagtttcaaaatgaatcagtgatccttctctggagattcaagcacagtagttttaacaaatgaataaatgtgaaatagttattattggaagtaaagaaccattgttaatttgcttttgactagaatctgctgctgacaatttttttgaaactaggaaagacaatggacaattggatacttgttattttcaaattttctgattcttttttaatttctattcttagtagtctcaaccttgttcatactgaaaatgataaaactgtaattgttttgttttggaatatatattcagttcatcagttgtactatgctgtgttgcatataggataagattatttgtttattatagagttagggacactggtttgttacctggcagatatggagtttctagtatttctcaagttcttcattttttgtttttttcatctgatttgattttttaattttttggattgcaatgtgcatcaatatgcatttatggagctgattccacaggatttcagatttccttttttttatatctatctgcagtttacacctagggcatcaaattatgcagtaattctgtttgaatttcatgattgaatgttaaatctcagactcgtgcacgtgaatggcttttctattctgaagaaggacagtggatggtggtcagaagctctaaagcagctcgtctcataatggtactatgctattaattttataaaattataatttgttcgtattttttgtatgccaaattacttttctaattgaagcttccaagcaaatccatgactttaggtttacttggatgccagccattcggataccagcatggaggagattcaggtagaacatcctcataagttatgcttcatggacgtgccattataacaggttaaccatgttgctttttactgaattgtgtctgttatcccttttcagaaggatttgtctccattggttacgcagttggcacctgcagaaaatgagaatggagctaaaataccgtctgtatcttgtaccagttgcatttttgtgatttttcatttatttcgagcaatgttaacataaatgttcattttttctctcctgtttttctattcatgccaaaacattcaaacatgttccattgtgaattacagtaattactatactgtaaaccattttttttcaggtgctgttgtcatacttatagcatgtttggttcagattatttttgtggaagtaatatttttttgggccaaaatctctttctagaagttggcaaacataggctgaaccaaacacacatttaaacactatgaatttcagttttttctcacaagttcttgaataaatgtctacagtttcatgatggcaagtgatgggatcaaggagcgaaacatcattcacaaggtttgtaacaatatacataatactgtctctattttattattttgatctagtgaactctctgtctgttaaggccgtgagattaactctagtattctgcaagaaacttcattcttaacttcttactgagcttctttttatggtgtttagcccttggttccattgttcattagagggagttggggtcctactgggctcatttcttattatgtttatttttttatccacccgctttattgatctaagagtaatttcacgtctttattctattaagttttttgaaatgctgtttttatcaataagaaacaaaaatgtatttattcactagtctttttgcttttgtgattcctactttttacatggatgctcattctcttgatggctttgcttgatttaaaatgatcccaacattctcattatatcatttatgattatgtgttttgcaggtcccatcttcattaactggatcaattattgttgaagatgtaatttatgaaaatgttgatagtgaagtcagttgtatttttccttctagagagttggtgtttcgacgccttgtatttgagagagctgcaaatttggtgcagtctgaagctctgctaaaagatgaacagtcagctaccaaattggttagtgagacagggaggaagaaaaacaatgcatcttccaaatctagaaaaagtggatctcagagacacagtattggtaattgttttcctcttgcctctggtttatttaaaattactgttcaactcctgtaagtgttgcttcaacattattgtcaaatcccgaatttgttaatttactgttgtatatcataaagtttccatttattttatatttttgtagaattggttttgaaccattgaacatgattgaaatgtgtgtccaaattaatcttagctgtatattttacattgggatgtgtgcatgcctacatggtatgtgaaatttattttcaatgtaaacgtaacgaggcctaagaggaatcatctcttttaatttatccttcattttgctaatttattttcttttaaaaaaaagttgtagacagtgttttgggttatctatatagtttttttgaagcctttctaatgctgaaaaatggttttggatgaatatgatgtttaaaaatggtttaacagaaacagaggatttttacagttttgaaactattcattttctagttttcaatatttgctcgttgtttataactcctgccattgtaatatttttttccgatgttgcaggagcaagcagccagttgaccgtctatcatggctatgtagctagttcttatcatacagggattatttcaggattcacgctaatatcttcttacatggaaaatgtggcatcaagtgggaaaatggcaagtatttctgacttttaatgtgatgcatgaatctactagttccttggtacattaaggactgtagtttccaataatagcaaattgtaaatacatggcaaattaacttgtctcactttcttcagatgctctaaaacattctttcattcattattgctgatgcattcaagtgacatatctcaggtaaaagcagtaataataggtcttggagctggtttacttcccatgtttcttcacgggtgtatccccttttttgaaattgaggtaatttatattttttttcctgttgtttagggaggggatataattagagttcagatttagtccctaatgatttattcttctgaatgattcatatgacatggtttgataataatttttatctacagactgtggagttagaccccatgattgttgatattgcaagggactacttcagtttggttgaggataaacgcctaaaggtagttaaatatacattcatgtcttcctcttgaggtgttgtgggggcgtaaatctaaattaggactaaccaaagtaaagccagattgctaacttacatcaaaggaaatatccacatgaaacagtaactagttttaagaaaagattctccatgcctacttgaatcatacaatgttgactcttgcaagtaattattttgatttcatgaattttttttttttttgctgtttaaacaccagtttaaaatatggatggcaataaaaatatggcaactgctgataaagtgacttctgtttttatttgttgggagggagaagggctgtgtgcagaatactaagaaccacaatataatataagaatttgttgaattaatcttgtgatggggtgatcacaacattggctattgaatcttgttgctttggagaatccaggtgcatgtagctgatgggatccaatttgtccgggagattgacagttctggagcacctcagattcatggaaaaagttcaactgcgtctcatgctggtgtagaagtgacaaaagttgatataattattgttgatgttgactcttcagacccaaggtgaattgaattatgcatttaagacattaaactatcatataatggctaagaaaaaaatggtattagggccattaagggattagaaataataatatcattatcttctatgattttaaagaatcctacttatttattacattttttgtacagctcaggattgacatgccctgctccggattttttggatgagtcttttcttgagaccgtaaaggataaactttcagaggatggtctctttgttgtcaatttggtgtcacggtcccaagccattaaggatatggctctctcaaaaatgaaaaaggtaaaaacaaatgagtgcaataatatttagtttggactttgatttttgatgtctgatgctgtatcttgtttaatcagatatttattacaaatgtgtttaaaatctctattttttttccctctcttctctttgtacaaaactcaaatgcagtttcttaggtgctttaggtattgtttatccaatcatacacaatcgggaaaatttcatttcactcaccttattcttgctaaaaccggtgagcttttcaaagaaaagtactccaaattttgaaggtttaaccaatatttataaaaagaaaaccctcccaaatataactagttgctgggagaagtagaaatgattatggttgttagttatttctgaatttataaaactttacacagacatcgggagacaaagtttagttagatctaccattctgctacacagcattagagtactaatctaatgaaaaatgtccaaatgaatcttttgtgcttataaggggatttagaattccagagaggctagaaaatggagactttaggacacaatttataattggtgtaactcggttacgaaacattagtattttcaatgaaatatttctattactttaaagttgttgaacccttgtttgcatagatgctgtccttatatcttgtttctaaaatttaggacttatcttatatagcgaattgaattgtaatcctttaatataaattcataggtgctgactgctgagatcaattctctctagtaattcttattattctgaagagttcaagctggtatctgagcatatttcctttgtgaaatggcctactgtttttaacttcacaactgtaatcccaatatagtacttagttggttcaagtcttcagattggaaatgttaagatggatgtacccataggtatcattcctgcattgtggcatagattgggatagtgggatgggtgctatgttgaagattacaaatgctatatcaataatttatgctttacgctttattgtttctgtattaaattttaacaaaaaaattaaacttattccttctagtctgatattttatttgtagctaaaatatgttggttatttctaataaatatccaaattttgtgtttgctttctaataaatttgttcttcgttttttcttcatgataaaataacaattttgtttttggtctctgacacatttttttagtcccttataaattagcaattttgtgtttgctccctgaatttttttttttcatttgttattagcctttttcaaaacaaaactcaatgcaaagaaattttttaccaaggagcaaacacaattcggatatttattagtaatcacaaatatattttagcttgtttactaacaagaaacttattattatgttgttgactatataccctggatgctgttgttgtatataaatatttattcagcataacttttggttttgttgattgtggaagatatttaacaccgtcttgtcaactgaaagttatgtttcttttttactgtatttagagtctagttgttctgtaatatcactgttgtatttctgttgtcttacataggttttcagccacctcttctgcctccagcttgacgaggacgtcaatgaggttcattttgctctcaaatctgagtcctgtattgaggatagctgtttctctgaagcttctcttaaacttgataaattgttggagtttaaacacccggagataggtcaaaacattatcaatgcgaccaaaaagatcagacgtttgaagtgaaacttgctctccttccttgccgtcgttatgagcatgatactcttcgtctgtatgatgtgaatgcttgctatctcaaatgcggaagtgatttcagccaagtgtttgtcattgatctgccgattgaactgtctagtactcatcagtagtacttactggttgagtgatgtataaatgacttatgagttatgatgatattgtagcgcattcaccctttatttcatatgggtgtctgcttcaacgtttaagggttatggataacattccctggaataattcgctgtgaatactatcctctaggaattttccttcgttaaggttattttgactagtctttaaaaaactcactggaaagtttacaattcttggaagactaatgctattttcttcatcttactaatctttttaatactttataaagtactaagtattaagtaaaatagtgaatgcatttaatgttttggaaatataaaatgcatttaattcttttgtatttagtaaatagaatgatttgtagaaagatcttgaagggaagatctaaatttatccttcctgaaaatagtttaaaagcttgtccctgtatatgaacaaaattagtattataaatatttgcaactctaggaaattgctttctgacaactattggaaaacctgttttggtgtggagtgaagagttgccgtcctgatgattttttaaaattagttctaatatttttcgttttatgaagcattatgttggaagtacttaaaaagttgatgaaatataactgtttatttttagagtaaatagtctatttatagtttaaaatattttcactatcgtttaattataaatcatgtatgatttattgaattttataataattacttaaaaagttacgttaataacaattataaatcgtgtatgatttattggattttagatcaaagaacccatggtatcgcatgcacaaaggagaatcattgatcagcagagattatttatttgctgtccaaagtcaaaagaccaagtattatgtactaaatcatgacatccagcgaagtgtcatacatatacacaatagggtgaacacaattaaggaccatttgtggtcagtaacattgtccagttggttgactagtgtgaacctctcgttttagaagctgcttacagcctcttgaaagaaaccatcactcaatggtgttgtgcatcttgcctccacagacaacgttttcacaacacctggaaaggggtcaccaccgaatacagagcctgatattttgatggagcaatttcttttcccttggcaagcctgcaaaatatagaaagtatatatcaagagggtctacaacctagaaaagttaggttttgtcaaccatgcgcacaagtgttttgcctgatacagacatgtattagtatggagtatctccacgctgaccgatgaatcatttcattcctcaataaatataatcaacccaaagtttagaaagttattttggacccaaaaccaactttctaaagatgaattgtaaaggggatttgtaatcattatattcataaaattgaatgacaggtaagttctttgcttcagttttatgtattgggccattcttattaggcgagttccccccttttcttcttttggtgaaccgcagaatatttttcatcaaaacattacaagcctgcagctaaaaagacgcataacactacagccctgttttttccaagctgcatatcaacattagccaagaccttacacttaacatacaagttctcatcacttttctagtgcctacagaaatgtttaatcagtgataacaataaatttgtaatcgtaatacttaaacaaagtatagggttaagcattttggaaaatatcttgcatcatcacttttatcgaagtccacaatgccaaaatcatgaggagcttttgctttcttgcagagaactgtgtccccaattcccccccaaggtaatatagtgaagagtgaaaagctacccaatatagagtttacctcagaaactgtggacattgaactaggtacatggcagtttcctctagaaaaattctgaaactacctcctggagtaccaaagctagcaaatgttacggaagaaattgtgtgtccttcttgacaatgcaagtgcagttcaggtatcatattatttgcagaaacttcttcaatgagatctgcattctccaactttttgcaaaggtggatagttggattctgacacttgagcacatattattctggatgaatgtaacttgactgaaatttcaaagggatttcctccagtttcctccaagatagtaagtaaattgttggttgctttcaaccatgatcatggcgcatggaacctggagattgaccaataactcagaagttaaggaaagtgcaatgataagtatgatagtacaataagtgatgctgtattctcctaaaatatctttacaataattctttcaatactttacaaggaaagttttaaattaaaaagctgatgtatttaatataattggaatattaaaaaattcaatattttcctaatttagtaattattaggattggttaggagaatttaagtttttcttgtaaaatgttgtacataaaggtgtaaatcaacaggagacaaatgatgctttgagcgacatttcataattaatcgataaagtcgtttggagtcatatgaaatcatgaaaccaacagttttagctactttgagactacatacaaggtttgggttggttttccacaatttgttgaacacttgtcggaattatatgctccacgataatcacagacttgttgacatccactttttggggaaacccgagtccagtatcttcctatatgttgaccattcacccaagcctgaccttttcccatgcttttcaagtcaagagcaaccgaatctctgccaccagggacatcaaagtatgtctgcttaaaataaataggtgttatttttaaattgttgtgttgtgataaaaaaaactatgtaactcattatccggatgctcctactacatgaaggtaagggaaagagatattgtacgcagtcttatccttgtatatacaaagaagttgtttctgaattcgaataaaaaagaaaaatagcattgggaaagaatgaccagtgggcttaatagcaccttcataaaatctcagtagtgtatcatgattttagattcactcactccgtagttgtgcgttggggataataattacaataaatagataattgaacaatttcagaggcaacacagaacaaacaaatgtcctgggcatatataaaatattcattccaaatcatctgctttccttaaagaacttcagcatgcgtataaatttataatcatcttcttcattgaccgtacactttatattattcatgaatttgtctactgtaggaaatattttgtagcttaaacataaatggtgcatgtttcttgatcctgtgttaatttcatggataagtaaaaagcagtctcatgtctctaattcctccactcaatcaatctgagtattgagctatatctacagcttgttctgaaattatttggataggtgggcttttggctgagcttggattgtctcaaacagctgcaacacatttctatgccgacaatactagtgtaatacaaattgctactaatctagtttttcatgagcacatatttagatggattgtcattctattcggctattcaggaggcattggagaatcaagttatctcctatcctcttgtcacctagcaacttcagcttatggatatctttatcaaggctgttcctcatccacgtcatcagttatctgcaaattgatgcttcctgaccagccacatcaatttgagcggggatgtcaataagggaactagtcattattattgtttcctgtatatattaggaatacgaaccaggtcattcattgtactttgtacacaattagacttcctaatttaggttgtacaaatttggaattagaatttttgtgtcactaacggatgtaaatgaaacctctactatatatggatgagaacagaatcaaagaaaccaagaattcaaaatttcttgacaccttggacttgaagcatggacaatggatggccattttacctcgtgctttgttgaaatgagcattttgttagagaaatatgataagtgagagaaaaaaaagactttaaataatattatcatttattttgacatgaaacaaaatgctaaccaaatagtcctattaatactaatactagattccaaatctaagtaaataacaaaactataacttactaaagaaacgataaaatctctaagaataaagtaagattcctaacaagctaagactcctaaaaattaggtgacacaattattggtataacatgaattatcctaatcattatgcatgattctcgttttataaatattttgcagatattctggcatgcttaaatctagctttatctagaaaaaaagagtgcaactagtatcaaacttctgccttggtcatgggggaaactaataccatgtcaagaatcaactttctaagaagcttaagctcttatggaggttcatgagtgattttatatttataactaatcaacgtaaataacttataggctcttttccttttctattttctttcactgtacaacagttcttatagatatatcacttcaacagctcaaagttaccttgtaccatgtaaatgtggatgggatggcatcaggggccaactctacccattcagaattttcattctcttcactgaaaaatttaaaaaactcaccctaaagcccaacctgggatacaaatgaataaagtggagttagtatttttcaaattcctcggactatgaaaagtacaatctcacaagtatagaaagtgatgatatgaagatgaaaattatagaacagtacaaatttagaataaagataatgaaggtgagacacaccaagaaaacatgccattaaagcagcattttaagtttctttggagtgaaggcagaactagaaagaccaactgacattgaacaaataatcaaaactaagaatactttttccaaatttatatcttttaattaccatggcaaggttgaaatccttaaagacaaaaaaatctcaaataggcaacttaaacaacctattcctacaagggcatgtaacccaaacttaagattcaaaagcctattttatacaggaacatagaatctcaatccaatttatactacggtaagatattgttggaattaggaatattttaggagataagagctcttttaatgtttattttagcaagtagcctaggtacttggtataggtaggttcaatgcatcttaggaagtagtggcatctcctttaaaaaaaaggtagtggtatcttaactattctcttctaaattattttagaattaattatctttgtaatactcttgaacataaataagctcattcttctggaaagaaaacacactcaagtacattgagattttttgccccccattttctcacatggtattaaagatcctaatctggggagagggggtgtttctgcaaaaaaaatggtctctgtagaaggtctgattgggctcttgaagctgtcagacgtccaaaaattctagaattctccagcaaaatttccagtaattgtcataatttccgatgacttttctgcccactgtcagaacttttccctcaactttatctgcctgccatcagaatttttctggtatagctaggtttaatgcatcttaggaagtagtggtatcttcatggttctctggtaaattgtttgggcgttgcttatctttggaatactcttgaatataaataagtccaatctgcttggtggaaaaaacactcaagcacattgagaaaaaaattcctttctcatttgcttacggatattgtaagacactaagaccaaaacatctctaaagcatgaattcccaaatagctcaaaatcaagccctgattggattacatataatcaataattactgcactcatccttttgcagttcttatttactttgacaaaagtggtttattttttaatacaaaaaaattgaaatgtgtcctttgttgctgaccctaattattttaaaggttaaagagccaaaataacagaaatgagtatccatatcacagagcacacacacacactggagagaataagagagtgaacctattgaatggaaatacacaaatgtttggcttcagtccttacaatatttatactaactataccggtttatttacaaagagagtgcttctggagtatacctaaatagcttatgtacacctagtacttacactatctatggactaactaattgactcaccctagaaaatgtttgctagttggtcatttgaattcagaagaccaattgtaatatgtccagattccagaaggtaccatgtagaaaaccagagaaagagaaaacatgtgtcttgggccggtgtatttactgtatatttactaactgtacagatttacagaatacatctgtagtgtactacatcaaatagtattttcctctaaaaaccagctaatatttcatattgttcttttggatcagtttagggtttaaatattatggacctgataggtccataatgattttgaaagatctatatctccattttcgaatcctgtgatctttattttacctctaatccctgctccatccttctcaagaaaagcgccacaattctgtaacattgtttcaaataagaatatatgtatcatcagtaatctttatccctcaattgtttgataggagagtaagttaaaagaagtagaagaaaatagttataaaagtcacaaagcatacagatggaaaggaatatgctgttaatattaatgttaacacattggataatcctttgtcatcaattcactaatgaacgagcatacaaataaagaaaatcatttaacaactgtgttgccttaattgcggacacccttggcctgccttaatttgctgtctcatgcatctttattctgataggtgtgacgggtagatatagacatatagtcctacattgactaaaaataaggctaaattaatgtttataaaatttggacaatcctcgtctttaagtcaattttgttgggtggaatttgatcctaaatccaaattctaataagctgcaataaaagaatggactaatgaaactggttaatattttatactactgctgaaaaaaggaaaatgtaagaaattgaaagcaaaaaccagagttagaatatgcatagttcatattttgatgaactagggctgaattcttacatttatattggattgattcaattctgttttggtggcctaatcagaccaattttattattggaccaattacgcaattgacccgtaatgacctggtcaaatctgataggttaggtcaccaaatccaggttgaactggtccattccatctggtttaaaaaaaatgaaccatctctacaatgttgttttgatgttttattattatcaattattattttggattttagaatataaatgaacttttcttactcaaataatattagttatatatttatatataatagatacatatataattttagatttttaatatttattaagtcaaatcgagtcaattactgatccatcggttggaccagtaatccattatctcgactgggtcaatgatcaaactaaattttacaattatacttccaaaacattaaattatttatatctaagaaaaatattatgtagacataataagtaacattacgttcttcaataattcttactttgtcgttactaataaatctcttgtctaaaggaactactttcataaccaatgatcaaagaccataacagtagaattatgaaattttacacaattgccaaacacctacacaacacactatacacaattttaattgtatccttatgtataaggttttggcattatgcataaggatacatgttaaaaatatactaggaatttcacctgcaaacccactgtttgagttaacagtgttaaataaagtggtgcacttttactttcaaattataagataaatcctttttagattgagtttttaaataatttgataaataaggtgttaaggatcaacacaatgaatcgataaaattaacataattgatagatgattgaatttttcaaacataacatgttaacaaaaatttgattttgtaattatgtatatgaaaaaaaaatattaagagaaacaaaatcacttctactataaaataccttactcctagaaaaaataaaacaatatgcaagtgtgaaatactatttgatcaaatccaactcctacataagtaaaaaaaaaaaaaaaaaaaattaagtagtacaaactttacaaagttgtaattacgtaagctagctagcattagaggatgcaagaaatctcgttgcaaagtaacagaaaatagaatagctaaaagcgtgaacagcaggattcgaacctgcgcgggcagagcccacatgatttctagtcatgcccgataaccactccggcatgtacacaagactgaacaaaacttttcatattttataattattataaattacagatatacaaacccaaaaacaaaaatcatctgaaaaatttgctattattctggaaaataaaattggtcgggaaattttcagtctcagctttgaaattttgcaagggaatcgaacacggttgtcgatcccttagtcagctcctcgtcacttcattcgttccccagtgacttattatttcgatattattttcttgagaaaatttcactttccgggaaaatcactccgctcctcctctccctccgaaaaggtaagcaagctccatccttcttctttttccttatttttacagtttcggagagaatcattcgattggttaatcgcttggttaaaatcgtggattgaaaaagcaaaaaaataaaaataaaaataaaaattgaaacaacctgcacgatcttcgcgttctcgatgcaatcagaatcgctatcggaaaaggttttggtgctcgcggaggaagaaaaagacgaggaggaagaagaagaggaaaaacatcgcgagagcgtcggcgtagagattattggttaccgatgattcctcccaggcggaagaaatggaccgaggcggaggagaaaaccctaatcgacatgtacggggagatggtggcggacggttcgctggcgaagatgcggactcgggagaagaagttcaagccgattgcttgtcacgtgaattcggtgcaccacgtgcgcgatcccattgcgtacccttggcagtggagttggaaggacgtttcgacgaaggtgcagaacatgcggcaccagtatttgcttgtgaagcagaagatcaagaggcctgagttttcggggtccggaggaggaggggattgtgatgaggggagtgagtttgattgggtggaggggcttactcattggtctaacttccttaggtataaggatgtgtttggggatgttgcacttgttgttggtggtcatggtgggaatgagttgatggggattgaggatggggatcacggggatcgtgatggggataatggggatgggtttcttgctggtggtgggggatggatatggttgagtttgggcagatgggtcattctggggatggggattttggggctgctttggatggggtggacaatgaggtgatggggttggaatttgagattgagggggaggaaggggaggtgaattacaatgggagtggtgttcgggagagggaggatgctgcggagaatggttttgtgtttgaggaggaaggggaggtgacggggtcaagtttgaagaagaagaggaaggtggtgaaggggatggagaagaaggcgtggcgaattcttgctaaccaactggggcagttgagagagatggagacgcggttcgagcagcgcgaggtggagagggagcgcgagaggcagaggagggagaatttgcgagtggagcttgataagcagtgggaaaggaagcttgaagagagggaaaaggagagagaagagagggagaaggagagggacaagcttaggaggcaggggatggcggagtgggaagccatggaaaaggaaaacggagatatggaaaggaaaaggagagaggaagagttgattcatgagagggaatgggaggagagaatgaactgcaggaggctggaatggaagaagagggttgacgagatgctgagccagcaccgagcagaaatgggccagatgcagactcgttttcttcacgagcaacaaaatcttactaaccaattgcttggtatattctcgcagtggcctgcccaacctgctggcctatctgatcatactagtgctagcaaccattatctttcacaaatgatgcaaaatttgcatcatgtgaatgttcacagtgacgctagggttgagggagataatcaagaagatcaattcattgttgatggatgatgtatctctgccattttgtttatctgtgctggggagtccaggaacatttctgttacaagaagtggcgaaaagtgcatataattgttgaatgcattcttaattggtatttcttcagttaggtattgttgtatactatgtttagtttataatattttagtgtaactaatcgatataaataatgctttttgttccttgtgttcgtctgtactgaactatgaaactcagaagctgcgagtgtaaaggccacattttttgtccaatacatgctttaatgcttctattcaaaccatctattatctgaagcctatgaaaaaaatattcaaggagtaattttctgttggttctttaatgtgcaattcaattcattgtaatgctaatgaaacaacagatgacatctaggcttattcaccctttgttattgtttcctgctatactttagctaagttcatgtcctatattctttccaaatattctgctataagttaatccttgccttgttttaacccttatgcacatgtcagatgtgttactgtgcgtttggtaaaatgaaaatttaaagaggttcttatggggtaaagaaattgagagatgtatttagatatacatttaaatttaattatcctttttcctcacatttttattcttacaaagctcacctatactctggcatgttctgctgtgtatctttagttactggatcttcttcatatttgattacaagattatagtaggacatatgaatgaagttgattcataattttaccataatttttatacttttcttttcttttcatgttttgataaatgtttattttattcaatattaataattggtatacacacatctcatgccgtaacagaaatattcctgtatacccacctgttggtacccataccaatgtgaagataaagataatgggggtgagtgttcgcaagcaatgcccattcacaactttcagttctgtttactagagtttcatattctttgttgtttaaccacgagccataacatttacagtaactaggttcaactatttacattgtctttcacttgcaaccatgtttatccctatattgatttgtaattatcaaatgttgttgcctaatgataaagttggtccacatattccaattaagtttggataaaatttcttaacaagaatttattggtgaagaaaataaggaagtagaatgagtcgactttcaactaagttaaagtgaatttatacaccttaattttaatttttggagaagttagatgagagaaaaagttcagggatacaatactttaaacttacaggaaaaaatgattcattgatgttcacaatttcttctgaaagtagacttacatcatggtaacatgataaaataataaaattataccaactctccaatttccgatcaaattgttgttcgtgggagctttactttgagaccatgtattcttatttgagaacaattatgcatactaaaagccccactttgagaccatgaatttttaaattagtttaaagtgatttttagtatattatgtttaataattatttcacttttatatattatgtttttaaaatttcattatggtgttttatgttttaaaaatatatttttaaatttttcgttaaaaatgttagtgtttgtcaatgttttaaattttaaaacagttaagttaatatgtgatgactaaaaattgacactgttttttttttatttaaaaataaaaatcactaagtaaatgaagaaaagatatacttaaaatcacgaacaataataactttcactatgatattattattattgttgttgttgttgttgttgttgttgtttgttgttgttgttgttgttgttgttgtttgttgttgttgttgttgttgttgttgttgctgctgctgctgctgctgctgctgctggtggtggtggtggtggtggtggtggtggtggtggtggtggtggtggtgttggtggtggtggtgttggtgttggtggtggtggtggtggtgttggtggtggtgttggtgttggtgttggtgttggtgttgttgttggtgttggtgttggtgttgttggtgttgttggtgttgttgttgttggtgttgttgttggtggtggtgttgttgttggtggtggtgttggtgttgttggtgttggtgttgttgttgttggtgttgttggtgttgttgttgttgttggtgttggtgttgttgttggtgttgttgttgttgttgttggtattgttgttggtgttggtgttgttgttggtgttgttgttgttgttgttgttgttgttgttggtgttgttgttggtgttggtgttgttgttgttgttgttgttgttgttgttggtgttgttgttgttggtgttggtgttggtgttgttgttgttgttggtgttgttgttggtggtgttgttgttgttgttgttgttgttgttggtgttgttgttgttgttgttgttggtgttggtgttgttgttgttggtgttgttgttgttgttggtgttgttgttgttggtgttggtgttggtgttgttgttgttggtggtgttgttgttgttggtggtgttgctgttgctgttgctggtgttggtgttggtgttggtgttgttgctgctgctgctgctgctgttgtcatcatcatctttattcaatttaattacttaataacgataataattacattcactaattattctcaatcacaatgggtaagggtccatttttcttttgtcgatccacctttcacgtcaacgcataaagactgttgtcttgccctcacttttgtctccattgcaacctccttatacaactgaaatttttgcctcacctaacaacaactgctcattaccatgatggcagtagcgcgttgatgaaggcgaagaagaatactgacaatatccagttgtagatgaggtttgatcagtcaagttagatataatcatcttccaaaaaaatacaccgtttgggccctctttgtgctacttgtcttcgctcaacccaattgtagatgtcaactgagaaatcctctacttgtccaactcaaacgtgtacaatagtggaggttttgctcgcagatctcacaaagaaccacatggtgacttcctcattcaaatatggattaattggggagttaggaccatgtttttgtctttcgccgaagagaactcttgctccgatctaccttgcttatgtttcctatagcataattgtgtgaaaggttttggtttctagtgaggagtatacagattttcggtggttctaacaagattatgtgttgacgtcattccatatatgtgatgctgcacttttttttttacctttttagatctagaagaggttgaagaagatgataatttttttagttatttattttttaagaataaaacaaagaccgtggcaatttttagactccatcgtgtaaaattaattatcttaaaatgtttaatgctacttttgattcattatattttataattgttttactttgacacaattttaaaatttcattcttgtcctttatgttttttaatgtatcattttgatccttttaaatttaaaaattatcgaaatactaacatttctaacgaaaaattgaaaaaaaaaatcaaaatgatacatttcaaaaacataaaagacaaaaataaaattttcaaaacttaattgtgaaagcaaaaataatttataacataataaactaaaggggaaacgaaaaacaacaccgtgattgaaaataattatttttctaaaaactctttttaaaaagcagcaatagaaaagtaattccaaaattatgactagcaattgcaaagacgtacggagaaagaaaaaaaaaaaaacagttatttgctgatcattaggaaagaaaaaaacagaaaaaatgggttggtataagtataactataaggggagagtcagcagtctacttagacatgcggtgggtgcacaccacaagcccagtcagaggaaggaagcatgccctgcatctaccttaatgtaccttccctttccaattcatttggttggtgagtgttgaaggccctgccactgtcatgactattggcaccgccactcctcccaactgcgtcgatcagagtacctatcctgactattatttccgcatcaccaacagtgagcacacatgaccgaactcaaaagaaaagttcaagcgcatgtgtaaggtatatctctctctcatttagcctatctttatttcattatataatatgtatgttgtttattttcaacatacatctttgatttgattagtaatacatactaataatacatgataagtcaatgattaagaagcgatgcatgtaattaaaccaagagatcctgatggagaatccgagtgtttgtgcttatatggcaccttcattggatgcaaggcaagacacggtggttgtggaggtaccaaagttgggaagagagactgcaactaaggcaatcaaggaatggggtcaacccaagtccaagattacccatctcatcttttgcaccaccagcggtgtcgacctgaaaagctactagacatgtgctgaatatggtaatatgtcaagtgcatgtgtgctattcatcttggatcagatgagtaacaactccatagaaaatggacttggcacaactgttgaaggtcttgaacggggtatgctatttggttttggccctggacgcactattgagactgttgtgctctttgtgtcattgtctaatcatatatattgtatttagaaagaccaaccacaaatccttactttctttcttgttagagtttaaaaaatgtattctttctttcctcatgcttcttttttatatcagtaaataagaacgtatcatattattattaattcaattaagcttacagacaatttatctatatatacaattgaggaccagaagtcaagaacttttttattagaaactaaatataaagtccaaaaattaattttaatttttaggaactaaaatatatttaagtcgatctttaaaatttattataaaaaatagacgtttatctttccttttaagaatgaaatgaattgtaacattattactaaacgttatcaaagtcatgagatctcacatctttgaatgtttatcccacttcaaaatgctggctctaaaaacaagaaaaatgaaccagtcatttggatacacaagctcaaactatacatcatgacctcaagaaagaaaattcatgactcttgcacattaaaacagaccacaatctctactaccattaaagaatcatatccttgatgaaattccaaaaatagaatggtggcaaaacaactttgtattatgtcaagcaatatctctaatagagcattagcatctaaacgcaatgacaccgaatataattgctctacttactactaaatcccacaagtccaagaataattttaaatcagatcaagttgcagattaagagataaaagaaacatattatttatttttcaaagaaaagtcatacacattttcataaaatctatggcaataatattacttagttgaattaaagaaactcaaattatatcaaactaaaaaaaatgcatataaagataatttatatttattcgcatctcacatcctaaaatgacaaatgaatataaatataatttgcaccaataatgcaattatcaaaatccctaattactttataagttcactactgctacaccttaggacagaccacaatatatgctaagagtaaagaattaatcacaatttaggggtgaaaatatccgcgtccactcatttgatgagtcatgttgtttgatggattcactccactcatttgatgagtcatgatgttgtttgatggattcactccactcatttgatgagtcatgttgtttgatggattcactggtaatatttgttgcatttcatgaacttgttgatatgcaatatcagaatcaaatcccctcatttgatgagtcatgctatttggtggattcagcggcatttgttgcatttcatgaatttgttgatatgcaatatcagaattttcaaatccactcatttgatgagtcatgttgtttgatggattcactccactcatttgatgagtcatgctgtttgatggattcactagtaatatttgttgcatttcatgaacttgttgatatgcaatatcagaatcaaatccactcatttgataagtcatgctatttggtggattcagtggcatttgttgcattacatgaatttgttgatatgcaatattagaattttcaaatccccttgtttgatgaatcatgttgtttggtggattcagccgcaacatttgatgtatttcgtgaacatgttggttggcaatatcagaatattcaaatccactcatttgatgaggcatgctgtttggtggattcagcggcaacatttgttgcatttcgtgaacttgttgaatgtcttgatctggatgaggaattgaattatgtggatcaatgtgatgaggagcgctatttgtgtcatctaaggttatgtcatgaatgctttttcttgtttttgttgacgatgaggcattttgacgattgaagtatttttgagcatgactggcaatttgagttgaagattttgttttaacaacatgccttgaaatttttgtccacgctcccttcttatatgtttgaagcccaagtaaaaacaacctaccattaaaaaacaaatatgagatgaaaatttgataagttttagttcatttgagttctataaaatacattaaaataatacaatccaaatgtttgataagcaagatttttcacaagggattttggtctttctctataaatttattaggaacaaaatttgttctgtgcacgtctaaacatttcaccagaattagttgaaaagtaacagcaaattgagaatacaacatataacagaaaaataaaatattaaaaatccaaacaatgtaatatttgtattcttcaatactgagaacacttatgatccaattggaggctagtgaaaactacgaatcgttaaaaaaaagttgatatataaccaatgaaaacaatatgctcaagtagacaatgtgggacattttcatagaatattcataaagcagttcaatctaattaaattaaaacagaaaaaaataaagaaagcaaaattatttattagattggattagatttcagagtttattttgaaaatcaattcatttattatattcaatatatatttataaagaaagtaaaactataattttagattgatccaattcaaataaattttctccttaaaactagtttgatccaattcataatgatcatagtctatttgaataagattgactaaaaataaaaaatgaaaacagatagcagatgtccatactaaaaatccaatccaaaaacacccaccatttggcttttgcaatattatccaaaaattacaacaacgttaaaagtctacctgtgttcttcttcagtccatgcctcccctctccctctcttgcgccgaaccgatgaacctgcatcattctgcatcatggaaccaccaccaccgttatgcaccagcgcctcaactgggtggctgggcaactcgaccggagccgacacaaactggttcacgtggtgggccaatgtgtgatggtgctgggtgtcctccgccagaggaacctgggtagcaacgttcagcgatttctggtggtgttgggtgtcctccaccagaggaacctgggtagcaacgttcagcgatttctggtggtgttgggtgtcctccaccagaggaacctgggtagcaacgttcagcgatttctggtggtgttgggtgtcctccgccagaggaacctgggtagcaacgttcggcgattcctggtggtgttgggtgtcctccgtcagaggaacctgggtagcaacgttcggcgattcctggtggtgttgggtgtcctccgtcagaggaacctgggtagcaacgttcggcgtccaccatgcatcatcgaggttctgccacggctcggtgtcgaaatcaaagaactgagtgtattcataaacctcatcattactcccatcgttattatgttgctgaggaaacccagacattgttttttacttttatcagcttcaaactctcaagtcaatggcatttcttttcgtaaacacgggcttcttattcagagcccttacgctggtttctttgaaaatttgccgccaagtcgcatttcatttaattagtgtttttaggagccaacgtctattgatataatagataaataatttatcttctctttttgaatttgaaaatatttcctatgaaaatcttatcattttaaaacttttttgaatttaatatgcaactagataaattgatattcagttgaaaatttaattttttttgtctttcaaattgcttatccaaagataacaaaaaggtttatcttaataaatttacttatataaataataaataaataaagtggcggttttttataatttaatttgattaaaactattaaaattttcacgtaatgccttcatgttaaattgaacagaaagaatcacattaaaaaattttaaaaaaaaactaaagaatcgtgttatggcatttaaaaaaataaagggcttgattgaagctttccaaaatagaaaaccttattaaacattctacataaataaagtgatcaaattaataattaagttattggttaaaacttaaacttaaactttgggggataacagttcattaattgtttttggagcgaaagatacggttgaaaatattttatcttctttggatttgaaaatatttcctataaaaatcttttaattttaaaaaaatttaaatttaatatactagataatttgatacacggatgaaattttaattaaaactttttaattagtgttttttggagccaaagtttattggtataatagataaataatttatcttcttttttaatttgaaaatatttcgtatgaaaatcttatcattttaaaacttttttgaatttaatatgcaaactagctaatttgatattcggttgaaaatttaattttttttgtctttcaaattgcttatccaaagataacaaaaaggtttatgttaataaatttacttatttaaataaacgagaaattatagtagtacatttttaacatgttgttttaaacacaatattgattatcagttaaaatttattagaagccacaaattaacagtcttacttctcatttaaaaactctctcaattttttggttttcaataaattttaattaatactacatatgtgctacaaatagtgtgttattgagtatattgttaatatttttctaaataatgtacataatatattattatataaattttattatcatcttttcaaattatatgtttattaatctattaaagtttaaatttacataattatattaattaacttatttataagtaatttcaaaattttatgttaatattatactaaaaagtgagattttaaataagtttttaagacgtataagactttgaaaaagtaaaactaaattttaaaataatttatataatataattaaaccaaaattaactctgatgtttcaattaacagactagctagccacaaatctttcaaaatccagtcaaccaaagttgattttccttcctatccttacactgttgtttaaataaatgcactgcattcatcaatattcacctatttttatttcaaaatctcaaagttgacaaaaaaaaatagatttaaaccaattaaaatatttcaaatgattgaatataataaaaaaaattaggtatttcaaaattaatcaatccaaaaaaattagattgatttcattaagtaattggatagaattttttaaatttttaaacaaaatatattttagagtttatttaaaagataaataaaatattaaaaagtcaccaatattattaaaaaaatagaaagggaaaagcatggtttggtatatttgaatcaattggattgaagattttcaatatacgacacccaagttaatatatatataaaaaaaatatttcgtatgagaatgataatagtcattttcattagttagattaaaataaatgattaaaattaaaatattttaaatttaaattaaagtttcatttaattataaaatttctataagatttaacctaacaaaaaatcaaatattttaaacaaaaaaaaatggaatagaagaaagaaagaaaaatgaaaagaaagataataaaaagaaaaaaagaaaggaagataatagaaaaagaaaaaaaaggaaagaaagatgataaaatgaaaaagaaaaaaaaaaagggaaagtaaaaaagattagaactagacttttaaatacgtcagacaaagtctaaagaaacctataacaagtaaataagtcaagtcaggtttatgtatttaaatcatgcctaagcaagtctaatctgatctattttcacccctacttctccttctcattttttctaataaagttacactctatttcggtttattttctgtgttttaattgttatgggcttagtcccttttagatcctgagttaaaatagactttcacaatttatttcaaagaatccataattaaggaaaattgaggaagaagcaacaacacaaggatagagattgaggaggattcatatatctttctttttccttttcgatttgaatgttcttgtttcttttttgtgatttttttttctattatgattgagttttatcttctattttgagattggacaattaccttgatacattaaaaaaattacataacccattgtccataagctccactttatacacatataagagagagatattgtatgcattcttatcatatgcaaagagaatgttttgatgatacattaatgattttaaattaattgtttcttagtttcttccattttgttaatatttgaattttgttagtttgattcttattgagcacatattaaaaaattatttgagaaaataatttttttatttatttaaagaatgaattacatgatatactaaatgttggtcaagaactgtacatcaaaattcatgagattaactcatatatccaacccatgtcatgaaaagtgaatgttaatttttctctacaatccactactctgttatgggtatgctttgtgtgaataagaccacattcattcaaggtattgctactttattgtagtcatcaataaagtcatgaaaatacctttttagtttttattctttggttagtcttatcccatgcactgatttgcaatcatttcaaaaatcactttcacagaacacatctcatcaaccacttgtatcaccatgtatgtcccatctaagaattcaatggtttaaacttttagaagaagggactctaagattgtatacaaaaaaatatttgtataaaaccacttttatgtaattatatctattaaaaacatcttttattttgaaagttaattacaatttcagctcttttccaaaatgctatttacaaactagttttttttaaatatatttataataatgagaaatcaaattatattgatgtaattttgacaattatcacattatatttataacttgatatagaatatgatttttattgatccaaccgttgaattatatttatatatgatcaaaatcatgtatgctaactaggtatatggaacttgttgaaatataatgtaaattttatcaattatatttacatcacctatttttatgtaaattatatttaaaccaattattttatttcaaattaacatatgatgtttacattatatttacattatattgtatgctaattacattatatttacatcacctatttttatttgaaaatctcaaaattgacaaaaaaaatagatttaaatcaattagatatttcaaaattaatcggtccaaaaaaattagattgatttaattaagtaattggatagaatttttttaatttttaaacaaaaaatattttagaagttatttaaaagataaatgaaatattaaaaagtcaccaatattattaaaagatagagagggaaaagcaaggtttggtagagttggatcaattggattgaagattttttaatctactacaccaatttatcatcaaattatcagttagattaaaattaaaagttaatattaaaatatttaaaattcaaattaaaacctcatctaattataaaatttatataagatttaccaaataaaaattttaaatattttaaaattttaatatacatcaagatattcactacaactaacacaatcttctcaaccacatcagatgattattgccataccattgttatagccaccaacaccttggtgatatggagcttgtagattgaagacttgagatgttttggaactcaaaagaatttggatttagtaaaggaaatgttgattaccagctcaccaaactacaaggccttcgtccctccgtcaagcatttacatgatgtaccaacaaggctgctttgccaatggcacggtgcttcttctggccaaagaccttgccgaaaacaactagggtgctagcttgcttttcgtttgttctaagatcaccgcagtcacatcttgcggcccaacacccatattgatagccttgtgggtcaagccttgtttggagatggtgcagcttgtcattgttggatcagaccccttaccaattgaaaagcctttgtttcagcttttctggactgcacaaactatccttacactgaaggggctattattggccatcgcgaagttggactcactttttgtctcctttcctggattcatctctaagaatatcgataaggccatagttgaagccttccaacccttgggaatctctgattacaactctatcttctgaattgcacacatgatgtatcgccaattttagaccaggctaagttaggcttgaagcctgaaaaaatggaagctactaaacatgtgctcagctagtatggtaataatgtcaagtgcatgtgttattcatcttggattagacgaggaagaaatctacggaaaatggacttcttgaaggcattgaatggggtgtgctctttggttttggttttgtcccggactcacttgagactgtcgtgctccacactgtctaatcaaaccacaaattcttttatttatttatttaattatttttatcttttcagattgaaaaatttattctttcttttcctttgttcatccctgcctgccttcctcagtcacatgcttgttttcttttttgtatacaagtaaataagaacatgtcatataattgatttatacagttgcaaagtgaatagttttgtccaatttcatcttcattgaaatgttgtttgttacttactataatttgaactgtagaactgtgtgaatctgatttatgacttaattgtgtaaagagagttgtgccacttaacttggtcagctttgccttaaagttttgtgtatcgttatatatctatctggctgagagagaaaattatacataatggttcgataagtattaaagacataatagctaagaaaatgtagttccaataacttgattactgaaagaactaaatcatagtcgacacaaaatgtacggacagcaccttgcattattgagcttaccatagttaactgcttcaccactttatccaaggttagaattagtagagttatttcctgagatgtatggactggtccttgacaaattaaatatttggttaaatcagtatatagagttattttctgaattgacagattagatttgttgccattaatttaattagaaataatttaatattttcttagtgtatgaaatgaaccattaattagatctgtatgaaaatatatttttcttttataaacgtaggtttgggacctcagaacataaatccaagcatagtgttagcagttacaagaggcttgtgtggtggtcctctgtagaagaaatcatgcttttctaaaccccacctgtctaatgaatcatcttcctttttcctaacttaacgatgcaataccatacagtgttattcaagtctgctccagactatcattttagttagggtcttaggttgtgcatgttatccattcatgaggccctatgatgcacataaattatcttttcactcaactgaatgcatttttctggggtattttgcactacgtaaaggctgtaagtgtctctcttgatagcaaattctacatagttcatatcaaaagatgtaatattcagcgaatctaaaattttcctatcagtccttatttttcaactaccactaccccatcatccgcattctctttacctctcccatacatacaatcttttcaccacttcatctcaccctcgttttcatccttcacatacaatagcctttttttcctcctcaacctttatcttaagatacatcatcatctctttctatgccttcatcttattctactttctcagatgtgttgctaatcctcctccattggggctcaaaagtcaaaacatccatcctatgcaaacaaggtctaagtaaggcattcacaagcccacactgttaaccactctcattaaaccttcttcaatcaaataggctatgtaggatgaatattctacacttactgttaaaaagacttggtccctggttcctcttcatcctcactgacaagttgtaggttgtaaatgtatctttcaagtcaaagaaaaccctattgggtcaattaaaaagtacaaggcccatgttgttgcaaaaggcttccactaacagcatagttttgaccacactgaaacattctcacctgttgtaaatcttgtcacgattaagatcatgatcactcttgttttcactgacaagtggacaattcagcaacttgatgatgcattcctaaatggatttcttgttgaagaagtctatagggcttaggcactgggctttgagactgctggcaagctgcttgcatgcaagctacataaggcattagatgacctgaaacaggcacacatggcgtggttttaaaggtttactaactttgcttctaaattactaggacttgattcaactcatgcaagtgtgatccatcttttctttttatactaaccacttccccaacattgcacataaattctagtgtatgatgatcatattttaattactggaaattctcgtgatctgattcaacagtatataaccaaactaagctccatatttgcactcaaatactgggatactttggactgcttcttgggtatggatgtcatgtatctcgaaaatgattctatttttctatcttaaggaagatatattagagacatttttggacaaagctaatatgtcctcagctaaagttaccttcaccctatgcctaaaggctgcaaagtgcaaactctaacaatttgtacctgattttctccaaaaccctcacctctataggtccatctttggtgaaattagctatattgtgaacaaaatatgtcaatttctctctcgaccactaggtcattggaaagtggtcaaacctatatctgctagggacccttcaccatgggctaatattgcaacttgtttcaagtcccagactcccctcggctggtcatttttggtttttatgatgcagattgcgcttaagatgatcatcgttccacatctttgtgttctacatttattttggcccaaacatggtctcttggtggacaaacaaacagcctttgttgctttctcaaacgtataggctgaaaattgaaatctggccaacaccacattagaaattcttggatacagtctcttctgcatgaactttaccttcctattacaaccccctacgtttgtttaccacgacaatcttaggatagtgtccttgactcgtatcctgtcattgagatctaagcaaatggagttcaatctcctttttgtcatagaaagtgtgctgaagaaagattgcgccttggtcagattgtgtgcattcttaccaaagctttggaaagtactcgatttcgtgaattgtacaccaaacttagagtggttgatcctttttctttagctcaagtcccccttgaatttgaggggggaatgttaagagtaaagaactttctagtgtcttaagaattttaaactctttatctgatagttgctgtattagatatctgaaaactgtcaattactatgttatctcagctcagattcaattagtatatgatcttgctataagcatacataactatatcatagtataatgaaaatgagtaacaaattatcttaatagtaatttgctattattttctaagtttctatttcactcttgaatcaaattaaatttggcctagctagaagagaaattcttaaattgactttattcttttttaaagatctaaatatacatgtactctcactcaaataaatatttcatttttttttcttttactcgtgaatcaggacaacattgaggtatatgaagaccataataggacctgcaaattgtgatctcatattaatgaagactaactttagagtattagctattcacaatttcacataaaaataagctgctcagaaattgttaaagggaaaaaaatattacaagaaactaaattgcggcattattctctaatattgtctgaaatgcttcttgtaatcttttacgcttcatatttctgttttgccttttctgacattacaagcttgttagaaccatccaataccactcattcactgaccttcttctccttgaaataccatagcttaatcttcattggatttgaaagctgtctgcttagcttgggaacataggtgaaataacattgtcgtccaggccagagttaaaaaaaaaggcatggctattaagtccctgagtgactactagaatgttgtggagtactcataaaaacaggagactctatgggtctatttcccatatctttggttttgtgaagaagaaaggtcccagataaaattgtgacaaagccacaaacctcagtagcaatttgagatgcatcttgtgtgtcccattcctgtagcaaataaataaagcagaaaagcagataatgacttgcaatccaattgcaaacttccgacgaagatattatttaagactcataataatacagatgagtctaacaagacaatagcaataatgataaatgatcaattgacaattgtagacgttaatcatgccatgaaatatactgtgagaattaaatgtcatttcgttttttcttaaaaaaaattccttaaaataataaaatagaacaataacaaataaacaaaataaactttatgtgttagaattttcagctattaagtactagcaaacaaacacgcatgcttttaaaacaaaatatgaaattacacattgatataatcttaaattcagtttgtctgatttaatagatcttaggtgtccaagttcttcaaaacttgtattcaacttgatattattatgcaagttaaattctagttatgattggtccaatactatggatgactaagtttctcacactttcatgtttctcatttcagttttacttttccctgcacaacaagaaaagaggtagtttgtgttttatttccataaacaaccatatgtctatatgaagagttgataagataagtgatcgccaatagttaaaactaagtagaggaatactaatagaaactccaagtaaaaatatattaaaatgatttagatcctaaatagcatttttgaagaattggttttttgacaaaacacaatgatatcttttgattcatgtaactgattccacctagtggaaacaggcttttgttgttgttattgttttaaactactatatgattgcatagtttagtagcatcatcaggtacattttaaacaaaagtatatatatatatatatatatatatatatatatatatatatatatatggaatcatagaaggcaatttagttaccttaaacatgattatgctggcaaagatggtgaatgatgtaaacatgacatagtaaattggtgatacaactgcagtgttaaaggtgtccaaagcctgaaacatgattccaaaataaataaaatagcattacaatataattgataactgataagcatattactaattcagcacacttatttcaatgattctaacattattggttttaattattaaagaaagtctaaagcgaatactaaaatgaagttcagttgtaagttagttggaaatccctaatgtaaaaaatatggcatgccatttctaaaatattgcatgttaagtattactcatctataacggcaaaggaaaggaaatgaaatagttcaatgccaattaagaaaaacaatacaaaatcttttgtttataacttttcgaaatgccacgaactagattagaaatgcaaacatggtcatttagataatgatagaagtcccaaagattgcaaaagcatagttaaatttcttaagcattacaaattaccacctaatcactaaggtcagagaaaaatcaaaatagtgttttcaacttttgcactccaataaccaataaaaaaaattaaaaatatatttaactttgacataattattttaagttgtactttggaagacatattacaatgactgccaacagtaaatgtactaatatatgtaagtcaaagtttaccttgttcaagtagttaatctgcaaaagacaacatcctatcacaataatcgtaaagaaccaggtctgaaagtaaatgaattggttgttgccttcaaatgttaacttcatagctattgacactgctttcacactcatgacctatgcaacaaggaacaacattaggtttatcgagggtagttttattgtgacctacatgacacatatgagcattgaacacataatcgatataccgtaattgagcctgtgagagagcatattccaacatatataaccagataggttggcccatatcgaggagcacaatagaaaataaggatgcaaaccacaaccacaactatacacatgtagattagaaagcctgttgatgaaggaaagaactcaatgtcagcttcgttaaccataaatgaatgccttgaatctattaagaccttaatatgcatcccactcatcttgtatcctcctactttgattttttgcaagattcaatggtaaaagatatgttgaaaccaagcaatcaggaattgaatattacctggttctgtagcaagttgccacacttccttaacagagtgaataactctttcatggggagcatgcaacacaatagttgtagatcccaccatacaaagagcacatccaagcacaccaaatatgtgcaacctctcttttaagataaagtgagctagtattgcactgcatcatgatattagtttgtaactttctaaaatgcaagcagcacccaaattaaaatttgatgaatgaagatgtgcatctacatctgtgtcaaagaaagcagaaacatcctaataattaatgttatgaagaataccatgttccttacctgaaaatgatacttaaagctcccaaaggagttacaagtagtgcaggagcaaatgcataagctgcaaaattggctacttctccaacaatcactacaaaaatgtaagcatacatatagaattagttgatgaaattttcataagattgtcggggacattagcaagttgttatttatagttacagagttctaagagttataattgaaaatttgctctatgaaatttatatgtagcacaaaatttatatctatgaaatttatatgtatgtacaaagacatttgaatccaaagtcaaggaaacatagtcaaagtattagaacttaaaagttaaaagtaataaaaaaattctttgtcttagaagaattaaacttaaatcagttgggttcaagaatttttggtagtccactagacttgaaatgtgatagaaattattctgcatcactttatcttttttcactctccattataatcttaattgtaaaatgtcaaattagctgataaagacaacaaacgagacaccttttcaacacaagcctatatcatgaagtaatacaataaatacaaacagaaaattaaagatgaattagatcaaacatgcaatacaatgggtcacaagaaatcccttttaaattaaaataggtagcttatgattaggccttgtcaaatgtgtttagcaggtaaaatgctacatgatatattataatttagtaattgcagcaccaaaataatttttaagaaaaaaactaaaaatcacatactagagatcattccaaaccaccaccaaggttcatataggtatgcatgtcctcccgcacctgatcaaattaaaacaatatatatatatatatatatatatatatatatatatatcaatgattaaagaaagggtaattaacacctagcaaaccaaaaacaaaaatgtgaggaaacatgaacctgctcttttccctgtggcaccagcctttttaaggcccatcttttttattatgaagctagagccaatgaaaatgctggaagagacagccaaaacaaacccagttacgttgtcagaagacgcccccatttgtcactatcatgtaaatgatatccaaaaaaatatcctttgatgatacgaacaattgcagggccaagatgtccaattcaatcccttgaccctataagccattgattcaacgtacaaatgcattaacaagaaaattaattgaatgaattgtataacatgaaatatgcatatatagacatagaaacatccaaacattagaaggggtatgctatttaccttattgggcaccttacatacaactttatggctagaaaatcatgactcgcacaaaactaaagagaagggttgtctgtgcatgaaaattgaagccttaattgttgatgtcaaaggtgagggaggaagagatcatggaattgggatcgaatggaggcacgagacgcaactgtatgggtgtcacgcatgcgttgcagaaacaattacctcaaattaggcctctccgcaactcacgttttctgagaccttttgtattagtaatagttattacgattttgtgctgggttgtgtgtggcttttttatttattcagagtcagtagcatgtagtaatagtgaatcttataagaatagtatttgttaaagaataatcaatactaatagtcatgtatcttaataataacttaaaaagtatatcatgtttcacaatcacacacacacacacatatatatatatgaagaaattgtttttaactgtgggtcaattgattaaaaatcattcctaataactaaattaatacaaaagtcaattttattgtatatgtaaatatatgatcaaataatgtattctatataaacacacgtgggtaagtatgtgcatgcgcgtgcttatgcgtgtgtatgaattaaacttgtgaataaatattaattaatataatatttagtgttattattataatattaaaatgtaagtatttttttctcatatagtattagttataacagttattaaatttatttgtatataattatttgtaatggcatttaaatatattatacttttattcaatgcagcatgaacttttatttataacaggagtggtggaatttaaatataatatttaactgttatttaaatttattagtataacagttatctatatgtatatatatgtgtgtgtgtgtgtgagtgtgtgtgtgtgatattattcttgttattgtttaaaaaatctaatttatagaaacatatttttgaatgggaatttccttatataatatttattgttgtttttattaaatataaaatataaataacattaataatcttactaaatattgtgtttattaaacatggcatatttattatatttaataaatatattatataattgttccgagaaagactaattaaacatgataagatatgattagataataacgtgatcaagcacgagaacaagggattcacgtgatcaagcacgttagtgcgatgaagttagatagagtataaaaggtccattattaatcttatggttggcctaatgacaacatgaggatatacaactcccaagtctcgggcgttataatggaaaggctgaaaaaaatagaaaaggtagattatacaataattataaaatgtattattatgaattattttaaattttgactaatatatataaatatgcttattttcaataattattattagttttacataatatatttaaaagtagttaaaagaaagaaaacaaatagacttgaaaacaatcattaatgtaatatataatattattaatgaattatacataaaacatactttatagtagcaaaatttaaaatataataaattttacatataaacttattattacaaaatttattatccaaacttatataataaaatctacatcaaacatttttttttatttttttactaaaaaatattttataaaacttattttaaaatagaaaaactcagatgtatattcaaataatgtataaaagttgataaatttatatcattttgatattatcttatgttggtttcatatcataaaaatcaatatgtaactcttatttatgtctggtggtattttaattatgtattttttttaataaagtacattcaatttaaataaatcatatatagggtttaatatctttttggtttctaaacttttcaattttttgcttgtagtccttaatcaaacttttgatcatttctaattcctgaattatttctctattaacatttttgctccttgttatcaagtaatgtgatattcacgtgtaattttttttgtaaactatatgaagaaatggtttgtgcaagcaaaattaaaatggaagggtttagtgtttgcttaagaagtgaattagggaatcagggtttgaagggttcaaatattatggattatctagttatggagcttagggttttgattcatggattcaatgattagtgattttgcttattttagctgattttacttagtgtgagttgttgattttgtgttttaaatatggttcaatggatcactaaattgtgtattgagggttgctgcgtttgcttactacatatcttttttatttatgtttttcaattcttcaaacttttttgctggtggttttatatggccaaaaaaattataatgccttatggaaaaatattccaaaccaacaatgttttatcacatgactattatatcaaactagtaatttacatgaaaagtcacatgattatcacatcatcacataaaaatcgtatttgatggaaaagaactaaaacaatgacaaacataattaaggcactaagatgttttaaaaaatatcaatatagtgaagatgaattttcaaattgctttatcaccttttcattcttaactttctcaaactatccaaaggagtttcatgcacctatcctttttatgtctcctttacctacaagagactttttctatctcaaatgcttgaataaacacacacaacgacttttatcacaactgtgaaaaagtaaaaatgtttcttattatgagaagtaataactataattttttaaaatttataaccatacattagtgttgtaaaaacggttcggatcgtaactcggtggccaaattgggtcgtttccatgtttggaccggaaatggaaccgactcaggttgacctggtaaaatccgacttggtttttggttgaatcggtttgacccgacagagttttttcaatttttccaattactggcccaccagttagaccgctgacccactaacctactgatccactatctcgtctgaatcaatgattggaccagatttcacaactatcccatatatagatgatcaaaataaaatattagattctaatcttataactattttaaaaatatcatgtgcatttttgtttaatcccaaccgttcaaatataatctaatggtttatattatttttgtagttctcattactcataataagaaaacttcttatttgatatttttctatgaataaattcacactagataatataatttaaattataaattagaagaagacttatatgaatacatgaattataatttaaattcccaatcaacaatttaatgtgtaatatagggttaatttacaacatttccccacttataaaaaataattatttatttattgggcaattttgagttgtttacaacttaagaaaggaaggaagagatgagagacaagtgattgatttgattcataatgtaatgtaataggaaaataaaaaaaataaaaaataattattcattgtgtttaaaattttgggttctgaaaatataatgagtcttatttataacatgttgtaaagcatgttccttatacatcttatttcccttattcattcttgagagtttaactttctacactagtcatttttctaatacactcaacatgtacagtgtaataccgattttgtctttcttaaaatccgtaagttgcatattaacacacaccattcgatttcttacggatcgttgatccgtatgagtcatacggattgtcaatccgtcaattcatatgactcttacggattgtcaatccgtatgattcatatggattgtcaatccgtataattcatacggatcatacggattgacaattcatatgattcttacgaattgtcgatttctataagaataaagttgaaaataaaaaaatatgttgaatgtattagaaaaagtgctgatgtaggaagcaggactccatttcccataccatcagacgttagaagccgaagccgaagcccaagcccaacgctccagcaccaaacttagccgtcacaacaacgaacaggtacaatacacctcccattttttctctttcccaatctaccctccatcctccgtcaatccccctaacaatcatttcaatgccctcaaaatccattcacttcaacgccttttctctgtatctctctctttaatcttccaaatcttggaaattattattattgaaagggtccttcccgcactaatttatcgaaaatccccccgaaattaggttttactagtatttatctatcagcgattggtggtaatttttcgaaggtagggtttaatgggtgatcgcggttcgggcgctgcgaagccgatttggatgaagcaggcggaggaggcgaagctgaagagcgaggcggagaaggccgcggcggcgaaggcggctttcgaggccaccttcaaggctttggagaataaacacgacaagggaggagggagcgttgctgaatcggacagcgactccgaggaggagtacgaggacctggcccacaagcccattggccccgtggagcccgccaagtgcaccgctgcggggaccgggatcgctggcggaaccgcgtgcgctccgtcctcgtttgtggtggtgactaaggacgccgatgagaggaaggtttccggcggtggtgcgcaaataaaggtgagggtgactcccgggttgggtgttggagggactgagcaagaggggatggtgaaggatatgggggatggaacatatactgtgacttatgtggtgcctaagagagggaattatatggtcagtgttgagtgtaatgggaggcctatcatggggagcccatttcctgtgtttttcagtgcagcaggtactacatatgctttacggtttttgcttttttttttttttttttttttttaatttagtatatgcatttgcctcaaatgtggttgttttgagttgtttttggtttggttagttagcagtttcacttggttgccttttatatgtataataataagttggtttgactaggatgtaattatgagtagtgataaaacaaacaataacaaaagccttatcccaccaagtgagattggctacatggatcaatgacaccatggttacctgtagtgagtgatctgtgtttagtatatctaatatcaacgagttttgtgttggctgccaaaggtttaacataaccctctcccattacattggcttgagattggctatgcataggcggagtgttgtgttgataaccttgtcgctgtctatatgcgtgtattttggtttgaatgatcttcgtggtggtcaatttccaatgctttgatttgttttgtaggtaatagtactggagggccgctgggtttagctcctgcatcttcatttccaaatcttgttaatcaaactatgcccaacatgccgaattactctgggtcagtttcaggggcattccctggattgttgggaatgattccaggggttgttgctggagcttctggcggtgctattttgcctggaattggggcctcacttggggaagtttgtcgtgattaccttaatgggcgttgtgcaaaagttgattgcaagttgaatcacccacctcataatttgttaatgactgccttggctgcgacaacctcaatgggaacacttagccaagctcctatggcaccttctgctgctgcaatggctgcagctcaggcaatagttgctgctcaagcccttcaagcacatgcagctcaggtgcaagctcagtctgcaaaagattccattggtatgctattatcttaattttgtttttgttttagtggtacgtttatcatttcacaattctaaatttctaatatgatgaaagctctctccttaattttgcactatatttgactgtgatgttatttttgttgttgtgttttactgtttcctagttttttcttctaattgtatttgctaccacaataggttcacctgaaaaggctagtaaggatgatgcagtgaagaaaacccttcaagttagcaatcttagccctcttctcactgtggaacagctaaaacaactctttggattctgtggcactgttgttgaatgtgcaatcactgattcaaagcattttgcctatatagaatactcaaaggctgaagaggcaactgctgctctggcattaaacaacatagatgttggggggcgccctttaaatgttgaaatggcaaaatcacttccacagaaaccatctgttgagaattcttcacttgcttcatcatctcttcctctgatgatgcagcaagctgttgcgatgcaacagatgcaattccagcaagcactgcttatgcaacaatctatggctgcacagcaggctgctacccgggctgcaaccatgaaatctgccacggagttagcagcagcccgagctgcagaaataagtaagaaattgaatcctgatggagttggaagtgaagagaaagagacaaagcaaaagtccaggtttgattactgttgtcaattgtttagaggataatatatgcttattgtcctgattttatttcaaattttttattgcttcaaccactttgatttttgttctgggtagttctggtatgtcctaaataggaagtaggagacatgaactcatataatgtttgaacaaatggtgcgaaaaatagagagaaaactgagaagtgtttctgtatttcttattatgttcgggataatggaagatacaatacttttatgttgttacagaacagttgtaattaggtcaaacttgcaactgatgtgacactctaccaactatcctaagtgaaaccagccagctggtcctgacagacctatcagctggcagccacctgaacaatctaagtttggcccctgtgcaggtccacttctacaatgcgcaggcccaatattatataggattagatatttattcaaacacacttgaaatatcaaatgtgtgtatcaacaaatttatagctacacattagttaatgaggtcttgatagaaaataaggtttttgataaaaaaaaaagtgcatgttctttttatgcaccatcatcactagcataaaacttttccaattactgaattaaataagaattgagtttctctgctttaataagatgtgtcataaatctgaatgatatatggaatgttaatgctaataaagataaaactatgtaccccattgcccagaggctccttgctatgtgaaggtaaggaggaaggatattgtacgtagctttacccttacatatgtaaagaggctattttcggatttgaacccatgaccaacaagtcacctagacagtagacacaacattaccgttgtgccaaggtttaccctcttaatgctagtaaagatgataaagtaaactgtgatatgtgcaagaatggcatgctttcaatcaacatattttcttagcggcttgcatggaattccagattatttgcccaggggcttggtatggaaaagcaacttgtcttagatcattttagtttttaaatttgcatggcagtaacagactggatagttgtggttcatgggttgaggagggggttgttggactgtggttatttagccccctctgtgcataaggaatagtaggtacattgtagttgaggaacctccccacttttgctttgcaaagttgctgagttatggggacttgtgccctcctgcagtattggaggtcatttgggtgacgcagcaataatagagtatgaattgacatacttgggagaattccttgttgattggtctgctttccttgtttgtgcagatcctttagaaagggagattttcattagagaagttataattgtatatgaatttcaattgatgccgttgtcatgacttaactgaatcaacctgctgttctggattattataggtttcaacatagaaagtttgaaatatttgaatcatatgaagtttctatatttctagctagatgtggtagggctatgtatgtgcatgtagatgctaaaaaaggtaagaagaattgggctgaataaattatttgtatttagaattaactggtgtctaacatggaagaaatatattgtgggtggcctggcaattggcaagtctattgtttatcatggattcgtggttattttgaattgggaaaaatcttgttgtaatgttttttttttttaattttttctaccactcattatcattttctgcttttctgtacaaagttctctgtctaatctaaaatttaatttcctttcgcagatcgccctctcctcctcgtggaagatttcgatcaaagtcaagatctcctatcagttatcggagaaggaggaggtctcgctcttattcacctgctcatcattctaaggatcatcgctctaggtcaccattgaggtcccatcattactcaagctatgatagggaaaggcggtcctatagagatattagggaacatagtgatagatacagaagacgagattcagatagatcacttgatcatcgttcatctgcttcaagaagaaacagaagtaggagtgtaagtccttatacaaggaaatcatctgtttctccaaaacatcatagagaaacttcacctcatagaggaaggaaacagtcacgtgctgattctggctctccaaatcgtcacagaggaagtaggtcttctccaaagattgatgacaaaaaactaagaaacagaaggcgctcaaggtcaagatcttcagatgataggcttcactctagcaaaaatgaaaaagtcttgcatggaaagtctaaacacagagagagaaggcgatccaagtcattatctgtggatgagaagcctcacagaaggagccggtcatcccaaagaaaagtggatgaaagtagatccaggcacaaaaaatcgaggtcaaaatctgtggatgataggcatgattctcctgagagattggatgaaaacagaaatagaagatcgaggcatagtgataaaaggcactccagatcaagatctacagaaaatagggatcaaactaatgtcagagaggatgaaagtaaaaatgaaaagtcaaaacatcgtgatattaaaaggtgcaggtcaaaatctgttgaagggaagcgtcgttctaaagataaatcaggggaaaatagagataagaaatcaaagcatcgtgatagaaggcgttcaaggtcaatatcattagaagataagcatgacaaaggaggcacttcacccaatttaaacttggataagagaaattttgaactgacaaagtcccctgaaggcaagaatcactccagtgataaatatcgaaatagaggtgaaaaatcagagcctcaaaagaaaaccccatctaaatcaaaatcagaacaatttgatgggagtgggcccttacgaggaaattacaaggaggatgattcaaaaggaaaatcaccatctgattctggatctgttgaagaaaagcatcatttgaatgatggagaaaatgctaccagtgaagaaaattctaaactctttggagatgtgtttcaggaaccaattataaatgcaaaggactcagcaatcctgaatgataatgggacactgacttcagtgaatggtaactacaaatcagaagggtcaagtgaaaatgcaggagctgatgataacccaggtatgggaagtcctattctcaatcattgttgttaattatgttttagttggatgttacaaatctgagaatcctctttgatgcaggatggatatcagtggaaaaagtgggaagtggaaaatattaagcaaacatggcttggtaatgactaacttgaatatagaaaaaaagagtatccacttgtattatatgattattaatgcttggttactttctgtgcttacaggagtggtggttctaaattatatcaaagaacatagctatgagtgtagatttctgttattcaatcttgaatcggacgtggtgtcactcaaggctactaccatttcttgtcaccatagtgtagatttatttcaaaagcattgcaccatggttttttgtggttgaagatttctgcacctgtcaatgattatgggataaagagcatattctaattcaggattctcatttaggtttcctgacaagttctttccaaggaatatactgtttcttcttaggaggaccgcaattctcagaggatgatgcctccactatttgattggtccccagaatattctctgttctcttatgaacatcttccattgtttatttcttttgcaggttgggttggtaaagatcaggtgtagaatcccacagctgttggtgtggtttaagttttcaagaggagtcctgcttttcgcatgatcaaccgtgcagcgcttatatcatgcttcttttactgcttgattgatgtatgttggaatgttattttaagtatactattatttttattgaaggtaatttttgctatgtttcggtcttgatatttatttttaagtatattatttcccaattaacttgggttaaaggtgttgttgatggtgtctgaatattattggtttctagttcttcaaaaatgatagttcagagggagaaaccctcttagccagtgttcgattttatgcatctaaaacttattggaccttagatagcaataatatgttaaactgaactttcggtgactatttaagtttatctcctcattggtctgtcatatctagattctatagttgatgtggccaatttttgtagtatgatcttgtttagttgaaagcatcattatttgatgtggccacccataggctccgtttcgtttactcatgttttgtgatatggtgggcatgttatatccaaaaaatatgcaggttattctcattgaaatctgttggagctttgagatacagttatgctgggttgattttctcttgtgtaatggaaggtatgcggttagattctgatgctctatggtttagagcatatttgtttttcttttagtaagtgttgagagcaatatggtaggctgcttagctttgtattatgtgcgaatgcatttgctctaagtactgttttccaatatttttaccatcatctggtgtcttatattgtcctgcactccccccccccccccccccaaattttcattttgttttttttttgcttttttttcttttttcttttttcctcccaacaaattgtcatggttaggtaaagcttctatataaaggtcaactgaacctggatgttgctgcaatgagtttcatcatgttgcatttgagcaactggctgagttacagtttttacttaagtaaatgctgtaatgcaaatgatttcaacaggtaattctccgtgaaactatcgggtggtggttctatttgtgtaggatcttcaattttattttgtctgtcttgtcccatgctttacgtagttctgtatgttgtcctgctcacattgatgtttttgcatcacattctttacaattatttgcatatcgagccattttcagtgtcatcgtaatgattgagttgagtttttgttgtgttgattttatatgttgtcacaacttaaattgtgggtttgaaaaatgagcttgttgctgagaggtgctaaagaaattatgtttttttttctcctgttggtgggtcacaactaagtttatccccttgttttatgctctctttttttctgtccccagccccgttttcttttttccccttctgctcccatctccccttttttttttggttaggttaagcattggatatgatgatcttatgagcagctgcaaattctcttcaccagatgattgtgtgaagtttgttcttggaagttctgttggtgttttagtttccttttttttgttgtctcttcaccacctggtctagtcacactgatgttatgccttctccggttggcgcttagggcttttaccacagtgtttgttcatagttctgcactgtttaataaaagaaatgggtaatactattctaggttattgttgacctcttaacatgttgatgcgtgcccttcaacatatacaaataactagtggctaactgagggggaagtattgagcgttgatgacttaggctcttgaggaatatttgattaaatgttggtcccctttttcctcgaaaataatcctaatttaagctgtatgaccaacctactcagttgtagctaatcatcatcatcgagtgaaatcacgtcgttctatgtatctcttgctgcacaaaaccaagttaaaattggtgaaactaatgttttgattttgaagtggaagtttattaatggaaattccaaagtgcgtcaaatctaatataaatattccaacacttaaattgaagtttgtttttcttttttctacatactatgttatctggttattggaacctcgctttagctatgattcttttaaatatattattttttattgattgatatttataagaaatgacaatttgcgagtcttatatcatttaatgatttttttccttattaaagatagagtattttgaaagtgtcagtgttttttagtacccctctttcataatagactcaatttacatttatcaagtgcatgtgaggatgattgttaatacagaaatacaattactacaagcgcaatactcctttcgtttcgtaatatttgttgttctaggtatttacactaggtattacataaattaaaaaataataataaatatataaaagagaataataattttataaaattaattcatttataaattttatgtttccttgttaaaatgataattattttaagattattttttctttacctataattaatataggatggagttttatatatatatatattgcatgtacacgtcatcgtcgttggatagaaatggtgtcctgatcaaatttagtctaccataccagctaagcaagaaaaaacagactatcaagcgtacaactgcttattattttgtttcttggtcccgttttgtcgtcaagttaattggtgtactaatctaagcaagtttttgtattcttttttcagcagcagcctttctaagtaatgaaaacaattgatgacatatgcataatgatggccatgacgaatgtctgtaaaactgatttttaagttaaaaattatgtttgatgtttttatttcaaaactatgtcagtaataaagttcagtgtaaattttgttattgactgtgaaacttacttaaaatcgatttaacttgatcaatttttatataaaatcaattccttaacgtaatgtcaaacatgtaaatacttacgtgctagctagtatgtcaatgtggatttggataatctaatatgaattcaaaaatgagtgacaaaagaaaaaagacgaaacttatgaagttaagttgcacatgagaagcaacactatataatttatcaatttttactttattcttctaactttttgattggcaaatcgttaattaaagtttaataaccaattaattttgacatttcactcaatggtaatttaatcactatattttaatatagtctgaaattgaatttaaaaatatttttaattaaaatgtgagttttgtcctaattcaatcataaataatacctcattggatgaaagttgttttcaatttatatattctatttttaccttatttcttgtcgatatgaaacttagatttttttaatacattccttcaaatccaatacttttagaattggtatgtgaataatatgatgaatgacctattttacaaacttttaatataactcaatagttataataagttactacttttttttagtatctcttttagtatatccaattagaataatatcaaattaagctctttaaaataattttgttttaagagtaatacaatattttgtttcaattaattttcttttaaaattctcaagtattggacttcaaataaaaaagttcaaagttatttcatatttttttttcaaataagttgtgaataataaaaaataaattaacttgatatgtatacaaaataatcaaaacttaaaagaattacagtatatttttatatgaattatcaaaatcctctctctatatagattataacaattatcttaagcgttgacattttaggaatttttttttccatgagaaccatttgactgtttttcttatcaattggagccattttaggatttttattattattatcctcttgtctctttcaatctattttttatttctaaattgaattttaatatttttcttattccacaatatgaattgttcattataaattttaaatataatcaatatatttgaaaatatttatttattgtaaaacttagttacataaaatagatatttatcctttgtattgcataagcgaaaataatagttaatcattactcaaatatgtgattttatcatcaaaattttatgaatcattactattttatgaaatctaatcattatattcatttcaaatttattatttttaattcaaaataaatataaactatttttatttactttttaaataaatattaactaacaaagcattagtttaagtggtaataaattcaattctgttaagtaatattttccgtttgagtcttataaaaaagacatccactgatcaatcataatgcttaacaaaaaataattattaacaaaatcagtaaatactctttaatccttaaaaataatataataaaaataaatattaaaatttctgaaatgatccacaactatatttatgaatatacagatttttaaattacataactttttttataatcaccataataaaattgtataatcatactaagaaattaactacaaacaattactccaaaggcggcggccatattagttaacggtgttgaatgcttacatgaaaatgtccgacagaaagataaaccaaaagatagagataaatatttttattgcaatatcaagttttgttaaagactttgaagtctcaaattgaaattccatatataattaagcaccctggaaagcataaaaacacgtgtattggacaaggtaattgattttacacttaattatatttttagtccttcaaactttaaaaatttctttttaatccatctccttaaatacattttttttaaattctgatagaaggactatataaaaaaaaaatattgtattatacctctttgtaataattttttacaatagtcttttttacaaagaaaaaaaatattaaaaaatcataaaaaactattgttaaaaaaatcttacaaaaggtataatacaaaaacaaaattttaatgatacaactattcctatggaagagacaaacatctatttttttcctttcctcgtgtaaaaaaaaaaaaccgaagaaataagatttgataatacgattttaaataaaccggatgttagagattcaattaatttttttcatgttatgattggtgattatagatatataacttagtgccttgttttttaactcataataataataatggcgaaggtgtttagttgttatgttctgtattgtttgtcaagatgcaatttgtgtagttttgatttttttttccaaatgaagtatttgatcttttatctcatatttttagttaaatttaattatttatcttctaaaaagtttaatttaatattttttttgttcagtttagtctttaattcttaaaaaattattttggtcatttcttttaatttagttctttgttccatttaagattgttgtctttagtaatttaataataaactttatgtgctaaaaatgaagtggagggaaagaaaagaaaattgaattaaaaagtttatttttaaatgattaacaacttcaatattaaataaactgaaaaataaagaatataaagaaccaaataagttttttaaaagataaaggataaaattgaaccaaaaaattaaataaatcatttacccttaactttcagcatactagtgaacagtgatctagatttgagaagtatattaagcataaggatcaatcataattattaaagcattataaaaccataattattaaaaatacaagtaagcttaaacatgttaataaagtgggccaaatggtatttatcaactgttaattttttatataaaaaaaagaacaggtatttgtcaacagtaagaagtatggtctacatgtcaaaagaaaaaaaaattatatatagaagattaggtataacaacttttaagaataataaagaatgttactgatagaaatggtttttctataattattaaaaaacattttttaatagttataaaaataagtggacttaattattatttttaaagaggaccatttttggaccaatttaaggaggacttaaagatgttaataatgtgggcaaatgatatttgtcaactatttgaaatattgtctacatgtcaaaaataaaattacacgttaaagattagaagataacaactttttttttttacaagagaatataacaattttatgactaacaaaaaatgttacttatagaaatggtttcttcccttcctacatataagctaattatagagattataaaattgatttgataattaaaggaaaaaggaggagaaaagagactatgaatttaaatcttccactaatataaactaacaaataatatttctcaataaaaaattaatctttcctgaaggtagataaagacacaatcttatttgaatgtcttaattctaaaaaatgagaataatataagatacaaatatatagttattatgtgtggtgcaaataagtcttgtttgcaccactatctatttgtattttggtgtcattgaaaaaatttcaaaatattgaatttgacttgtgaaactaaaataaaaaagatacacattaaaaaacagaatgtttttgtaaaagttcaaaataagattatattttatcaaacaaaaattaattatataactcccctccccctgaagttatcttccaaagcttatcctcataggaaaagttcaaaccccaaaaatacaattattgaaagagattattaattgcaatagtgtgttaatcattagttgtaatattgtatttacatttagtgtttttattgtatttttggtacttttttaattagatttaaaatctcaccttgataatttatataataaaaaaatgacattaatagtcaacataattttgtttgatacatgatattaatatattcattaattttaataatgattaatttttattgagaaatctaattgataatctttgttaggattttctcttctaattatattttttctacccacaaatcaaaatcttgtttaaggatattaaactcaataataaattctactcaaatcaataagatattaatagtcaacatatatcaaagagaatctttaaacctaaatagaaataataccaaaacagttcacatctaaagtcttatccttaggtatgattaatattaatataaatatttcaaaataaaatagaatattccataaaatttttaaaaaggaattgtacttttattcaaaagtttattatatatattttttctaaagttatcgtcgcaagcatggggaattaagtttaaattaaaaaaatgacctaaatcaattattgatagctttgatatcaaagtacatcgctttaatagttcaaataaaaaatctttttgacatatttggtttaaattatattgaagttctgaaaagaattcttacgaatgcttaaataaatcttgcaaataaaaattgaaactagggacacataaggtatgacttattttaaattagagaagtgtgacaaaatattgtttgaatgtaaatgttaaaggtgcaattgtagataacaaataaaaggcgtaattaaatttgtttgtttttagattatttctatttcttgagagaacttaaaatatttatttctttaacttttgttttttacaaaatatgtacttatgattgattgttttaacttttttctcacatatatcatcttttaaaggtgatcatgtttaaaatatgatttggaaaaatatgattgggtattaaatatggatacatcttttagtaaaaatttgaatctttatcggcgatgctgagagagtctaactcccattgtttgtttgtctctttttttagtttttattaaaaatatttcatatataaattatgtacttaatattttggtactaatatttttcttgagcattatatatatatatatatatatatatatatatatatatatatatatcacgatgagttgtcaactatgtcattaaccatttagcatacataaaacggtatattctataatttatatttaataaacttattctattgtaagtcaataatggacgcattgctatttaagaacaataaaatctcccattccatccacaaacaactaaagatttgttttgtttgacaccaaaaaaaaaaataaaaactaaaggttttttttttaggcgtaaaatttgttgctatatacgatttttaaataaactggatgtcaggcattcaatttattttttcatgttatgatcaatgattatagatatataattcagtgcctttttttatgtctaggcatgatattatattttcagaaattacattcttaaaaatattataactaaaaagttatttctagatatattaaaatgagggaaaataagatagaagttaaaaaggtatgttaaaaaattttcatatgatataggattctcacacattcacataaaaaatgtaataattttttataatttatatcaatcataaaatgttatatctttaaattcacatttattataaaaaaaagtgtatttatcgaaatttaaaattgattattgtcaggatcaatatagttaagataggtttcatgatctctcaagttggattacaagtatcctttattaagagaatatgagagagaacttgtaaaacaaagaactttgacattcaattaagtgtgtgagtgacttgagaatgaatcaagaaggagatataaaacttaatatttatagcgttggatgaaaacttcatatatttaattataagagatatcacaatgatataaccatctttgtagataattcattgctaatagataagtagatacctaataaagaaatagtagcattattattagaattcaaatatatatatatatatatattatcagtttattagactaatagttcatctattaagagatttacgtctatactcttttagtaggagaactgaataaaagggttaatatatatatatatatatatatatatttcaatatcacatcacttattatgttaatttgtgaatttcgaacaatacatgaattaattttatatgacttaaaacaaatatatttatagtgaaaatataatatataaattttttaaaaattaatttttaaaaatcataagaaacaggagaaattgacattttcatatttattattgtgagaaatcaacttttaatccctcgaatacgcttataaaaaataacggtgaaggtttttagttacgtatgttctttattgtttgtaaggatgcaatttgggagattttaaaccgtgtgcaacatgttagtgaatagtgatgtagatttgagaagtatatttaagcacaaggttcaatgactcctaaaaaaaaggataatattcaataataactattaaaaaatacaagttagcttaaacatgttaataaagtgggccaaatggtatttgtcaactgtctgaagtataatctacacgtcaaaatagaattacatatagaaaattagttataacaacttttaagaataataaaagatgttacttatagaactggttttttctatgattattaaaacaacaattttttaataattataagaaaaaaagtgggcttaaacatgttaataaagtttgcaatggtatttgtcaactgtttgaaacagagtctacatgtctaaataaattaaacatagaagttaggtaagataacaactttccacaacaataaaagatgttacttacataaatgttttcccccatcctacatagagctttcataaaagctaatcttactagagcttgagcaaggcagtctcatttgaatgttgtaaatctaaaatatatagggctaatatagaaggaaaaaaaatactaatgtaggaacactatctatttgtgttttatttatctatatttttatttatatctaatgttaacaatcttcaattacaattactacatgatattttatttatttatttaatttttaatttatcctgaaggttacatgctaaaaaagattatattaaaattaacagtggatcaattatttatgactttggtgtcaatgaaaaaaaattcaaaatattaaatttgacatgtgaaacgtaaataaataaatatacgtatttaaaataaaaaatatttcataaaagttaaaattggattatattttatcgaaaaattgatcatgtaaggtttccccctctaacgttatcttccatagcatatcctcataggaaaactcttaaagttcaaacctcccaaaaaggacaattatcgaaagagtttattaattgcaatagtgtgtgaatgattaactatgacaatgcatttaagaataggacaatatttatatgtaatactttttaaaatgtatttttgtttttattatttattcagaattgaaatttcaccttaataattcacttccttctttcgttccttttttatttgttaaatttttaaagattttttttttcatttttatatgtagtttgcagagttcaaaattatattaattatacgtacttttatgagtttatcaattatatccttaattgttttttatctttaattaatttacacatatatttattgtggagtaaaaagataaaagagtgaaatagaaaatttaacaactattttatcataatcaaaaaaaattattttatttattggtttctacaaaaacaatcgtaaacgacggataaaaagaaatggacgtaatatataataaagatttatatgaagagtcaacataggttatcaaagattaatttcaaattaaaataaaaataatacaaaaaaccaaattgaagcaccacatctaagttttatctttaactgaataaaaaaaatctgttttatcctttcgaatatactataattaatattaagtattaacatgcatattttaaaataaaatataatatttcataaagaattaaaaaaggtttatacttttattaaaaatctgattatatttttttttcctaaaattatcgttgcaagcatatcctgagggaaaatttaaagtttaaatccaaaaatgataagtattaaatgtataagaatttaaatcttaatttgctagactgactttttacgttacctaaatcaaatcccattattttatttgcatttttttttcgtttttaaaatgtagaattcacgtataaactatgcactttttcatttcgttgatgtacgtataacttatgcacttaaaacaatatatgatactaatatttttattgagcatgatatcacagtcacttgtcaactatgttattaactatttagcgaatctctaaaacaaatgtatctttagtaaacttattgtattgtttttttagaggagtaaacttattgtattataaatcaattattgttgcatttttatttgagaacaattaaatcccccttaaccaacaactaaagattttgggaaatcttttcatatttaatatatgataatatttttaataggtaataattactagaatatttaatttgtacatttaaattacatgacaattatttaatttcttttttttaatgttttttcttacttaaaaaattaggaatttaacttctttatgaggtatggaagttattgaaaaaattagaacactgaatttaatgtgcattatatgctcaccatgccaatgtacgctaagcgcatgtttaggatttagtgcatggtcacttaagacaattgtactttggatgtgtgctcagcgcacacatgcatacttagcgcaaagtcatttttgaaaaacatgattatgcaacgttttgaagattataaaaatgtgacaatgtgcttttaaagggagttagtcagcaagggcacaaaatagagcaaaagagtcacttgggagctcttcttccatttcctttgtttcatcttttgttttttagtctctcataatgattatgagatactaaattatccattgttggggtttgaataccaaatactctttgatgtagtgaattttactatccatttaatgttatttcaatattattgctttctatttaagtttattgtcttatttatgatttgatcacccattcacatgtatattatacgattttaatcattgaaaaatatttttaccctaagaacttaaaggagcttctaggtaattcatgtctataaataaaatgatgttatttacccttatttatgcatatttattcttaaagcaaattacttagtttaattcttaagagattaggagtgaaattatatgatttagactttttaacgtgaagaatcatgattagagtaatttagttaatgaaaataatagttggaatactttaaatgatgaatatatatatatatatatatattagatataaataaaaaattatatcatttctttttttactggaaaaaatatattaattttaaatatcagataatacagtaatagtaatgaaataggaataataaattgttgggttacattgtttctctgatttctttagaatggataggtcttctatatacatatgaaccttttttttcttttcgtatataacaaaataataatataaaagcctttatatatcaacaaattaggttttagaaaagggactaataattttctacaatgtggtaaaaggattgccttcgaaacacatggtaaaataaatacataagtcttacacatttattattcagggatgatgatttaaacacgctgtaaaataatgtctatgattttggacacttcacaattttacaccagtaaactccattggcacataagttttctcagtctccctcttcctattattaatcatatgtattatttgtcatatttatatttctttggtgtaaaatatatgtgatagatgtttaagaattatttttgtaaaaacaacttaaaaaaaaatctagatgtgttaaaaatcatatatgcataaatcggaataataattcctctttcattcattccctccattctcttctatattttccctcaatatgaggttcttatataagagagagaaattcaacaaaatgctaataatacgggataataacaaactgaacaaactataacaacctaacaaattctaaaaataatttgaaatttaaatatacaattcaacactcccccctcaagttggtgcatgaatatcggtcatgcccaacttgccaattgcttctttaaacactcttctaggaatgactttgatcagcaataagttcaagaggtgcttcagaatagtccacgtgctttggttatgtgaggtagaaagaaaattgaaatacgagaagagattccacatgcttcggttatgtgaggtagaaagaaaattgaaatacgagaagagattcggaactgttcatgtcaataaacttcagggatggtctatgaagattcagaacaatgcaactgacttcacatcaatgaccttcaaatagaatacgtgcaggaagacttcaatactgaggtacgagaatgattcaaaacggatttatgttatgccgtttgtgttgttttggggaagaaattaagatacggtaaggattcaagtcagaaccaaagatgtgaaggttatgtgagacaaagattgagttcatgatgataataatcataatttgtagaggaatcggagaaagtgaaggttaaggaggaggtagatggttgggtatttcagaatcagaatcggccatcaaagaagggagttaggaatttgagagaaataaaagtggaatacgagaagataaaaagaaatgtacgtttgggaatgtgaagaagaatacatttggatatggaatggggaagaaaaagactctagtggcggaagataattttgttcatggaggataacctgactctcattcatggaggaaatcatgactgtcgttcatggagggaaccatggctctgataccatgttaaaaatcatatatgcataaatcggaataataattcctctttcattcattccctccattctcttctatattttccctcaatatgaggttcttatataagagagagaaattcaacaaaatgctaataatagggaataataacaaactgaacaaactataacaacctaacaaattctaaaaataatttgaaatttaaatatacaattcaacaagatgtgtataacccacccaatgaacaaaggccacaccttggcctcccagacgtttacttaaggctaaaacgacagctaaccacaaagtacaaaccaatctcgtaaaacttattatttttttggtgaaatccaatcacgcaaaaataaataaaaaacgaaatgagaaccatataaaatcgataagtcataaagagtaataccaaaacacacgcaaagcaaatgaagtagtaagagcgagagtgtgatagagagaagagaagaagaaagggtgagagataatgcggtgttatggtttaatcgtaccgggaagcgaccagcgcttctgcgtccccaccgtatctccagtgttcttgaggcccaacaaacccattatcacgacccgaatcgcgtttccaaaggcgaccctgaataagaacgagggtttcgtggtggagctgagcttctacgagcttctgggcatacccgaatcgggttcggtaacggagatcaagaacgcctacaagcaactcgcccgaaagtaccacccggacgtgtcaccaccgggtcgggtcgaagagtacacgaagaggtttattcaggtgcaggaggcctacgaaaccttatctgatccttcccgaagagctatgtacgataaggacatggccaggggcatcaacttcgccttcaacgctcgtcgacgctataattaccacgatcaggttcgccagccaacttagggctttttaattattccattcattttatttgaatcacatgattcgccatttcaggagatataaggttggttgggtcatgggtggttaagaaaaaagggaagctgctaacaaactaaccattatcatttgtcgccatttgaattgtatgatttggcaagtgtaggatgaattgcaaattgctttgaattgttcgatgtatgatatgattcaataatttgttgtgttttctaattttttgggtggcttttcttttaacagtcctcgttaaagatattgaaaatttaaataagtttaaattgtgaaataaaaaggaatagggaattaggtatagtgctgcttagtgaatgttgtttggttgttcttttactttgattccatttgcacagtctctcgctctgtgcatgctatttggttgttctgttctgttttttttttttttttttctcttaattctgagatgacaaagggtttgcacacttacactaacccacccaatccatgtgcccttatttttgtttttgttttaacttacgacatattacatatggcttataatgtttcgtgaaacttatggataatatgtatttttttttcaattcctagtttaaaattatacattgagctctatacatcgtttatctgatatactagggctgtttttcactttgtgtctaaacttatgatttgatgtgagttaggattcacaattgaaaaattagcttggtgattcaaaatttgatttgaatttaatctaatctgaaatattgtcttactactgatttgttcacctatctcagtcagcaaacaaagcaattgactgtaactttgacctggaatgggaattgcttcatcatgcacgtttgagttctgatattttatatttctgggtgctttttataagttagtaataggaacttgattctttctctgttctatgttttttgttttccaaaaattacagttgtagcggtcaccttgcttctattggaattctttttcatgatggtatcacagaatcctcctgctgtttgtgaacttatattaatatttaatgtgtctattacagaatttgacttctgctctgcacctatacataattgatatttttataatttatgaggactattctggcttttgttctttttccatttttttccttttcgaatatgtcgacttgaatcccagcctctccgccacaaaatctgaacaagtgtgttgtagttgcctcttcagcacatgaaaatctgtttacaagttaaatttctttttcatgatggtataacagattcttcctgctgtgagcttgtgttattttatgcaatatctattaacttctgcactgtacctacacccaatcattctattttcataaattatgagggctttcggcagatacttccttatgacgtttcctggtaggaatacattgtttctggatttctattacggcttttgttctttttccaaaaaaaatttaaatctttttgaatatgtcaacttcaatcccagccaccaccataaaaaattaaaaactgaataagtgtgttgttgctgtaacatgtataaatggctcttcaacgtattaaaagtctgtgcaagctaacagtgtgaaaggatataaatattagtattattaacaataacaataataatgatgatgaaacgtgtctgcgaatgagattgagtgtgatcttaattatttctttattcatatactactgttcggaaatttctttttatcgtggtaatgagtaagtgggaattcataaatcatgcatcctaaagagatagggatttcttaatttactgtatttgcttgttcagttgtctaattcactttttttccccttctaattttaaattgaagaaaagcgggtaaaggtgtttggctagaacactaattggtttgctcactgattctaagctgttggttttgaatcaggtggttgaacaaaaaagtgaatggaaagctaggtggaaatctcaactgtcagagctgaagagaagaagtaacagcaaggatgttggagggaatatgtcatgggcagcacgaatgcgccagcagaaggatgaattgtcaaatgaatcatgaccaggattttccttagttctctatatttaatgtaactagttgtatatatagacaatagataatgtgtacatcttcgtactcgagatcaaatcagatataaagttgatgttgagaaaacgtgcccttggcccattgctctactcacagttttaagcgtgctaactaatagtcggctgaattaacgtctctaggccattttagtgtgttttggttagcatttgcaaaattggttttagataaaatggcttttgaagttaatggatttatatttagatcattagatgattttattctaaaagcaagttagtaataaaatttaggataaattttttatttaatgcaaaaattatttataattactttaactcaattgattagattaagaattaacttcttaatggaaaattaaatatgtgaatattaattgaaaattatgttcgttggtatttcaattgtaattttggatattctaaggggaattcaaatagtgtttatataataaagtgagatttgagtctagtccataaaatcatggtaactttataaataagttgaagctagtacttaactatttatagcttcactttagattttttaatcaattatgctaaaagtgattttaaactagacacactattagtgtaactagcagctagacctgtgtattgcaaaaaaaattctaagaaaaaaaactaaagaggaagggagaataaaaaagagtaaaataaaataaaaacttaaaaaattgttcttgaaaaactgttcaactgacatgtagcgatgtcttgacaatttttttaatactttatttatggattgttctgtgtggttgttattttggctgtgagaagattttggggtgcctactgatgtgtaaggtgggagggagaaaaatagtttggacctaggttgccagcaagtgggattaggaactttggttttcgtttatgcatttaaatggacgagtatcaagggtcaaatatgattgaattttctttttgatccggcaaaattgatcgaattaaactccacaaattacacaatttggaaggtggaaaaaatttctgttttggttaccaacaaatttgtttcggctgagaagatttttgggttgcctatttatgtgtaaggtggaaaaaatttctgttttggttaccaaccagtagctttaggaagtttggtttaatatcaagggtcaaatatgatcgaattaatctccacaaattatacaacttgaaagccccttatgaaacgtgtcatatggtagttatttgggcggtgagaagattttctgggtgcctatttatgtgtaaggtgggagagagaaatataatttcggactttgtttttttttttttttttttttttttttttttttttccggaatgttttggactttggtcattaggaactttcgtttgtcaagggtcaaatatgattgaattaaactccacaaattatacaatttgaaagcacctcatgaaacgtgttatattaagaaaaaatgtgtatgactttaggggtgatgttattcgccaattgattgttagttttaacatttctcgaaaaattaggatctattttatatttaaaatatacagtaatggtaattaaaaataaataaatttgtgtatccgattgtgagttgttgaaacaataattttttttaataatgtgaaaactctaaatatatctatattgaaattaatttctgctatcaattttttaataagagaaactctaaagaacaacatctttttctacttttcaagtctaaaaattaaacttgaatttctactttgatctagtacactctgatttcatgtaaatgtttcaatttataatattaaatatatatggaatttataatattaaatatatatggatttgagacttttaaaaagagagttttatttaaaataatttcgtatctctatttttatatttgaaaataaaaaacatctcatatcttttttatgctaagaagtttcctaatataagaaaaataattatcaaataatcatgattaattacgataacttgtcacatgatctaatcttgatatgtagcaataaaaatttattcttatttatagacaactaccacattttatataataataccctttatttatattaattatattcttggtactaatgaagaatataataatattctactaaaatatttatttgattaaattaaattctttaatttaattatgaaataatttttttttgcaaaaattggaacactcgtttgtgtgtgatctagtaggttcaacactagaccgatagtaaattaatcacaattaatttactaatcaagataggcgtctaacaacacttcttaaggtccggataacatgaagtaacttttttttttaccttcaagaaccaataggagaataacgtaataattttttccatcatttacagctcaaagttaactctaaagtatattattactatcaaattctaataagttaacatattatatttaatcaatggatgacttaagaaactcttttctcctttcatttaattgttctagtcaaggtcttaattttattatagaactcaaactcattacctagagttgatgattttcttcttaattaatcattaattctacaagtatttaatcatatccaatattcatttaactagtatcataaggcattaggtgtccaaaattaaaatataacaaataatttattaattactatgataatctcaaattaaagaaaattattatatttcttcttaagaacttcctattggcatgtcaaagtaatattaattattaggaattctcaattgagtcagttaaataatgatattcacatgtaaattatcttctatatatgtaatttaataaatgagattcattaatttttattcaataaataccatcacatatatattgatctatctgaattattaatgtcctatttagaataatcctactatcaagaacaatttagattaaaattataaatgaattttttctcattatcatattctgtatcatgataataaatctttaactttaatcaaagatttatcaaattaataatttaataaaaataattataataataaaataaaaaataattctttacaaaaattaataatataataaattggatgttggatatatacacacatttaccccaacagtgataaatgaaaaaaagtattggtttgattaattatgcagtggttggaagtaggaatcaaaaggaaactggccgaaattggccaaattgaatgagcaaaataacatacagaaaatgaagcattatgattcggaagctaatggatatgaatacgaataaggtaatatgcatctgagcatatttcaagatgttgtgaataaattgatgcataaaagttacatcaggtgatgagttgtgagcattgcggttgcttggtttagtgtctgacacgtgtaagttttggtagtaaatcgtgacgttgattaaatattggttaacattatacatgttttactattttgactgataactaatttatgtcagaaaattttattaattatctttaatgtggtttttttttaattatatatatattttttgtttataaaatttaaatttgaaatcttacatataaaaaaaattgaatctaattttacttggaccaataattgttcttgacattgattaatttaactttaaattaaaactaaattgacattgtcaatggtacataccaagttgtcttgtaaaaggagggtatggaatttgattttccattaacttgacattgtcaatggtacataccatgttgtcttgtaaaaagagggtatgagattgatttcccatgaggcaccgttgtccttcccgttcccatatccatacctacgccacatgtcattctcccgaccaaagagagagaaataaagaggaggattaatttgcatttatcaataaaagttgtaatgccaaagtgttgcaaatttgtaacttgtgataactttctataagataaccgtgaagtaaagggtgagtggggattcttcccatttaagagtcataagttaggacaactaataatttcagttgggggacagggaatgggaaaagaagaatttgattctaatttctgatcacatgtaatagtttcaaagtatgtttttcaacaacaaaaggtcaatctagtgagatggccccccttacaatcctctttgttatttccaacaatgaaactaataattattaaaaaaaatacattacttacttgcaaccctatatatgaagaaaactcttggtcaaaaatattgtctaccatcttaggagcaacagcacttggaatatgcaggtgaggctatgaagcatgtccctttcccaaagcctatgaacttgcagtgggcatcacagcttggagtgtcttcgcatgatccaatacagatctgttggctgctcacagcatctgaaaatataacaataatcatggttgctactgcaagaataactttcagcaaaatcattgaaacaagtgaacgaggcactcttgtgtacgatcgacagcttattgtggcactttgtatcctgtttgttgtgtcttcttttttctgagtaatgatgttgagtgttgcagagaacgaaaatagtcctttaagatttacatcaaaataaattagtataatatatatttctctatcaaagagaatcaagtgtaattttcaaaagaaacaggagtattgtgtatatatattgatcactcgagagaataatacagtgtatgttttaagagctaagcgagtaatgtgtaatttcttcaaagtgagaagaatattgataaaatgttgttttcattttttaaagtcacaaacatatttttcaatccgttcttgttgggcaaaattataatgttctgttagagagtaattgttatgtgaatataataataccaatagacagaataaatatcaaaagcccagaatgtactaaaacataccaatataaaatataaattcgtgtcatacaaagtattatttatatagtgttaggattttttgtatgttctaaaaataataaaatattacatcgagttgagacaatatgaaatgtaatcacagttttttaaatcaaaccggctggttcaaataaatatcgtcctattattcggtccgtcacactcttaaaactattggataaagaaccgttcaaaaaccggtaagactagtcaaaaaccgtacaaaccggtaaaaactcaaggtgaagtaggttgaaccggtccaacgcaaaatctttaaactaacatcagaggaacatgcataaactaactggtcatcaaatataagacatactcaacaagttttttttttattattataagatttcatttcatgtataaattatttttaactaaattactttaaattatctttttcttcacctatgaaaattggaaaaaatgaataaattttcaataaaattaagatttttatattaaaaaaatataataaatatagacaaatttaatgttaataactaaattgattaaattttttattaatcatgaatttatcaattatatcttataatttaaaacagatgaagtaagaataactcaaattaatttttaaaatatatggagtttaatttttaaaagggactcaagcccaacaaactaagtaagactaagcaacccaaaaacttgctacatcagcatgcagcaaataaactcaaagagctagtgcaggacaaagccttcttaaccaaaagcatctgccaccaaattggtcattaacaatccttctgacaaaaaacagaggaacaacacgtaaaatatttttattgcaaacaatcttgtttgggtttgaaatatggaaaatctataaatccccgtcattttgtgttacaactctttatttagactataaaaatgtcaagatcatactatatcaaacataaactctttttaaatgtttagagtttagactgataattgatggatgcattctcccacggtcggttcattttgatttccaatgttgtctacactaagcggtacaatgtacaaaattgattgtcttgtacaattgttgcataaatggcactaaatcgtttccgctcaaaattatgaatctatccctaagttgagtttgttccaaaatatgataaaccacacagcacttatttatctatctatagagcatgcagaacttaccattccattcatgcatatacagcatttcattcatacttataccctataataaatatgtgtattaaagtcaaaagcatcaacactataagcgttggtgtttctataaaataggaaaagcctgaactcaaccatggttaaaataggttttctcatcaacatcaaatcggaatcagataagtatttacgagttcaaatttaattgttatgtatagaattacgtatccagggtatccttaaaaaatagtcccaagtgagagaaggtcccaagggtgttggtccctaccatcgctccacgtttatttaccttttttatgacaagaactttcttaaaaatagccccaagttaccaattcaacactatggatttaaaagaaattaaaagacaacacaaatattaacaaatcaacaaattaaagataaaaatgattgtcacaattaatttaatgggcttgatcttcgcaattttctttagtggagtcaccactaattttattgaaatatggaaaaaatgaaaaatcttaaaatttaagagtcgcatgtgcattggaaaggtagaaattaaatccaacgtcttctctaaatcacccatcccaatttttttgatgaaaaaatcacccatgccaattgattgtacaaatatttgttttcttattttaacataaataagagaaaaataattttaattccatgggtgaaacctactcatacggtgtagtaaagaactaaaaactcacatagtttgattaaaaataattgtgaataggttttttttttttataaaaaatattatatatttttaaatcaaataaataaacttcaaaaaatgacaaaagaaaatatacatcgaaaacggtaactcttgacgtctcaacatctcttgaagtaccacaattttccaccaaaagacttttttgatgcatctaccttttccaccattttttttaccatgttccattttgatctccattaatcttgtcaacggtaagcatgtggtacaaaattgtttgtgttgtaagtggttttccaagcgttgcttcaaattgcaaaaagaaacatttttatttatttattttaaacacctttctaatatctttaatattttttttatcatatcataagttgtataatatttatattatttttttcagtcactaggtgtctaatgatatgatggatgtccgttcatttttttttttttgtgtgtgtcggtccatccaaaattatgaatctgcccctacgttgagtttgttccagtacgtgataaaccactcgtttatttataagcccgaagaacttaccattccagtcatgcatatacaacattttattatggagtgagcttcttattccctcttcctattcacctttgcttgcattgttcaacactctgaatcgttcaaattccaaaaacttgccacttggacaatggaaactaactcttctaggtaagattcaccaatttctggggccacttccccaccaaactttggcaaacttggctaaccaacatggacccttgatgcacctacaacttggtgaaaagccacacataatagtctcttcagcagatattgacaaagagattatgaaaactcatgatgccatctttgcaaataggccccatcttcttgcttccaaattcattgtctatgatagcagcgacatagccctctcttcttacggaagagcttggaggcaactaaaaaaaagttgcatttcagagttgttgaatgcaaagcatgttcaatcactaaggcacataagagaagaaacgattataaacttgttagaaatgtctgtgcaaatgaagggtcaattatcaatcttattactaaggaaattgaatcagtgacaattgctataattgcaagggcagctaatggtacaaaatgcaaagaccaagaagctttcgtgtcaacgatggagcaaatgctactgctgttgggaggtttctcaattgctgatatctgcccttcaatcaaagtgcttccttggctcacaggaatgaaaactaaacttgaaagagcacagagagaatgacaagatcctagaaaatatggtcaaggatcacaaggaaaataggaacaagcatggagtgacgctcgaggattttattgatattcttctcaaaactcaaaagagagatgacttggaaattcccttgacccacaacaacagcaaagcactcatgtgggtcggtatgcattattctttaggattactttgaaaatttccatatatacaactatatacatagatatgaaatttactaacataataaattacacttaaaatatatacatatatatataattgaagtagcaagttattaaaatattctttctatgcaaataagtgattatacttgttttcttaagaagatatacttagtttatcagatgatgagctctaataaaataataaaattatattttggttacttattaattatgagttcgaatttaaaaataatctctattttatatatactttatgatcaagaaaattaaagttttaccagttaaaatattttctctataaaataagtagataacaactctctcttttcctttctttctttattaaatagattatatttcattttcttctattcttcttttttctgttcctcttaatttaaaagatatggattgaaataggatttttattttatcctattatgaaataattaaataatatttttcatttcatttatttggttctattttaatgaaaaacagaacaaactataccaatcccttgggtcatccttaaatatctaaatgagcttaccaattaatagcaggaaaaacagaacaaactatacggctataccttaatcccttgggtccacctcatcactccccctgttgctaattggctacatttttattccttggccaatttcgaaagggtccctaaattattgccttcttggaaaagtcttcaactgcctgggtgcccataccccatgcccattttgctttgcttctttcccaaagacgtgagtgaggtctacgttgcttttattttttgggaattgcgatgcgatgtcacataagccactactacatatgtttttagcaacatttaactacttaatgttatgaataagaccattttgtaacatttataaaaccaaatgttactaaattatgatattattttttaaaatatttatacaaagttaaaatattgtcaaaatatttttcgttacattctacgtctctcaccgcacgtttgttcatgacaatgttcccacatctctcacgccaacttttgtcctctgtattcttatttttctcacattgcagtttcttatgctgctcatcctataaaaatttaaaaattaataaattaaaatattatttgacccttttttatttgaaatgttaatactagttgtaattaattttttcggaaagaggtaccagctttggattgtgctacaccacatatttagctttattatcaagagtaaattatactattcctggtgaaatctctcctatttttttttatttatttcatcaataactctttcgattgtttgaaaaatattacattgataatttttatatattacactaattccttaattgtgatcatgttttccataagaaaaattgttgtaaacattagaaaggagtttgacaagtatacaaaatgtcattagatattaatctaatttactctattaataatgttctaaattagattgatggttaattaatttcaggacatgtttgttggcaggacagctgcaccaacagcagttacagtatgggcaatgtcagaactcatgaaaaatcctaaggttatggaaaaggcagagactgaggtaagaaaggtcttcaatgtgaaaggttatatggatgaaacaggccttagacattgtcaatacttaaattcagtcataaaagaaacaatgaggctacaccccctgtgaggcattattagtctcaagagaaaacagtgagacatgtgtgatcaatggatatgaaatccctgcaaagagcaaagtcattatcaatgctcgggccgttgggagagaatcaaagtattagatgaagcagagaggtttgtagataactcttattatgatttcagtggcacaaactttgaatacatcccctttggggctggaaggagaatttgtcctggacctgcattttccatgccttacatgttgctgtcactggctaatttgctttaccattttgtttgggagctgccaaatggagcaatacaccaagaattagacatgactaagtcttttggcctaactgtcaaaagagcaaatgatctttgcttaatccccagtccttatcacccaacatcctaacttggccatcaataaaaactatatgataacctggctaggtgtgcttatttatctttatcaagtgtattagaacgacgtgtggtgataaagtgacttgtggcgtgtttgtttcacggattaaaatgaatttatgagaatataatattcttatgtatgttatgaatttggaaaaaaatattattccttaaaggaaaatagttataatgatttaattaacttttattttcatgaagagtgacaaagatatatttccatgaaattgtaggaaattatgttctaatccaattataacttacattttaattcttgtttttttattttaattattttaattttgaaaatattaaaatttagtcaaacacacttttaaatatctcaagaatatacttaaatgattacgggctatttgtttcacagccagaaatgtgaatttttcatgtttgttaagaattttgaaaaatattcttgagtattgtttatccacattaaaataatagttataccatcatttaattcatttctattcatgtgataagaggtgaaatagttatatttctatggggttgtaggaagctatacatgttcttgcccaattataacttccatttcaactcttattttttattttaatttaaaattttagtaatatttttagtaatattaaaaatagacaaacacattaatatgaaaatgtgatacaacatcattttgtgaaataaacacattcttagagcatctttaatgctatatcttgagcaaagatcttgaatttaagatttgatcttcaccagatcttccaataaaagaaatgaagagatctccaacatggagaataagttcttatacaaaatttctcaaaatttgcgcattgttcaaaaaagaataaattttctctctctttatctctccctaagatctcaaattgagatctaccattaaagaaaaaaattagaaagattttaagagatatttaatcctatgtggtactatagggtccaccaaaaaatggtataagatctcaatttaaaatctaccactaaagatgctcttaggtgtatttaatcagacatattattaatttatctttattttttctttaatttattttaaaaattaatcacttattaatagttaattatttctactatttttttgaaaaataacgattaaaaagtaacacttccaaatatgtacaaagagagcaatgatgtgaagtactcctttattaatgaaggtgatagatttaaacttcttaccaataatgtagctaaggataaagatggacgggtgtcctcttgaattacatggctgtattctatcactatgttaaggataaatatgtataggcgacatttcattatgtaaataattttaatttggattaaatgtaatttttcatcatctattttatttaatatgtaattttgatttctctattttaaaattgagatatttatttcttttattttaaaaaattcataattttgttctccaatttcaaaaatacaaacatttgatcctcatattttaaaaaatatgtaattttattttatgtattttatattttagaaaatttataattttagttaaatctttaattttgtcaatgtttcattttttttatttctataattaattaaattatttattaatgataccttaaatgaatattttagatttatgattcaattaaatcaaaataaaagaaataaaattagacaaaagtgagaatttgaccacagttacaaattttttaaaatagaaaaattaaattgtgattttttttaaaatagaaggactaaatgtttctattttgaaatgagaaaattaaaattacaaattttttaaataagaagatcaaatgtctcaattttaaaatagagaaatcaaagttactgaatgaacaaaaataggtggaacaaaattacatttaattcttttaatttaacaaagtttcaatattatatttattttaattaatcaaatagttaacattttaagaactcaccgtcttaactcatcattaggtgacacaagtatgattgtgtggctgaagtaattgaggttgtctttgtttatcattgtctcgatcataaggataaattcatagcagctagccaccataatatttaagtcaattagtattaaaatgaaatccaaataaagaaattaaactctagctgatttataccttcaaattacatccttccaagtcaatttaagatttgaaatttggcttaaactcaatcttcaatgcctataaataaacatataatatatggaaaatgaaaggaaacttcaaagatagccttaggctgaaaacatttaattgcaccattgacccttgatttgtgctttataattttttatgtgcagatttgtgctttttaattgcaatctagaacttggcatattattttatctcgaactcctaacaaccattttaatgaattgtcttttcattatattaattttatgtttttttcttgaagaattgactattgagggtgaacaaatacatgttctttttttttttgttataaatgtttaaaatttactttttttgacagaaatttaaggccaaaaggaagtatattatataaaggggtgaataaacaagaggtgcagacatccaaatcacaagctgtgaaattgaatctgcatcaaccaaaaaaacaaccgtaggaagttacatggaaaaccgaataccccaacaaatccctacgaggcatacctagcataataagtaagaaccccaaagaccttatcccgtgtaccgatttccatcgacggtggtgtccctatgaggagagacctcacccgcgatacaaatcaaatagcatcaccaaaattaaaacagtcctttcaagcaaattaaatgacatgcttgacattcaaaaaaagagaaccaaactgtattattaataagctctatttagtttaaagttagaatttattttaatagagatatttttaaaactatgacgtgtctcttaattttgctgtaaaataaaatatgtctgaattttagtttagttttttatattaaaatgtgtgtttgtgaaatattaattctttgtgtaaagcaaagcaattaagttcttttttttaaaaggaaataatttatttaataaaaatgcaggaagaagaaacacaccacatcatatctatgtttaacgtgagacaaatatgactttaaagtttaacgtgagatacacatgactttaaagtaataaattatgtactacaatctaaaagttttccatgctcacaaacataccaaataaaaaaaattaatttgttgaaaaacacttaatctcattaaaacttaattatcctcaagtagaagatcgattatcttgagctcaaatttaagcttcaccatttcattctccggcataatcatggtcacaaacttcccatcaactccattcttgatagaaccttttggccacggatacaccaaaacaaccccttcatctccaaccccttgaagggtgtagtaaacaaactttggtgtttgtcccttcaattgtaggtcatacacattggtttcttccaagtctagaaatgtcaaattgacaccatacacaaagaaatcactcacaccttggtctctctcaactgcttcctcaatttgcttcctctcatccacaccttgatccgcaagcatgctagctaagattgtcaaatcagtgtcaacaattgagcattcacttccagcctcaaccttgcatatcacttggttgttacctatgatatcatttgccctcttatacgggtcggttctacacacggtcacggttttaagttcggatcctgatcgaacccgagccacgcaatgccaaatcatggcacatagggattcaaaaggaggagtttggtcaagacttggaccccaaattcgtgcttgcaagtagttcaaccgggagctagttaggtggaaggagaatgtgtccatttttttgttgttggctgggatccaatgatcccccaccgggtcaaaccgttttgctgaaactggatccttttccggctcgggttgtctgagtgttgggacggatcttgggatgttaaaaagctttgttaggccatttttcattattaggccccatgagttaatgaatcctgaagccgaaagcgggtcccccaatacatgggcccaactaagacccaatgaaattccaccgcacttaaatttagttacctgcatattgatcaaacgaaaattgagttacctgcaaaagccaagttgtatgatttacagtgatagaaggaataaccatctagaaataaattttcagatttttttttttatatttcgtctttaccaagtaaaaagaaacattaaacgtatttatactcttttatctaaatgagattttcaaatttttgcttctaattttcttatgtaaaattttgcttcttttactattattgtagtaaggatggaacattttaaaaatggagataagacatcaatgatattaatgtaattgtcttttaaataactttcgattatatttaatgattaaaaattactcctctcacctaagacgacatctctcttaattaattttttaaaaaacatttttttattatgcaaattaggaaaacatctttctgaacttttcattcccttgttcgtgtattaagcattaaaaaataaaaacaataataattttaccgtattattatttttgatgacttgtgtttaattcgacaatttgttgtatataatatgtaaaattatattaaaagtccccaggaaaacagtctttatcgaatttaaacgtgttaatgattccttaaaaaaaacgtgttaatgataaacttcattgtataccaaaaatatgagcctgataaactcgattctgatcaatatcggcgtatctatatagaaagagtctgatagtaaattaaaacttcattgtataccaaaaatatgtgtatgataagatttaaagataggtttaaatactcctacaatatccactttgttactctatgtagtaggtagtattaaatattaaatgcttttatttataagacattaattgtatttattttttcatataatatttatttattaaatgttaaaaaatttataagaagattaacattactaaaaatcaaaatattacctcggaattatttatatataaaaaacaagtaataatgtattttaacagtatacaagattctgtattaatgataccacctttttctttttttttttgttgaatagttaggatctaccttatctctcttatgaaaggaattgtccaccataccatactatactgcgttctgaattaatgtaagggcaacttatgaagataggatggtattaacatctctaccagaaaaacattgcgactaattaacaggtcactatttcaaccaaaccaggacaggataaagagggggttttcaccaagagaaaataacttcattatgaatcaaatgaaagtattctttaattaattcttaaataaaaagtaagtaataagaatttttacgatttttgagtataaagtcttaaaaaaattatgattttgattttttttaataatgaaatcataaaaaattcaacgactttattttttaaaaatatttatataataaatttttcaccactttaaaattgtgattaattttaaatgattttaaagtcggtttaattataattttatatttttgtttctactattttatttttctatcatgtagttggacactataagtctacaacttcatttttctcctatttcttttccttttaacatacttatttttaatatatttttcaatcaatataaaaaatgtatttgtacaaataatgaatgttttttccttttttttataattttatatttcatattattgtatttctattactctacttttgtgtcatactatcgtgcaagacaagttatggtataactgattttatttaatatttttatattttgttttgtaatttattattatttgttaaatttagaaacgaaaaggtccaaacaatataaattaataatataaaattaattccttatttattttatctaattattattggttaagaaaatattaatcaaaaaataattaatggttaagaaaaaaataaaagtcattggattataaaagaattaattattttaattttaattattctttcaacgactttaaagtgataaattataaaaaaaatattaattataattattttaaattttaaaagaactaaaaaattaattataaaatataaaattatgattaaagtaacttacaaaaaaaacattaatcacgattttgaaatagtgaaaaaattatgactttatataaataattaaaaaattaaaatcatttaattttttacgatttcactattaaaaaatcaaaatcatgaattttttatcactttatatccaaaaattataaaaattcgtacgacttattctcatttaaaaattacttcgaaaattactctcatttaattaattgtaaatggaattatctctttttgtcaaaattcctatagagtggtagggtccttacgcatgttttattgtactatattgcgcagagggggcacattaaatgaggaatattttaatcgtccattaaaaaatttatatttgagaataaatttttacaattgtatgatttgttttgtgtatattatcatatgtctagctgttatttttttaataaacaattataactaactaactgttttttaggaaatggaaaataaacagaaaaatatgattttcaaattttcttattctttaaaaaaatcttatttaaatttcaaatattttatctttctccatcttcttactgaatgaaacattggataaaagagtcgatgagaaatacgtgttgtacagctgtagtcactagcgtagcaggactaaaccccagttagtagctagtagctactctttttattgaggcattgattattgtatttggtaatccttcgcggctcacaaactagtatacaaagtatatcatcttttgaaatattaaatcaacaaagaaagaaaaacaccagtagtcctcaataactagggatgtggaccatttcatgaaaaaatatgggttggattgagattttgtgttcatatttattaaaagagtttagttgaactagtcggaccatcctggcctgtaataatgtaggtcaaatgtaggccagagccagtccagtccactaggttagtagctcaccaataaaaaataataaaatatttaatacgtaattaaataaatggtttagaaggagagtgattaagaagaagtgtacgattttgaataatccctaaccctaatatattttcatttagaatctaataatgagttatactacatgtacaaatatgttttgattgtctgcatcattgtaaaacacatttcttataatatgttaaaacttaaaaactaattgaaaatcattgttaaacatgtattccctggttgcttttacttctattagacatgtatttatattaaaaattattgttataagattaagttaatacatattattaatttttagtataaataattatatttaattttttaaaataattttttacctttttaaaaaaaatatttatttatttattttttatgggatggcccgctagtccactaacccactttaaagtgggacgagctagtatttttagcccactttgcaacagtgggtcagcctcgtccgatccacttttttgataggttggaccagtccagtccgtttctgggtggactgatccactttaccatccctatcaataacatcaacgaacatgtcgatccaaccttaagtaatttacatctaatataaattttaagaaaaatattttattttaaatgaaaatatatataatatattagaccttttttgttaacgtataatattatttttaataaatgtgtttttttatattttatataaactaaaaatatttttttatgagtctaaagctttaactttgtttgttttatccttaaacaggactaccaagtagctagggaaacaacgttgtacaactaaatttgtatctagagaaagttttaattaacttttttctttttaggaagaaaacttataaaaagtctttggttttctgtttataacctttggactatatttggatggtggaaaataagctttaatttactttatatatatgtttgataaaatcactttcaaggtatttataactgaatttcaatataaaaaaattctctttgtcaagtaggcgaaagctattactacttcacactcaacaaaaaaccttatcgatgcaaaataaatatatactccgaaaatatttttatactgtattttaattgttcattcaaacgaatgacaggaaggaaacagctaccaaaaactacgagatgaagaccccatataactaatgaatacgggacatcgtttctcattgatttttgattttcaaaaatatattttccattattacttggtaaactagagacaaactagacgttcatctcatagtgttaattagtactacaaatctatgaaaatattaaacaaaaaagtaaatatatacaccaaatttaaaacataaagctctctctcccaaaataaatatcctcttacattattttacaaaaataataaataaatgaaggaaaataatagtctttcaaaaaattaaagtgatatttattagagttattggtggaaagtcattctctttctaacactctctttgtgattaattattttttaaaattatcaattttgataaattttatatctaaattataaaagagagtcattaaatgataagtgagatccatcaaaacttaaacaagtttcaaccaataactaaaaagtgttgaaaaagagagtattaaaaataacgtcactaacatttctcttgatgaaaaagagaattaatgttacattaaaaagtcaaatacaatacttattttgaaatcatttttttgttaattgcaacacatcggatgtggaataaccaatactcaacattcaaaagaaatataaagattaataagaaaatcttcctctaatttcattgtggcctttcggtgtctattttcctttaactttattcatcagttaaatattaacaattaaaaaaccttttatctcaattagtttgaattggttgtattttgatttcgagtgtgaaaattatagaaatgaaatattccatttcatgattaaaaaaacactaaaaaattcctatgaaagtagtactaggttttgtcatacataaaaaatgaataataactaataagtgtgtgtcacgagtgatgcataatatataaattagtatagtatgtatagggaaattattaagcacctgcaacaaaacaggaggagaaaaagataattctgggccaatgacttggtgagagacgagcaacttgtacaagggccaatccttcatggctagccactcatctagggttttgttgcacttggcctcaatgaatcttgctccacaatcattgcacttgattaagggcctacctgaatccgatcgccgaaaccggccacatgtgatgaagtaatggttgaacaaagtgaacatgccatctttaattttcatgatggttaggtcttgtgcagcttcattatcaaagaagtacaccactctaaggtagtgaagcttcatagccaaatccaagccactagggttatggaacacatctgacccggtggcccggcctggcccaaccgaggatagcctcacatcatgcactacacactcttctaagaccattttggtttgatcctagaaattgaaagcaaactctttggttggtgggatttttttttgcttaacaaaagagagagagagagagagagatcacaagggaaaactggaaaagaggctttgattgttgtactaaagtgagtttttgcctacgagcatatatagagtgatggagtggtgtcataagtgaaggaccatggagtggctggttggagatttaatggaaacttactatgcgtttcattcccattgggtcgtacgaaataagcggttggaaatgccaaatataaatattattttttgaaacattattgatcatttacaaaactattttttttttaaattttcttcatattaattatttttattaaaatactgttaactattttagtccataaataataaatgctataaatcatctttttttctttttcttgcgaggattgaagtgttgaagaaattaggtttaaaaactgaaactcactgttattattctctccatatattaattatttagataaaaagtaattaactgaaaaaagtaacataattagtccaaatatttttaacagtaattttagataaaattacatttacaaacaaatttaatgttagcacttaaattaactaactttttaaatatatatttaaattagttataagtgtcttatattataaagacgaatgaagtaaaatattattactttctccatcccattattattgttgtgtaagaaaaaaattcaaaataattgtcatattaattttttatgtaatattaattaccttttttacttatattttttgtaatattaatgaataacaaaatttataaataaattatattgataatataaatttaattttataaaattattattctcttatttatttattattttttcttaatctatgtaaaataagctagaatgattattattttaggacagagagagtagtaaatatcttaaagatacttgctaaagaaattaataaataagatatatattaaatttgtactagaaatcctgaaagaatatattcttccacaatatttattttgatttttttctcttacagaacatttattatgattcagaagtagtaatattccatttctgattaaaaactttccacttttcgttatcattttccgtatacttcctctatttttttaaggatattcttctatttctttttaattgttgaattcttttacaaaaattggttactatctaactgttattttttaaaaaaaagataatgttaattattattttatcaattatactcttatttttcacttaatttttaattattttacacttatgcatttatttatagaatggaaatgaagaggatataatagaaaagtccacacgaatgtcatttgaataaaaaaaattattacattttgtgtttatatagaaaccttaaaagatagataaaaaaaatgaataaattattttttagacaaacattaagaacactgattaaaaaaaataaaagaaggaagctttttaataaaatacgtaaaatcatgttttctttgattgttaaatacattctcatataatttcttttacgattcttgctttcccttttatacccggactcatttactaataatgcgatcaattttacattgttccccacattcacatggcaattaatattatagtctggtgagtggtgacatctcaccgatttatagaggaaaatagatcgatgtcatccacattggtttgttacgctttgcagctgcgtatttatagtctgtcgtaaaggatatttataatcctaaataagaaaataacttcaataatttctatgaattaggtgtttcaactttcaataacgtttgaaccggctaaaacttatatatatatatatatatatatatatatatatatatataccatattattaatataaaatattaatcgatttttctgataatcaatatataactcatatcaacaacttcttgactcaaactatgtacggtttggatgttagtaggaagtatttacaaaaattcagaaggaataagtatataaacactcaaactgtgattttttaaaaatcaatattataaattttaaattattttatttactacccaaattatattattagcttggttattttatccagttagttggttactcctaatgatttttttttaaaattatcacactaccaatgtttcaaatgtacattgtgattatgagtttccatgtaagaatgaaaaaataaatcatctaattcatataatcatatttgaatggataaaatttaaaatctcattattactcaaaagagttatgtaacttttttaaaattgtgcataatttatgttatttaagcttaatcatttatataagacatcagacttgatcgaaaactaaagcaaatacagttcgtatattttaaacctgatatataacttttatttaaaataatgttttttttttaaaactgttttaggcccatatatcatattggattgtcctgtaagataggtgtgtactcgcactttaaattcgagtaatgtatatatagactattaaatcatatttatattatcaaggtttaaagaaaatgtacgtgactttgttacttaggaatcggacaactacttataatcttgaccattcatatgatatggtccatatttattgctcttatttcttacactaaacaagtgttgtcgcatgaatagttttcattctcatcagattcaagaaatctaatgatagcctatcttacatttttttttaaaaaaaaatatataaaaaaaatactaattacattttaactccaataatatatataatcaataaataataactaatttttaaataaaattttaacaattaaattacattttaaataaatatataaatttacctttttattaaattattattgttattttattatttaactattaaataattattatattttaaatatattgagggaagagtagagggttgtatccactttaagaaattgaagaaaaaaactcaactccaacctcaatcttgattaaagtgagttttcatgtttgagtgtcaaaattagtatggctgaataacggggaacatgctttcagaatgggggagcatgctttcggaatgcacaataccatgcatgcccaacccaaacatggcgaggccaactacaattaattaatgtccattattttgctcacaagatgtacttcgatgtggagggccaacgaattccattaatacatataaattttttttaatcatttactaatttttgacattcgatcttacgtttcatctaaaaaatcacaatgcaagttatttattatctcaatccactccactcatttataggtactattaattacgcgtattctttattttgattcattatattttataattattttattttaatatattaaattttaaaagttttatttttatcttttatatttttaaacgtattgtttcgattcttttttcaatgttaatagaaatgttagtgctctattaatttttaaaattttaaaataatcaaattaaatgttatatttttgaaaataattgatgaatgaaattattatcgttattaaatgattaaattgaatgaataaaataataataatataaaagtgatagttgttgtccgtagtttcatatctatatttttctaatttatttaatgatttttaattttttaaataaaaaataatgatgatttttagtcgttattatattaatttaactattctaaaatttaaaatactcatagacattaagtttctaataaaaaattgaaaaaagaataaaaaatgatacattttaaaaatataaaatatcataataaaatttttaaaacataatatacaaaagagaaacaaatgtgaaatataataaataaaaaataatattaaattattttaaaatttaaaagttaacataactctaatatttctaaagaaaaattgacaaaaagtatcaaaatcatacattttgaaaatataaaaaatcaaaataaaacttttaaaatttaatgtataataaatgaaacaattgtaaaatagtttttttgtttttaaagaaagtatatctaagttgtttttttaggggaatgatctaggttgttggaacaacaatattacatatgtataaattatactaatattgcactattttttactgcagcactataaatattctaacaccatttttgtatgttttttttttttgcaaaacaaaaaaacggcaaaaaaaattataagatttaattatattttttatcctcagtttttttttattattggcgaatttaatgattgggaataaattttgaacttttttataaattgatgataaaatgtgtcgaattaaaaaaattaaaaactaaaaaattagtaataaaaattataattaagctaaactataaactttatgttattaatgaaacatgcaagctagtaatctatgttggaccaacactgacctttcctgcgccttccctcactttttacaaatcatttcaatttaatttgagtttaaatttatgtaattaatactcgataagtataatttaattgcaagcacacgcttaatttgtgaaaagaaagtgatatatccaacctttgtagtttgtaccatatatcaccggaacgaatccagaaagacattaaaagaaggttcaacttttatacttttatttaagtatctaatttctcattgataattatttaataaatatatttaaaaaatatttattatcagttttatgtgtaaaattaaaaccaaaatcgatctactactaaaagaaattaagcattgtaccaaaaaaaaagcatacatttactcaaccttctatttattaatttattttcttttgtcaatattttttaattttactctttttgttttcatgtatataaaggagcatgagggcccttgtgcccctcctaaatctgtccttgtatatcactatcatattttttttattccattatttatttatcttgactatcattatatagggcgcgcaacaacttttacagtaactatatatcaaaattattttttaattcctatttaaaaaaatagtatttatgtaggaattatatacgtactataatgaacatatgataattaattggaataaataaagtacacgtgaaaatttacatataggaaagtaaaagatgcaactaattaataaacacgatataatgcatataatgaaaaatgaaagtaccacttcttatagatattgtatctattgagttataagattgatttagtaattgaataaaaaataaagaatggaggtaatggatttgagtttattaatgaataaaaattagcaaactatcaactaatatatgattgatctaataaaaagtgagactaaaaataaaaattgagaacgatcttttttcctttaaaaaatgatatctggaacttttttttgtttatatataggaatggaagaagtattgagagatttataacaattcaaatattttttttcaattttgaaaccttttaaccaacatattagatattttttacttttaaaatgttaataataattacaaaatttctgtctggaagcctaaaactcgagatttaattagttgttttatttttgaacaagccattttagtatttgtcaacaaaatatatatatatatatatatatatatatatatatatatatatatttgcatttgcaagctgtcaatactccattttatcaaaatttcgggatctaaccttgctaattcaagaatttcaactcccccattcttgcaaataaatatcttcggatcaaaataaaatatcaaggctctaaatcagccgaaaaggtatttccattgtccccattccccaacctttttgccgttcgtgttactgatgcaacatgcaagtatccaactcatctcacatgcatcgatcactttcatgttcatcaaccttcatcgaatttaaacaggtgtcaactgcctattgatagaaatgaatatataatgtcagagaaagtagttgaagtgaagataatagtcctacatacatttcatgttgatgttgataactaaatccgggttgctaagttaatatgccatcaaagtcttaaattcgatgtagttttattggtttatagctgacacctagacacttcattttgtccattgagctcaaggtaaaactaataactttgtgcaggacatgcttattagtttttgtccatagatcgaagtctctgtcaagttaaaagttttgaatgctcagttacaatgattttgattttaatttggcttatccaaaaaaaatttaaaaggtttggtcatcttacgtgtaataaataggtttaaagatgctttttcaagttttttaattagttttatctaaacttttgttatttaattatattgtgattgtggtgttttttttttttttaattcttattttttagtttttattagtatgttttatcattatagttagattttcaatatatttattaggttgtttaggtaagataagcatgattcaatgcacactaatgaattttgtacactcaatagggtgcttggctgagcattctttttgcttcattccccagcactttttaatcaaacaaattagcttacaaaaataatgccagaatatagcagtgaaattaagcatgggcgtggattaattactctcggtgacatgacattcagaatttctcttcaatataagtagtgggcatactttatcccatgagttaattctcttagctttatcctcttagcttcaacatttagtaggaataacactacaagaaaaaacgaaatttcagacggaaaaaatccgtcggtaatagcaaaaatccgtgggaaaaccgattttgcgacggaatttccgacggataaaaatccgtcggaaaaaggggcgtaggaaatgttaggcgacggatatttttttccgtcggtaattaccgacagaaaaatccgtcggaaatggctcgtgggaaatttccgacggattttaccgtcgaaaatactcgaattgggagtaccagaagcgctttctatgtcggttattgaagccgtctttgaatggtgtcctggaaagtcggtaccttctaagacggtttttaaaataactgtcttagaatgttatttttaaaaaaataaaaattgatcattctaagacggtgttttgcagaactgtcttagaatgtctttcttttaaaaaataacaaattcaataaacctttttttgcataatccttgaaaagttgtgaataaaaaaagaaaacccttaatattattaaaaccactcaccacatatgctccacaatgcttacacactaaattgagctagtatttcttcactaaattgattattacacataaaagaataatatagattcaaaagttaatcactgacttttggaatagtttaaatgagactttcttcaaactcaataatggattttggtaataattaataaatgttagttgaggtagatgttaagaatactacaaataaacataagagagataaaggaataagaacagaaaaattgtaactaatagtgatatatgcacaaaaacatggacagctttgcttcatattttagccatttggctgggtgttttccttgcttttgtttctttagaatatcccagactccccctgctttatttgctttctaataatgctttcttcaataaaacacattactgtaaatgcaataaaactcagaagcagacattctgaagaaatttatctcaagataaatgtatttttgtcacatcacgcatttagaaaacaaggatttttttcacccacaaaaaaaaaggaggaagttgtttactccatatttctcaaacacgtgtaatctatcagattttgaaataacttgtttctgaaaaatattacctttcctgtaagaattatctctctgagtaggccaactgcattgttttgaatgagatattctactatcttacagctccatggcaatttgggatcaattaacaatactaaaacctccaataaaggaatagctgagacattcaattcctcaggagtaaataaaagctaatcccttaactgatttctgtcaagttaaaaattaaataagcaagttagcaaagaaagcccaaaaatacaaatcagcaaaaatataagggcattttttggattattaaaaaaaagagtacagcaacatcaagaccaaaggcatgataccatgaagagtacaaatttctcagttaacttatgaaatacttgcaagtcatccaatccaatggccaacatatatgcacaggagggatgaagcactatttatctagtaaccatcatataggacatttttggtcacttgtatttctcatcatatagaaatagaatgctaagatgccccacattggctaggaacatggccaaacactccttatcagtcttggttaattcacatcaatttagtatataaaaaaagacaaatagcatgtgatttagtatataaaaaagacataaacaaaatacaatagaaccaatgcaacatgaacaggacaaaacccttagcagcataaccgatatcttaaaaggatgtcagttttagagtccaacatgaatatgacgggtaaaaacaggctagagaattttaaagagtcagctcagaaaaggaattaaaatatggtcatgaaacaaacctattctgatgcagagcacaaatacaagcttgtacaaattgcttcactcgacagttcaccaaagcatgtgtcaataacaaattccaactgggaattctggatctggtaattccaatgaaaattccaactgggaaaacaatgtcaataacaaatcttaatggggtgctgggaatgaaaacaagaattccagctggagtcctgggcatagtgatgctggacatgaagattccaatcagggcaagaaaagcaattggaactctgggaacagtggtaaccaggcttctgctcctaacaatagcaattggaactctaacaaatcctcttggagtactgggaatgaaagtaattggaattctggatgtggtgattccaatcaaaacaccagttggagaagcaataacagctggaacacagcaaatgcctcaagcgatgatagtgtaaatgaaggttcaaatgaaaattccaatggagtaggtggtgggaactggaccggtggttaccggggtagaggtggctcggacagagagcgttttagaggtagaggtttttggggtagaggagaacgtgatgggtttggtggccggggagagcgtggtgggtttggtggtcggggagagcatggaggctttggtggtagaggtagatcggacagggaaggttttggtggtaggaggggatcagaaggaggacgtggaggccgaggcaggggaaggaatgatcaatctggtggttggaacaacagaaggggttctggtgaggatgggccctctgactggaagaagggggcagataatgatggatggaagaatattaatggatctcaggcttggaaccaggatagtggtgacaaggataggcagagctggaggcagggaaatgcaaatgaggagcatcctagctggaaccgaggaagtggaagtaatcagagctggagttcagcaagtggagctaatgataatggatgtcaggcttggaaccagggaaatgcagataaggagcatccaagcatgaaaaacaggctagaaataagcagagctggagttcagcaagtggaggtaacaataattggaacaacgaagggtcgtcggagattgcagaagctacggacaaaaattgtcacaaaaattgccctgtctttaataacgtgcgtgacaatgtcttgttggtctttttagtgcagtgctcttttttattttcaacttacccaatcaaaattgcctgctatataataatcaaatagtatatcgaccagcattatttaatactgattttatctaaaccagcatcaacacaaaggtactgaggggctctaattaatcccatgaaaatcaccacctagttgacaaaaatatatattctatttgtgctaatatctatgccttttttctggaacagtataagtgtttaacaaatctataattcaacatgaaagatcatgaatgtgactgcaggaggtaactcagccattttttgtttctgacaaagatgatggataaagcagaatgtgaaactaaatcatttttcaaaataaagaagctggaaattcattgttgagtcactacaacctttttttacaacttccattcttatgacatgttatcacagttcatgtttctatgttaaaatttacatgatttattaaacgagagaattcatacataccaatttgaggatcaccagtgtttgcatcaatattacccagaaatccattgatccttgctgtttcgagctcatgatgacaactaccaggtacaacagaagttataagtacaaaaaacgtgtccagtttcaattatgatttatgaatatcaaatttaaaagggaaagatcaaggacagcccatgtaaacacaatatataatgatcaattcacctgtggccaaagatggtgggcaaagaatggagatctatcataaattaccaagtttttgttttcttcaaaatactatagtcatttgcttgcattttgcaattctgcatggaccattattcagagatatcacaatcaataaaatataagaaagatacttggctgtgaaatatttttccactaacgaagttgcgttcacgaagattaaaataagagtggtcatacttttaacctcagcaaaatgtttttaatatactccttagataattattttttacatgcctgcattaattaatgtccaaatctggcataggttcacatacatactctttttttatataaatttttgcattaattaatcttacttatatggagtatgtattttttatcagattaaaaaacaaaaaaaaaatgagaaagagaatattagtggatatttttaaattgaaaaaataatgaattatttttaaaatataattctatttttttactgcatttaatagtagtattttttaaataacagaaaaaaatgcttactagtggtatttaaatagtagtaataaattacattcaagtttttgttttcttcagagatactatagtcactctcaattagtcactctcaagaactagtgtcagagctgttgcattaggatcaaatgccccaccattaggatcaaaggtcccaaatcataaagctatgataagtatattaaaaaaatgacctttttctcacagactacactaaggccattttcaaggccatcctctagtgcattcccatgcaaatgccgagaaatggaacattatgttctcgagcatacttagcagcaagaattttgcactcctctatcacataaaaatgaagataaaagtataatttatttatttattttaaaaaaataaaagtattagtaataagtgtatatgtttaggcgcacagaaattattgtatttaaaaaagtgtttaggcgcatagaaagtattgttatttaaaaaaaaaggcatgttttgttaataaaataagcacaagctacttgaggaatagtgaaaaacaggactaaaagataatgtaattaattaatataaaggatgtgtaatatatacgatggcaaaaaataatatatatatatatatatataatattatatgtaacatctaattttattttgtggcctatattgcagccctaacccccactgacccttaccactttgggtatgtatgaatatgatcggatcagtggttattttgtagttacaacagggtggtaaatttacgtttatttgtgagcatctatccccacaaacacgtaaaaatcaagacttgccaccattatatttggcttttttgattgttggttttgtgatactgtgatctgatgaatgacacgttaaattaagttgaatcagacattagactcaatgcaaacaagccaatggcacactcatgagaagtgtttgtgagcaaaactataaatatatgtgaaaattactgagcaaacctgagataaactatgcaataaaaatatatcctatggaaatattttgaacttgagttaaacactcatgaatttttttatatttaacctactcctttatttcaattgaagctatgcagttcctcctctgtaagagatcgcttacaaagacagaaatatgaactaatgtaaatataaataaaatgaggttcgctcaacaactagtggagattataaacctaacttagattcaaacgttctcgctgctcagacataaataaataaataaatttcacatactttgtgaataagaaattgatacaagtaacaagctgatcaatatctgtgcatcagcttaaacacatgttaagcttaattcagcattttgggtatcctacaattgctccaagtatattttacagggccaacacaattgaagccaattaatgatcaagaacatgttaaaatggttaatgatcaagaacaggaaaaaaagaagttatatacctcatcaactacctctatgagtgtaacatcagacttctcagatttactcttgaaaaatgattgttgttgcagagacatgtacctgcatacacgcaacataagttaaatcatgtacaatttataaacttagtacaagagccaaaattataggatggacacaagagccagtgaaagttattcttagcatgaaaagaaaaatgcatcacttatagtaataccttcaaacaacaattatatcaaatcaaacaacccaaaattacaacgcttaaaatttaaattttagtatatatttatagctaaagtattgcaagcaacgctgtatcacatgattcccattcatatgcataataagagcaagaaaaccagattgaatggcagacctcagcattgcaatttgttttctagagtcaacagtcataataattttgtaaacaagagggagcatacttgcctgttgtaagagtcccaagcacatttctcacaaccccaacagactgtacatttagattaaactagtatttgacccgtgcgcatacacacgggttagttatacatttaaatgtacattatcgcgtaatgcaaaattggaggtgaaaaaagaaaatataataagattctaaaactgtatctgttactctaaatagaagtaaacatttaccccaaaaggtgggtagattacccaagagccagaatcatcactccttgaaagtgaagaatgttaattccattcagaataaatccatatattcaccaaaagtaaacgcctcagtatcccatcactgcacagttatacacaaagcttcctgattgcctgctagcaagcaggttccactcacgcacaccttcacctgggacacaagcattgatctcaattagccttctatctaaagctcctgttcaaaagtttattcaaaacttcaagcagaacagaatatgtgatagtcttatggctcagtccaattgaagaaaactacacctgcacgcacaaggagaaagtttcatgctctggctttttcctcagaatgtcagctgtccatttcagcgatgcgattgagtgtatgacgtactagcaaatggttcaagacatttaaagaaaatcagtcgtagtaaataagaattaagaaggatgtctacacaatgtgcgaaaacctaccgtctgatcaccaagcataagaacagttttgagagacaatttccgactgcagaatttgaataaatcctcaaggctagggccaagtaaatccatcatgagcacgttgtactctccttcaacaccataccatttcacatttggaatcccgtctgccaaatagaagatggcaaaccaaaaacatttaagctgagtgagtatcacaaaatcaacaacaaataaaaatttccaaaacatacaaattcatcaagacacgagagattacttcctccctgcagcattttatacagcttcgattcatacaacaattgaggatgcttggttttgacccttagatttcattaataaaacccattgcacagttggggaagggaaggggcgagaaactcaccgtcgtcgccggcgtcgcacaatgggggcaggaactgagggggtctcgatttgcgccgcacaattggggaagggctttgctgctgcggcgtttgaggctcactccggcagggaagggcgtggctgcggtggcgatttatgaatataatcaacacgaggctgagagaggaaatcaggaatcacaagagtgagagggccagagagaggtacctaatttttcggatttgggagatgaaggcactggcacagggctgagacgcgattcgtgagagaagctgagaagaggcactacactttagaaatagcattgcaaaaccagccacagccgtttttcaagtctctaaagtactctttagaagaggagaagggaaagaaaactcacctgcgccggtgaaccaaggaggagaacgcgagtgagagaggaacgcgagatggggatgtttggaggctagggttaaggttacaaaatggggattttcgacttttgttttttaaaaacgtgaatgcaaggaaatgggatttccgactgaggtaatggaaacatggccgtcggaaaggattaacatttccgacggatggaaggcggtgggaaaaagagggccggaaaatgccgcttttcttgtagtgtaagtaagcgtcgcctctcaatccaatttgtcagtatacaaaataaaccttccaccatagaatagagaagtctcttggtcccctcaatcatctttcccctgaacctacttaaactcccaattgagagcttctgaccggttcaattcaagggtgggtctacccattatggaaaggtcattaccctccctatccttttctttttcttgattccccattctacgaattcgttgttactaattcatcaaaggagcaaaagcttttggttttaagaaaagacatatagatcatccccacttctttgtaatcagatcttcaattcgccaattaatattatgatgaaagctcctgaactcaagtttttcatgttaaaaatgttttaaccttgattaaagttttttctatagacatgcatttccctgatttgagcatcaattgctttatacttatgaatgtttatcaccatttattaaatgttttgactcatttatgttaagaataatgagatatataactacgcgcttcttgcatagttgcatttgctgccacgaatgaagttatgtatagaaaataaataactttgttatttagcctttgcttaaatttcatagaacttcataatcaatctcattttgttaatttgacttaaagaaataagcttgttaattaataaagttcaggtaaattttccccaaataaattttggttgtaactaattttgggaatttcaccatcaataagaaattgggatatgaaaaacaaggataagggcaaggaaaaagttgtttaatttatgaatccgaattcaaaatcaagtgaaattagatcctaatattttaattttagtttttatttcccttttagtgtttatttaaattcttaaaaggaaaatatagaacagatttaatttcttcaattactttttttattagtaatattttagaaccgtcttcttcttatgaaaatgatattcaatttcagctagtgtcccagtaaagttatcggattattccctaagtcagtttccaggcctataattaagttaatatattctttaatattaatattatatgaaaccaagatcatgagataaaaaaaagttttccgtgtcaaatgttgcaaggtgaaaatgcgctatttttgttaaatataaaacctaaaaaagattaaaaaattcagtaagattttaaaataatgacatattttcaaagattaaaaattcatttaagtcattttctataatacaaatattcttctacaactaacagggagaatgacatgaacctaacttagcaaaccaggttttgctaaccttgttatagaatccccacaaacgttttccaagccgctagaggagggtcagattttttatttttttatttatcagcaaacaaagaatattatacaggaagagtaccggcagggttagatatgtgtcttagctagttattatatataaatgtctaagtcataattaattatgatagcttagctaactcttctattaactaatggctacacgtttgcagcttcatcattcatacaccaaaccacatgattaggaaataaccaaatagccttccaaaaccaacttctgggatataaacgaagaagaaaatacgtctatttagaattttggatatattcatttacttctctaaaaacactttaaaaaaataaaagtaatatattttacataaactaaaattaacttatgcacgaactaatttgtaaaaaaaacatgagtttttctaaaacgtgatttttaatttatgaaaacttattttattttatttttcttctaaaagtattttttggaaaaagttatccgaacataccttatactaaataaataagggattcttaactttgtactattgaaagtaattaaggagaatttctataataaaaaaagagtaaggagaatttcttactctttagcataaaaatgtagttaagacttaagagtgatacataaatgacccactagaaggctataaataaatgatccacgtgttggggtaaataaactataaatagcagcaaaggagacattataaataggggagtagtggaacagctcaacagcaggcaaaatacacacagtggtgtaatatgggtggggtacccctgatactctcttctatttatattttataatatagtgcacgttcaataagactgatagaatatgaaaatattcttgtaaatattttccatatctgtgtatatcttttatattaggttagttaatatccttagtcaaattagcctaatctgtagcctagatttgtgcacctaatctatagccttgatttgtgccagcacttatgtatattatgcagtattttgaatgaaacggcacggaacatattccttcatggtatcacgagaccaaggaaactttcctgtcttctcctcctaaccatctagcttttcttttcttctccatcttcttttttgcttctcgttagccatgtctgactccaagagcctcttccatccggctcttgctgtatccaatatcaagaaccatatctccattgttcttgaaatggaaaacgttcaatatggaacgtgggctgaactcttcaaaattcatgcccgatctcacaaggtcattcatcatatcataggcaacgtcacgaaggcacctgctaccgatgcagaaaaagaattatggtcgactcttgatgccacggttctccagtggatttattccactatttcgaatgatcttttgaccaccatccttgagcccgactccactgcaatggaggcgtgggatcggttacgcgatatttttcaagataaccaacactcgcgtgcggtcacgctcgagcaagaattatccaccactcgaatggaagattttccaaatgcatcagcatattgtcaacgactcaagatgctttcggatcaattgaaaaatgttggtgcacctgtttcaaatcagcggctcattcttcaaatggtgtctggactaactgatgcatataaaggggtaggtacgttactccgacaaagcaatcctctacctcctttctatcaagcgcgttccatgcttacactcgaagaggcgggtctgattaagatggcagccacgggatcgaatacggccatggttgcggcaacatctaaggatcttgatgagccctcctcttattctgaaaatttctcacacaatcgaggtgggaaaaagggtggaaatcggaacaacaaaaaccgaaataatggtggcggcggtggacgtggcagcggtaaaggcgcccgcggtggtggccgtggtagcggccagcaacaccagcagcagcatttcacggtccccccgtggcagcagcagcagggtccgtttcctggttgggggtggatgccacagccttgggttgtccccccctgcccatatccttcttcccaatgggctcgtccacatgggccagcaaaacaacaaggaattttgggccagcgtccacaagcctatgctaccagcaccccttcctctgcacctacagatattgaggcggctatgcatacaatgtcactcaacgttcctgatggaaattggtatatggatactggagcaacatctcatatgacggcgtctcaaggtactctctcgtcctattttaatatgagcaatctaaatcgtaatattattgttggtaatggacacggaattccaattcaaggttctggacaatcatctctttccccaccacatccaccattacatttaaacaatgtcctacatgctccaaaacttatcaaaaatttgatttctgtgcgtcgtctcaccactgacaataatgtttccattgaatttgatccctttggtttctctgtgaaggattttcagacggggatgccaataatgagatgtgatagcatcggggatctatatccaatcacctccaccaacagttctccaaccacctgtccatccacttttgcagctattactcccattttatggcacaatagattgggacacccaggaccatctgttttacactcccttagcaagaataaatttatttgctgtaaacatttatcctcctctactgtttgtgagtcttgtgtttttggaaaacatgtcaaatttccattttatgcttcatcttctaatactttgatgccatttgaaattatgcatagtgacttatggacatctcctattttaagcactgcagggcataaatattatattctctttttggataactattccaatttcttgtggacttttcccattagcaaaaaatcccaagcatactcaattttttcatccttcagtgcccttattaagacacaatttgagaagaatattaagtgctttcaatgtgacaatgggagagagttcaacaatgagcctttcaaaaaattttgcgataaacatggtcttatttttcgattttcatgccctcacacttctccacaaaatggaaaagccgaacgcaaaatacgaaccataaacaacataattcgcaccctccttgctcatgcttccatgccctcatcattttggcatcatgcacttgaaatggcaacatatcttttgaacattctcccaattaaatctcttaaccaccaatccccaactcaaatactataccttcgggatcctacttatacacatttacgagtttttggttgtttatgctatcctctcttcccttccactaccatacataaattacaacctcgttctaccccgtgtgtgtttttaggatacccatccaaacatagaggatataaatgttacgatttgtctagccgcaaagtaatcatttcgaggcatgtcatttttgatgagtcccaatttccttttgctaagctgcatacaccttcttccactacatatgattttttgaatgctgaattacacccctttttaacacatcaatggaacaatcaaatcctgcagccaacacagccacctttgcctactgctattcattccccagcaagccaggctgcccagccaacacctccaaggcctagcccaattcccatagctcctgtccaagctccaaccccaaacaatggcccaactaccaaccccctaccagcacccagacctgaacccataaggaccacgaccactagaagcatgcatggaattttcaaaccaaaacgttccttcaatctgacagcttcagttacccacattaccccatctcctcttcctaaaaacccaacactagccttgtccgacccgaattggaaatctgctatgcaagacgaatataatgctcttattaaaaataggacgtgggatttggtaccacgacctcctgatgttaatattattcgttctatgtggatttttcggcataaaacaaaatctgacggctcctttgagcggcataaggcccgtcttgtttgtgatggcaggtctcagaaggctggagtagactgtgatgaaaccttcagtcctgtggtgaaaccagcaacaattcgaactgttctcagcattgctttatctaaatcatggcccattcatcaattggatgtccaaaatgcttttctgcatggtaaactacatgagaccgtttatatgcatcagcctctgggatttagggatccagttcatcgagattatgtatgtcttttaagaaaatctctttatggtttgaaacaagcccctcgtgcttggtatcaacgatttgctgattttgtatcaaccattggtttctaccatagtaaatctgatcattcattatttatctatcgcaagggcaaagacatggcattcattctcttatatgttgatgatatcatccttactgcctcttctgatgatcttcgtaagtctataatgtcactccttgcttcagaatttgctatgaaagatttgggctttctcagctattttttgggcatagcagtaactagacatgcaggtggtttatttctttgccaacaaaaatatgctgcggagatcatagatagagccggcatgacctcttgtaaacctgctccaacaccagtggacactaaggccaagcttagtatttcctcaggttctccatatgaggatccaactcattatcgcagtttagcaggagcattgcagtatcttacttttacaagacccgatatatcatatgctgtacaacaggtatgtttacacatgcatgctccaaagactgaacatatgagtgctcttaaacgagttctgcgttatgtacaaggcaccctcacctttggcttacatttgtacaaatcatcaatttctagtctcatttcctacactgatgctgattggggtggatgtcctgacactagacggtccacttctggttattgtgtttttctcggagataatttgatctcatggtcctctaaacgacaacccactttgtctcgatcaagtgccgaagccgagtatagaggggttgcaaatgtcgtttctgagtcttgttggcttcgtaatctacttctggaacttcattgtccgatccacaaggctacattggtgtactgtgacaatgtgagtgcgatatatctctccggtaaccctgttcaacatcagcgcactaaacacattgagctagatatccattttgtacgtgagaaagttgctcatggacaagctcgtgtccttcatgttccctctcgctatcaaattgctgacattttcactaaaggacttccgcgcatactctttgatgattttcgagccagtctcagcgtacgagaacctcccgtttccactgcgggggtgtgatagaatatgaaaatattcttgtaaatattttccatatctgtgtatatcttttatattaggttagttaatatccttagtcaaattagcctaatctgtagcctagatttgtgcacctaatctatagccttgacttgtgccagcacttctgtatattatgcagtattttgaatgaaacggcacggaacatattccttcaaagacagaagctttctagctaggagtttctctgtaatctataattaactagaatggtgatatatatcacttttttggtgtaatctaaacaagccgtgtattctactgtcagaagaaatttatctgaaatcacacacttatcccaattctgttgtcatatatggagatcgaccctcaaatctgaatggtcccaactcaccatgttggttcatttgctttctccaatgaaaaattgatatttattattaaattaaatacttataatatactgcaactattcttatataatagattaaaaaaattatttatcaaagtaaaataattttccatagtctttttcacccccttagtttcttcaataaaaattatatgtctttaatttttacctatttgatttttctttaaattgtaaaactcacacaaatcattttctactttttttttccttctccctttcatgcatgcatggtgcgtcattcatagtgagagacacatggcttcaatcttttttagtttcaatatttcggcttttgtttaatttgagagagtttctacggttcccaaaaaattatgagagttttgacactgtttgtttttttaaccgataaaattattatgttatttgtcgtcttattaattaaatatttttttatttttttcaaattagttcttgattatttaaaatataaaattacaattattttaattaaaaatttgattaaatataaattagagtaactattacctcaagaaaaataaaattgtgattctgtattaatattggtgaaagagattaggattcatattttaaacttatgtttaatcaaatttttaaaatttaaaatagttttaattttgattttaaaaactaatttgaaaaaaacaaaaaaatctttaattaatgagaagatgtatgacatgataatttcgttggttaaaaaaataacaataccaaaaccctcacaattcttgaggcaccataaaaattctcttgatttgatccttcaataattaagatgtcaattcatttatacttttttttttcttctccttcttatcaattcgagtcattcatagagagagagacattagtttatttattttttcttaaaatttcagtattttgtattttgtttgatttgagtcgtttgaccctgtccaataatcataatgttcattattttttcattaataagttacaggacaaaaatcactcaaacaatttaacgtgtgattgcataggtaaccactaaccactacaaatattaaaagagtctcattaaataaaacataagaattgaaatttgtttatatttaatataaaaaataagagatttttattatttatatattcattgataaaaaaaagttacacaagaagcgtattaggctattaggtctgagggtataattaatagggcgagacgggaaggttgttttaactttgaacatgtgctttggtggtgcatgcatgcagctgcgctgtcacttgtctaactatatatattcaagattactagcagaatttatagcattggttctacttcacatgacaactacattagtactatttatattcaagattctactgtgtaaactatcctttagattgtgttttactgattttattcttggtctttttttttaaacaaaaaaacagacaaaaggtttcatccctcataattttttgtgatttttttccgttgaaattaaaatcaaattctaaaaagtttataataatttacgcactttattaaattaactaaactaaattccgttaataaaagatatgaataaataatatgcaaggcaagatccaatatactctctattaaatacattatcaattatgtatctattattttatatcttagtgaccaacttaatttgctgaaagtttgagtccgtaattaaaactatatacattcaaaaaaaaaattaaaattacatatgatatgaatgagcatttttaaattctaatgtataagaaagaaaattttattgctttaagaataaaaataatttttattaagatttgttaacaaattttataattttcaataaattttaaaaaattaaaaataatgtgtttaaaaactgtgttaaaaaatactaccaaacactaactagtcaaaaaatttatatgcactgtgaaagcttaatacatattagcatacatataaataaaacaaatattttataccattatttaacaatgaaatcttatgtattgtaagatagttaactttgtaatagtcattttaaaaattaatttgaaagtaatttttaattaactaataaatataaatagtgtataaaaactaaatttaaataaacttttcttttatcggattttatatataccatcatttcaggctgaataatgaacactgaagacttcatcaccacttttgtgttctgcatcagactttctagccaagtggcatgttgtatctgacaacgtaaccatgatagatatataagaccatcttcaatgtatattttaagagagtttcttagcaaatttgacatttttttttactttttttctctcctggagtgcttaaattttagttgagtttcttatataagaaactgtatcttaaaagaggatccaccaaaactcagtaaaaaatccatataagctcctaacattggaggtgccctaagctcatgtactatcttctaaccatggaatggggcgtcattcattgttacttgtaagggaccaaaccatgtccttaattatttttttaaaatattactatgtataattgttttaaattttatccatgaaataactttctttttagcctcctaattaaattttctccttctatcatagttttggccataagcgtaaactattcacttgatcactgaactgttatcattttaagtttgttctcataaaaaaaaaattgtgattttttagttcctacaaatgcataaaattttagttttgcttctatgtttcctgtcgttaacattggagaatactttaattttaaagtgatataaaattgttataaaaactttctgacggtgacaaattactaaaaaaatatttacgaaaaaaaacattttcatataaatactaaaactttttttgggtaagatataatgactagataatttatcataaagttcatgtcggctgagaaaaaaaattaatgttcatgtctttttcgttataaagattctcggttgacaaaagaatgatttttttttattcagttcattagctttgtaatctttcctcgggtttttagttctaggcttggccctccttaatcaacgaaaacaacgacggaagctgaacatagctatactgggccaaagcccaaaactaatatgataaacatgggatgttggttcatttcagattgagctttacaaaatgcaatgggacacagctggaaacaataatgagtataggaagttttagtcataaacatgttgttcaatgttttatctctagaaagcatcaggtcaagaaatgaggattcccatgatgatgaagaaagaaagaaaaaactcagatagccattggaaaagtaaagtaattgttaaatgtatccatcttattgttgctaaatgtatccctcctccttttttttttttttaataactttgcttatatacattttttttctacttttctccctcttttcaaatgtatctcaccttctttcttcctttggcttctccttacaaatactacctcttcattcctagtccattttctggctattactttattttctttctctatgccttcgatcgcttgagtcatcctcttccaacaatgctatttattcggttagcacaaactaccccttagctgtaaaagaacacattgaaagctcatattcttaatatgaaaggttatattatatagaaagatatttcatgttctgtttgaatcatgttcgtttctactaagtttagaaattaaattattaaagtggctgccagagattatcctttggtgtttgtggtaaggccatatttttttttgttcgatactgttgtttcaactatgaatttgtccttattattttgggattagacacatatacaaaacattataaaaggaatacatttgtaattttttattgcaaaagtagtcagagaagaggaaagaaaaacaaaggcattgtcaaagaatatgaaaggtaaagaactgaaagaaagaagcagaagtgtagaatatttgaatgggttaaaagagtaagaaaagggggaaatgatatttatgtaaaattactaacagaaaatgggaaagaggtatgtttaacaattgttgggagaaaaaaaaatatataattggaggctgataccatagttttgaagaccgatctgttgttggaagaaaaaaaaaaacacatttagaggctaataccatagttttgaaaaccggtcctttattggaaggaataaaaaacacaattggtggttgatactgatacaaaaattaatgtttaacaattggagggaactgcgaaatttgtgcagagataatgtcagaatataaaaaagaaataaacggaagataagaaacatctacaactaaaaatacggaaacagatcttaaacaacaatttcactatcctagataacagggctcttttctaaaagaaagataaatcttaaacaaaaaatcctaaatctttttttttttttgagatgaagaaaatcctaaatcataacagattacaaaaaattaaacaagttgactaaaaaagtaaagttttcattagttaggctgaattttgaatccaattttgaaaaacaattaaaaccaaatcaaaccgtacttatacatagtttgatatatcaatgaactttaccttgtttgtggaagacttgaaggtgtaacaccagtacaccacctttctctcttatctaaacataggacttactaatgataagttactataataccatagagttttttttaaaagcaatgttaaaccacacaatcaaccaaatgattggacttaaatgattaatgtactgaaattaagattgaattatttggataatatgtaagtttaatcattgacaaaaataaattttgattagattttagttatcttccaaccaaattttaaattaattaaagttcatttttataatgaatcaaaaggttaagacaaaaaaaattcccacaaccaaacataaagagtttcatttataaaactaactaggaccttagttgtataaataaaattttataaaattccattatcaatttatttattttctttataatttcattatctccattatcgttttattttttgctgacttgaatgtcttattacggtatcaatgttataatgattacaatgtacttgtaaacttattaaatattaactgaatgttttagaaataaaaatataaaaaccaaatcatttattcaatttaaaccgtaattcaattttataatttaattagataaaaaaacattatcagcaactttttgcataaaaattgattcaaatcaaattggggtttactatgttatctacacttatataatatttaggttcaaaattctgagtgtgtacgtacgtagcaggtccctctgtataattgttgtaggctccactattttaattttgttgaaagcttagatttaaaataaataaataaataaataatgtagcataattaacttaggatatggaaccataccctctctaccttgtgtctcacaaagcaaggcgatattgctttcagcgaaagtgttacatacaaaagataaatataaataaaatgaaacatccgttaagtatattttaggattagtcaattgttctcaacgttttgcatagatattttgggctcaggtggtggtgttattttgatttctctggtgtgatagaaacttagctgaacattgaaaaagactcggtagtcaataccttataacttctttttgctgctgaatcctagcatcaaaattggcatgcaatcacaaggttagattcctccttaactatgacatgttcgataatttaatgcatagatggactttgtaacttacccacagttatgaacctccacccccaccgtaaaaaaatgttggaaatctaatgcaacaacccagaaagaccataaacggtaccacttagttgcaatatcccttggacgacactgggatagcattgacttgtcttctccttaatgatttacacgagtgaaccccaccatctattaaaaagattcaaaccatccatacccctcctactcaatttaaaaccatcttgttatattatcccctacgatataattccattcaataatcattaacactaaagcaaaatgattcaatgaccaataaaatttacaggaaactgaataaatgaatccgattacttctttttccccttctctatcatacatattctcgtaaaataagagttctatgttacaaatcaaaattgtggtggagttgcaaagaccacattcacttgcaaattctcattctcaattaaaaagagcagctcagctctcagcaaaaaaagaaaaacaagttgcaaaatcttgtacctctcccctccccctctccacaacctgtacaaattctctgttgtctaaatgaattactatgatgcacaaggtgagagctgcacccccaatctggcagtaccaagcatgcaacttgtgacagatgttccctttccaatcagtaaaaaatcaagacaatcagttgcagcacgagtcaccatccaaacagtttaagatcaaggcaaccaatgagtcactcattatttgctgccagtgtgcaagcaacaaaagaatgcatcaagaaatttggaaacattttccagtccatgcttcagttcctcccacacggagtgtcaaaggagggttccttgtgcacacatcataattgtttgaagagcatcgtgtgacaattaaataatcaatcagtacggaatgacatatggaagagcaaaaacatctgctggctctatgtgcagagcttctgcccatacctgaggtgtctccccaacctctgaagatttcaccacagattttctttcttgcgaaacattgctgccaaatagccacgcttgatcgtcaaaatcagaccactgctccaccttaggtactgaatatacctggcctaggtacttggtatctggatgtggtggctttgcagttgcttcagttaccaaatcagctggcacattggcagtgtgagtcttgtttgaagaagctgcaaatggctgactttcaatgatgccattcatcttgctttctttctttactaccttaacactggtggcttctcgtggcctatctgaagcatttggaatggaaacttggcaaggttccaatacccttccgttttcagtgagtggatgagaggaagacaatttcggaaacttattgggcaaactgtcattgactgtaacaaaattaaaaaaaaaaaattataacctgtctattcaacagcaaaaaaatgcgtacaaacttgagaaaacttgtcaatatgactgaaaaataccaataattgaaatatcaatataagcatgtgacatcagggaaaacccaccgttatctcacaggacgtagtatctggtattagcttattaggtcagcaatatactagtccaaatccagtaagagaaacatcttattcttttttaaatacaacttaacaggatcattgagtagaaatgagaacaagactcatcataagtaacactcaccatgtggaactccatttgactcaatgtccttccgcttcttgagattttctccactgacagcgttcccatggctgttcctaaaaggctgtgtgaaagaatttgaatttataagtccaactttgttgctttcttttaatttattttgctctgttgttttaagttcattatgctccttagctttctcctcctttttcttctctttgtccctgtctttgtccttcccatgccctttcttctccttctctctatctttccttttatctcttcgtttatcatcttttttttctttaacctttttctttccttcatctttcttttccttaaccttcctttcttctgtcttttccttggccttttctctttcatctttcttttccttaaccttttctttaccttcaacagttgcttccaaattcctttcaaaatactttcccaaaagtttgggtattccaccaactccaggatgaaaatttccaacatgattctgaactggtggtgcatttccaattggccggacctcatcctgtattcctcgcccatcaatcttcttaacatgaagacccatatccttgagtttttcattaccatcagaccttgtgccacctggacctttagccaccaacctaacagtcccctcatcttttctatggtttgtattggtaaatttatgaacccattgattgtcagctcctccatcatcatccctaatcctccggtccaactccaggaggaactttgaatccttgctctcttcagccagatgatttttctctcttgccttctccccattgttaccagcatactgtttggtgagtctgttctcaaacaagatacccttcttatcatcttgcttaatttccttttgatggggtttacctccgttgagaccctcagcttgtcttgggaaccctttgtcatcagcagaactgcttttacttttatctctatctttgctcttgtccttgtctttatccttatctttctttttctctctgtgtttttcctttttgtccttcttttccttatgctttccatctcttccttctttctctctcttttccttgctctccctcttctctttgtccttcttatctttcttatgttttttttctttctgcttttcctgcaagtcatatggtgagaagagattttaagaataataatcaaataaggaataaaccaaaatggcttcaaaatctcttcacccaggagcaaccaaagagaaaaaaagaatatcaatagtaaaacatgcaaaaaagaaaaaaaggctcctgtctccttggcaatcatatatatccaaggaagaagccgcaacaataacaacaggatcaaagtccatcaatacacattgtctaccgacaaagtattctagattctaggagagcacatttcagccaactataaccatactaagagggaaaacacaaatccataaaagtcaaaaataaaagtatagcaattcaatttgatgccttattaaacattcccaatgattagattctttaaacccaacagaaacaatttcattcttatactgccggccattcagatccctattttctttcttttatggcttttggcacatattacaaataagatatgctacgacacttttaacggaagttctgtattctacgcctcacattgaaataaaaagatcaaaaaagtgcaactgacatgttttattaaggactagaaacaagaaactccacaaaataaaatatgcatttccagttataacccatagatgaacaaccaggaaacttcaatgataccaaggaaaatacccttctatgttcctatagttgaatcaaaatgaatgcaaaatagaacaaaccttgatcattttattcctgaaaaaaaaatgaaggcaaagaacaaacaacaaagccactgcttttgatcttctaattaacaagaagtaatccaatacatcatagtcaatacaatagtataccaaacaggaccaaagtcataactatactgagctccattaggatactccttgtagaggagcatcctaagcaaaacagatgagactctaggatcttcctcttgtgtgaaattatccccatttagtttttgaacacccattacaatgcagtgtcatgaaatgtttgaataaacagacgggattgatcacttgaactgatctgaccatgaaccatgtccgtaattcaaacactttcaaaaccttattaataagattttatacttaattaaagtttattttcttagaaattataattcatctaagatttttattatctttggttataagtgccctttagttgacttaacgttattttgaccttatgcatcattgtaatatagacacttcctgtcactagaacatatgaaaatctagtaaggacttagaagtactctgatgactcctctaaagagagaaagcaagagtctgtccacccttgatttgaaatggataattcaaatcacgagtggatacacattaactttctcattttacacctcactttaaaggagttaaaccccggctcatcactctacacagagtactctaggcttattaatctacaccaggtctcagtagctcaacctccaatttgattttaaaaacattgacatgattcaagaatatgctctagaggccaacccctacatggtggatttgatgaacttaatgttagcaacaaactgctaatcaacatcaacatcaaaagcacctttaatccaaattaattggggtcgatggtagatgaactcaataataaatacgagaaggttgaaaaaacaaagacggtaaaagtaaagaaggggaaaagaaggaaaggggagatgaagaacaaaggactaaaaagggataatctagaacatagagataacaacggatctaaccctccaccaagcttataacttttctccatttttcctaagacacaccgttccccaatctatatcacatttcattaaatcttgtttaactacctttttctagttacaatctacctctacctctctttgcgtcgagctcttgataacaaacttctgttcttacaggagcatccaagggcgtctcattatgtgtctcaatctatgttccttcatcttttcactcaccaatactactgttacctttcgtcgaatatcttcattttttatcttatccatcttcgtataaccacacattcaccttaatatcctcatttctgctatccttattttatgttcatgttgcctatatgctggccaacattcagttctatataacattgtcagtcatacagttgttctatataattttccttttagcataaaggaaattttacacaataactcagatgcactccgccatttcatctaccatgatataattttatgatttacatcctcatcaatctctccacctttgtgcaaaattgatcccaagtatctaaaaacatctttcttggatacctcttgaccaagtagatgcagggatcttgatcatcatctcttaccagtaaaaactcacatttcatatattcagtcttggtccagcttaacgtgagtcctttagactctaaagtgtttctccacaattcaagttttctattaacaccatcttagatctcatcagtaagcacaatatcatctgcaaaaagcatacaccacgacactttctcttgaatattttttgttagttcattcatcactaagaaaaagagataaggactaaaagtcgaaccttggtgtacacctaccgtgataagaaaataacttaaaatttcagtacaagctttcacacacatgatagccccatcatacatatccttaattgcatttacatattttaacagtacttttttcttctcaagagcccacataaaacttttattgagactctaccatatgctttctcaagatctataaacactatatgtaagtctttcttcttttctcgatacctttccattaattgttgcatcaagaaaataacttttatggtacatcttcctgacataaatcaaaattaatttacaaaaaccttggtctctctcctcaagtgatgttcaataactctctcccacaacttcatatatgactcataaacttaatgtctttataattagaacaattatgaataatcttccttatttttataaatagacacaagcatatttttcctccaagcatcagatagaatcttatttgtttgaagaacttattaaatagattggttaaccattttattgccacatcccccaggcctctccacacttcaggacgtcatcagatctcaaaactttattatttttcattctctttaaagtcttgttaacttcatatgtattaattttaagcacaaatcttctattcagatcatcataagcgtcatccaaatccacctcacttttattgtcatccacattaaaaagtttgtaaaaatagttcatccatcttccatttacatcttcatctgttaccaaaaaattttgattttcatccttcatgcatctaatttgggtgaggtctttactcttcttatccctcatttttgcaagtttgtatataactttttcaccatccttgctcccaagatttttatacaaatcggcaaaaaccttgcctctaacttcccacactgctttctttgcatttttcctcgctaatctaaacctttgcaagttctcatcattggaacttttatgcaaagatctaaagcattcctttttctgtttaattgtctcctgcacctctcctttccaccaccatgtttcctttgtaagaaatttgtttcctttgcttctcccgtcaccttccttcccacattttggatacatttaaccatcttatttcatatttcatttgctccccccataggctcctacagtccttcacacaacatgtttttcttgaactctatttgtttttcctcctttagcttccaccatcttatctttggggtttgaaccatcttcctcatattaagtactttattgaaccaaacctctagaactatcagcttatgttgcctagcggcacagtctacaatgtagaccttgtagtcgatacaagaatttctatcttatcgtctaaccataaagaaatcaatttggctacaattttggttactatgataggtgataagatgagactcccttttttggaaaaaggtgtcgcaaacatcaaattgtaggctagtgcaacgttcaagatatcttcttcagtctcacttcttgtcccatagtcaaaacctccacttcttttaccaacatgaccatttaggtcttctcctaggaaaattttctcctctcatggtatccctctcaaaacctccttcaagtcttcccaaaattagttcttatcatttgattgcagtccaacttgggttgcatacacactgaggatatttaaaattaaatcacccactacaagcttaatcagaataatcttgttgcctttccttttgacgtcaacgactttatctctgaaacttctatcgatcataatttcaataccatttcgactcttgtttatacctgtgtaccacaacttgaaactggtgtcatccactttcttgaccttttctccaacccacttaatttcttgcaagcaaacaatattcactttccttctggcaaaaacatcagctaactctttcagtttacccattaaggttcttatatttcagcttcccaattgcatccataacccttgggcggtattcacctaccaccctcgcccatctgcatgttgggaccctgacctacttatcaccaaatccgggttgaagacttgacgccttgccttgagacaaggaccctagctcagttatcactgcatcccgggaccgatgcagcgccttgccttgcggcaagggctctagcacatttttcgctacacccggaatccgatgtaacgcgtcactatgaagggtacactccaacaaaatatcattatgggtcatctcataaaaatagatgttttttttatggtcgattcgcaacacctgacaccaactctcttcctttatcctggcttgggacaggccatgcattcaaaaataattataatgcttagtaaaaggagagactttagaaaaagtaataggaaagactaaataaaactattgaaatgtaatcatttaaataaggaatgggttgcaactaaatgcagtcatgatctcccacatgcaaaatgtttaaaacttcattaaatccactttttgtatccattaaacaatcaattttatcaccaaaattttttatataagcattaaatcgatattgaaacaggatctgaacaaaatgggaacaaagcatagcaggtttggtctttgtaaatgaggagaaacttgcaattctccaaatattagaacgataaggaaaatatttgtaaaaagtgaaacactttaacctccataatccattctatttcaaaatgcatacaaatgtccctgcaatgtacacataccaacttgaaaactgcccacattatcttccctggattttcctcacttttttttcacaaacttcctatttacaatggtggttggttgaggtttcaataacaaaatgaagaaattacaaaaattagaaaaatagaggaccaattatcaaaccaaaatgctaaagtaattattatcatgcaataccttagtcatgcagtaattattatcaagcaattcatattatgtagttcaagttagttcctatcacgcaacatcttaaaggcttaatcatacttaaaactcccatcaactaaaaatataagctaacagcctgctccacaaaagtaaatctactgcataatgtactccctttaatgaatcatccaatgcaataaatctagctgatctacataacttcaacctctatactcaaacatccttatccaacataacagatgttgctttattattttctctttctcctcaaaattttcaaattccaaattccatcttataggaaagctcagctatctataagagatgctactgccaacggaatccaattaaaagttgaaacaaagaaatggtctaatagaaagaaacaaataaaaaattatcagaaaaagagatatggccactagccagtctctctagatagtcaaatatcaatgggttggtggaagtccagtccagcaaggaaaagagaggcattgtgggggaacaggagaaaaagcatggaccaaagagacagtcactacccatgaagaggcccaggggtcgctgctgaacacagagaagcatcacagacaaaaaaaaaaaaaaaaaaaaggggacaaggggagaaggggggatcacatcaatacacaatcagaaattttagggtacccattgtctttttatatagtaccacttcataaaacttgcaatacaatagtagagaagaagtatcttgagagcaccgtagctggctcactataaaaaactatgatcctgaattgacaagacaggataatcaataatgttatgacatggtaaaaacatacaccatatcaaccaaaaagaaaagctacactaacaattttgaatgtcacctaacaagaagaatgatacaagggaaagagttgactagcatcattgctagtcaaattgagaatttaatgcatatacttgacaaaacattaattagttcatttctttctaatataaaatcaacctgaagtagttgattgccatccataacttattatatgattatttcattagcaaatcatagttggccctgaaaatatataacttattaatctaatcaaggtaaacataacacgaactcaaggggcacataaattgatgtaaccagaagaatttatacaagaacattatacaaaatttcccaccttgatcaccacattgtagcaacctctagtttcaccacaaaataaacttgaacacttttacatgtttggggaaaataaactagcacaatttcactgaacttatagcggaaaatctgctaccattcaataaatggttcatgattgagtaaaatccattaaaatcacaggagaaaaaaggcaaaaaaaaaaaaaaaaaaaaactaatgttgagtaatagaatattttttccctttttctctttcttctttgaacagaaagaatgagaagtctactgaattgtgcagatagacagcttaaaacaaaagatttgaataaaaacagtataaaggagctcaaaaaaaggggaacaaaactcatgtttgattcaagaagtcatggtagccaataaaccagagattaaacagttaatatattttagatatatcaaaccctcaaaatttcctataagatcatctaagaagaatacaaccacaaaagccttttcccaatagttggaatctgctacaagaatcaaaccatgccattgtactacgtcaaaaacccagcttttgccaaggctatttttagatcatggtattttgtaatggttttacttaaattttccttggtaatcacaacaaagtatgttcaggtagaaaagccaaaacaagaaacaaaaatagtcagaattatttatacaaaaccatacacccaactatttacaatcaaatcaatgtgaattcttggtcttcatcttctcagtcgagtcagtcccacttgtgtaaaatcaataggttgggttgggccaagaatatctagaaccaattttcaccagtgtaattaacttaagagtatgcatctgattagcctcccattgagtatacaagcataatatatttaaccctggactgtccttattcttcacagctattatttcaacaaagacatagaactagcaatttcccacaacttgcttaagtcaatttgaaccccaaaaatgattataattcctataaccttactctaaatccattttagatgaagtgaaatgctttgttctatgactgacaagatcaaggatattcaaagatgttgcttccaaaaaaaaaaaaatcagtaagtattacaacgaatattagaagaatctccaaaacccaaatataaatggacaatctctactaatactaactttttgcttcaatacctaaggtgccaaggcataccatcaagcacaaagttcatcattttacaacaaaaggactcgtaaaaaaataatattgccaacaacaggcatagaacaagcagagcatatacacttttaatcatcataatatcccttcctcatcaccagcagtgttgttaaatagcggccatggaggaatggcgtggcagattttttgccaaccgccatattcaatttgtgaagggacgcccgccatggcagaccataaggcacaatggcgtgtttatatggcgggccattgataacactgatcacaccagtaatgacattatttctccactcaatcctcttgaaacttatatattcaggagtacatatcataacagtccaaaaatcaaaattttggacacaccaaaggaaacctaacatcttatagacatataagacagataaactccagcaaatcaagtgaaccaacttccatcaacaaagtgcagaacccctactaataactgtaggccaaaacagatactgtaatgtaactatgtaagcctccaatcatcttcaattgcacccatacagaataatatctgatactttcatgacttgtgatagttcaaaagatgccgattaaaatgtttcaagcaagaattttacaatgaacttcaaacaaattgaatttatattattaagaagaaacagatgaaaaattaaggagtacaaaattaattcaaacatgaatgaattcagcactttatatgttccattcagaaaatgacgtctatcaatatacatttaacgttatgcaattcacaaaaaactccattttgcatcacagttaaatctatgtcaaattatatgtacaatgtgagtgtaggaaaagtgtattaaccttttttaataagtccacttcatctgttatagccttctttctatatcctggtggtggaaatggaaaacagcgcgacattgcacaaaatccaaatacgcctagtgtaaaattcttctaaatttgagagtgcttgaattagtttccagtagccctgttccaaaaagggaacgaaccagcaactatgctcctgtccatgcaccatgtcactgcattcatttccagctttaatattcctccataagcctcttactacaaacacaaattgtggaaaccaccaaggtttactacccttcaccaaaatattcaaacagctcaaactatactactaaaaactgatgcaaaatcaacgcacagcacagcaaccacttgttctaactacttaaagtcggcaaatggttcaacacaattccaatcagtatatgtttcctacactagtgttaagctcagactaattatatcaattcaaagggctgcttcagaaactaaaaaggaccactgaaatcagatactctagtttccttgtgagccaactaagaatcaacagctttttctttgtgtcaaatccctaaaccaaaatgatcccccaacaaagacaaaaagacaaagaagaaaaacaccaaaaatgaagacccagaaggcccagctttttgtagtgtgtccagaaacggttctccaaatcctgatcactgattcactgttattaatatagacaatcttcttccatgttcaaagaagcaatgttaaacaccatcttaagcaatctccaagtgcaaatgctcaaccaccgtaactctaaatccaaaatatgaacccctgaaaagaccagagaccatgcccatttcacgcaaccccacgcagagaatgaacaagcacagtcttcctttcaatcacaccctccgatcaaaaccctaatcactcgggaaatttgcaatttggacaagtgccccccggttacgatccaatgaaaccctaaaaaaaacacaaacaagctgagtacacatacccggaaaatacccacaaagaatgaaaaccctaatcccaattccgaaaattttgttgattaaacacccaaaaaagagagagcataaagcagcaaaattgaagaggataaagagaatcaaacactttttgaaacctaagcaataatgggtatcgatcaaaagggggaaaagaagctctgattcgaagcgttgacgggaaaaaaaagtgaaacatcgattgatgaaggagagcccaagtgaaatttgttgcataagatcacctaatctgctacaaagcgaccatagtaggaggacaagatctctctctctctctctcatgaataaacagaagaaagagagaacaacaatctcatctcaatatacacaaaaatatgaatatgtatatctatatgtacatataataatataatatatggttttgggggaagtactttttctttgtgtgttctgtgtgttgttgttgttgctatggtatgctattcacaaagctagagccgttattgctctctagattctgggttttgtttctctttgtttaccactctgcttcttttcttttcttctatttctttctctctctggttatgcgtatttgtttgcctttctgtgcttaagttgtgtgttgtccctaatatatatctcatcattattggtcatgtgtttctttttcattatttttttttttttattttctcactttctctgttctttctctatattcctaagtaagggggctcatgtgctgtttttccgttcggaagtcacacgcgaggctgaaaaataattgaaaacccaaatgccgaaatcagaacaaaaaggaagggcaacaatggaatgccaagcaaagtcacgtgtttattgtccatcacacttgatgtatagttgtgaaatctgattggattattgacttgaaataatgaatcactaatttaatctgtggatcaataattgacccaatttaatcaggaacatattaaacattcaaaattatatatattatataaatatataactaatattatttgagtaaaaaaaattcatttatattccgaaattcaatttttttaaaaaaatcaaaatttttatatcaaaaattgtaaaattggtcgggtcgaaccgattcaaccaagatcaataaactaactgatcgagtttgaccggatcaactacataatcaatccaataatgaaatcggtccggttagaccaccggatcttggtccaacatgtccaaccgacctgaccggatcgaatttcacaacactggatgtatgtactagtgtatttaacatgtcaagtggataaggattccaatctcaaatccattggtatgaatattatttgtttgagatataatttcttaaatgaatattttttaatatagtaattagaactttttatttctcaattggatctggtatatttttacaagttttgattttttgagtcaattataggactaatcctagatgaaggatttagtcacacttaaaattcattatttccaagatgtatataatgtgaaaattgaatataaatcctcctcctgttgttaattgagttatattgattggatttatatgaaacttttaagagcacatttgctataagaattttttaaaaatttctaagaatttgaacttggagatgtttaatttttatgtttggtttactatttaaaaaataacattttcaataaacattgttttccaatgatgtttctacacaggttttccataaaattattttcatgggaaagttagaaaattaagggtatgtttggtttgagaaaatattatctttttttattttcttttttattttatgaaaattattttcattttcaaattttcatcatttagaaaaatatgtttgttggttttctttttcattttcattttcattttctgattttcttcaataattgttttccactcattacttagaaaatttatccaatggcattcactggatgggagagattgcaagttttgagtgcacggtcatgttattgttgactgttactaggttccaagagaaagaaagtatgatgcaaatgaaaagatctaaaaaatttcatgagtgtcatgcatgattagtgaaaatgcagaaaatgaatttttttcgttttcggaattttctaaaatactgaatttgttttctaaaatctactatacatatatgaaagcaataggcatatgtaattctgtttttgtccttttcagttgattgacacttggcaaaaatagggataaaaggataattgaacattaaaatgctaattgcacctcctttttaataaatgcatttcaatgtttccaaattaaaacttgctaactgcacaccctttttcataagtgtactccaatattttcaaattaagacttgctaattgcacctctttttgataagtaaattaatatttttttaaaattttaaatactcattatatcatttctttcatccctttcacacgttatctctttaacgcgtaaccagtggtatttcctatgtacttaaggtatcatactagccagttaaaacaaaatacaaaattccaatattattttaatttttctttcgaaaaaactctaaattttaaaaaagcaataggccatggaaatttcatttttgcccttatttaatttggtgacacctgtccttcttatctgataaaatggtaattttttaatatctatttaatgtacaccttcagccttcaactccatccgcttctctccgtctccttctagctttctttcaaaatttcaaattttgaaatttgaaatcacctccctctgtgcacacttccgctccatctctctctttctcttctccaccaaattcctcttctctgtttctctctttctcttcctccaatttctcctctcattttctcttttctcttatctttctatttcttgctcacctcactcctcttatctaaaatcctcaacaaaatatacgaagacagtccattcaccagctccgaggttgttttcatcctcctcaggtaactctcagcttgaatttgttcttcttcttcttggttttgattcacatgtctttgctcattttagagatgaaaggaacagttgatagatttaggtattaattgctttggtgctataagatcaacattttttttttaatgttgtaaggctcacaaagtatgagtttgagtcatgattattttccacaacttattatgataataacaataataataattagtggtcactttgttataaatgaagcatgatgtacatggaagttgagtaaaatttctgttttataagcttatacattaaacccagtaaagttccatgaggtgtttgacaaatgtgtggtgcttatgaagtgtttgacaaaatgcctcccccaaatttctattgctctgtttataatctttattgtttgacaaatttctattggtcattgcattaacaaggttgtgtttcttctctcacttttttctatttacaaggcaaagaaagactaaaggatgctcttgctgggttggtaattgcttttttttcgataaaaaaattgttgttatatctataaatgtttttttaagtttatttagagtggtcattttacgtgtggatatatttaatatattttaaatataaattataactaaagtggtccactaatatacaaatttagtgtattttagattgcgaaaaaataagagtgtatcaattaaattcatttatgttctaataagacacaaatattttgtaggtatctaactataattgaaaaatgacacaaatattttagttgactttgacatcaattcatgttaatgcagtattatatcatcaattttttaggaaaataggaagcagagcaacctcaaaaaattgatacattgaacatattgcctttttttatacatcgaacatattacttaaattgtggttgcgttttgtgactttccttgatagaacattaaaattttattggattttactgccaaatattttgatattggactaatgtatacattactctgtaagtttttttatggaattattttatttatattcatttgggtgatgcacgaatgcttattatattcaattattttatagaaactacttattttttaaagttttaagtgtgtgtttgaagtagaagtgatgtatagaaactgcttactttctgtttatttgttatgtcaacatattttatcatttttttgtaaatctcaatttctatttccttattatttgggattttcttttttgtttagataaaagaagattatgcgtagtaaaattagtctatgtgcttcgataaaattagataaaagaagatgatttgggattttcttatcagttcatgttaagataattttagattttcctgtgctttgataaaattagtctctatttaacatgatccttagtagccttggtttcaatttaattttgatttagaataagtttagataaggtcctatcaaaacttcttgattacatagtgagagtagaataattttttttttcatgttttgtgattactatatttcaggtagtaagggtttgaagtttcttggtttggtgtaagataaacagactattgttctagaaacccattacctcaattatgctaaatatccaaatgttggcacatatgatttaactttttttactagacaagtttagaattatctatgattattgtatgtatgccaaaattgacgggctattttatgttgaaaagttgcacttaggaggtcaggactgagaaagcctcatattccaatatgtatttaattggtttgtagaatatccatggtgatttagaattgaactcttaaaatgaccatgtagatactaataaaattgagcctacaagggctgaggaagaagcaattgctaaagggattgcaagagcctacaagggctgaggaagaaataattgctaaagggattacaagtataaagtactatcaaacatcttcagacttcacttttggaataattggtttaagttattatactagggaattgttatagcatttcagcttttggaatagttggttttaagttattatactagggaattgttatagcaggacatgagtcaatagaagcatgataaaaaaagcttgtgtaatgtcttctaagtagtgttagcagcagcaaagtggctctaagcaaattaaatattaatatattaaagaaagcattaagagggaaataatttactactaataaagctttcatgagtaaacctgaatatagaaaaaattataagaacaaaattctttaacatcattagacaagtttcatatacataatacacgaacacaatattatttacttttacttattatttttatatagaaaaatatcacaattgtcaaataattgagctacaataaactataataagagataaattcattgtcatcaatggatatattattttattgggtaagaactaaataaatgtataattttattttaaacgtcttcgatcatatatatatatatatatatatatataaagtttttgttaataaagtttttatattaaatgtagtatttgtttttgaatttttatcatataaaataatcgacaaatagcagtaaaataaaatggtgacatttaaaaaaaaattaaaaattatagttttattatttaaatttaatcaagatttaaaatttttaaactatttttatttaattcaattattacgataatcagcataaaacatttacttattatatttattagaaaataataatttaattctttattaaactaaagttaatcaagttaaattattttatcaataatatcacaaatatatatatttttttagttacaatagacataaaaattaaaattaatttataaaataagacggagtgtgacggggcgtagcgaaacgacccgtgcgtccgcacgggtccaaaaactagttgaaaatgaaaacatctaaccaaacatattttttcaattattttttattttcattgaaaatgaaaacaaaaaataataaaaacaaacagaccctaagtttcctatgctgaaaaaataattattgtgataaaaatatcatattatttttattatatcgtgataaataattaaagtttataaatttctattaaaaattaacgtgaaaatcttttgctcttaagaaatatatataaatattatataaaaaagaatctcaatcaaacatatttttcttatttttaagaattatgattctcataaattatatcaaacacaccctaagagattaagtgctaactctaatatgcgataccttgcattaaaaaaatgtcaagtaatagataatttttcatttatttgcctagtttataaattcgttagacaaaaatttacggttatatttggataaaagttgaaaacatgattttgatgattctaatgcacatttttacagttcaggtcacaaaataagaaaagaagaaaatgtcttttcggaaataaaagtatttttgagttctccaactaatatccagacatgtactataactataatttattctcttgttttttatttatattttattgagagtggattttgtttcgaggatttgtaagtttgatttgtatttcgatttcaaatctctatttatttccttcaaattcaaaatgatagtacgtgaactaatagtcaaatcctcttcatagctctcgtaagctagcaacatttaattagctttagtgaacaatttgtgtacagtacggtgatgaactctgtgtatactcaacagcatagctcaaacaagagcttggtatataattagactagctagtattctccatgcagacacatgtcccatgttcgtgcacgtctaggcacaatctccacaatgaaaaacaggatcattcagcaaaggatggttaatgggaagaagtaacttctctctccctcaatacatatccaagaaacaaaaaggaaattacgtattcccttatccaaaacatataaatatcttcaacttaactgatttgattgttgaagtccttttaataggtattttattgcacaccaaagaaaaatataagagattatatcaataatattagacaaccgagaagatcagatttgttaacaagtgaacttgataagaataatatgtattatatataagtcaaaatattatattttttattcgattaagaccataattttttttcataagaattgaatataaataatgaaagtttatcacaaatcttgtaccttactcaactagctaataaacaagaatgaataaccaaatttgatttgattattagacaattaattttataaaattaataaaaataactttgaaggatcttgaataagtataaacttaccagcaaaacatttattcaatttatcctgaaatcaaatttgagatcaacttagtcaatttgacaaatgtatacatttaaaaattgactttttactatggttttaaaagtttttaacggtgatatgttactattatctttaaagtcgccgttataaaagttaatatttttggactaggggtgttcacggtacgggtcaccagtgaatccgaactgatctgaacagtttgggttgagtcatttatatatttgggtcaaaatcgaatcgaaccgatcaaaaccgttcatgcacgggttgggtcaagggtttagatttacagatccgttgatctgatgacccgatccgtgaacccgtaataataatataaattttattatttatatgtatatattaaaaattaaaaaataatttgataacaaaaaaaggtatgatattgtaaatgtttaagattacattcaaaaataagataagatattttttattgcattaaaaagtaggataaaatatttttaagattgcattgcataatataatagaatatctttaagattgcattggataatatgataggatatatttaggattgcattcaaaaattggttaaaatcatatatttaaattagtataaatagaaacatattttggtgttcatgtatgcattccattccaaataatattagagtattagagagtttatgtctgcatcattaagagaattgttgtgagatcatatagaagtgtttgacaagtttgattcttcaactctcaatcaggatttaaaggtatctatttgcttaaggaatataagcgtaaatgtactattttattgtattcttcttcttgactttggaaaaaaggtcgcaattgagaactaggataccaattttttctctattcttgatgaattgagacatgcgacttctggctgggaaactaggataccaatttggttgggaaacaatgatatcagtctatctctattcttagtaaattgagactagagttttttgatgggaaacaaggataccaaatgggataattgttgtgtaagggtagactaggaaactaggatactaagaactcttgtacacaaaattatcatagtagagttatccattggattgattatccaatttggaagtcgtgattttttacccgattgagtttttcacgttaaaattgattgtgtcttctttatctcttatttccatattattgcttctgctgttcaaatgaacaaggtccatgttacttcatttatatttttgtttatttgtttgattcagcaaatatggttgcaacaaaattggttataagaaagcttggtttataagaaataattatgattcagactattatagtaaatattgttcacaaatcttttgttttaatttatattataagtctattttataatattatgttgatggtattaaatgaatcaattttactacttttatacatttgataatattgtattaattgtatgagatatttgaaacaatcgtgatataaaataatagttataaaataaaattaaatgggtaatccgatgatccgaaccgaaccgaactattcatgaacgggttgggttgggttgggtttcaattttttttcctgaaaaccgaaccgaaccgaaccgaaccgatcaaatttgattgggttggatcctaaatttggccaaaaccgatccgaaccgacccgcgaacacccctattttggacgacaatttttaaactattagaagggtataatttttaagacagttttatcatgaaatcatcttagaaagtgttcttaaaaaaaggtatttataagacggttgttacaaaaaatcatctttaaaagtctacattttaagacgattttttatgagaattatcttataaattgttatctaaaaaaggatggatgcttctaagactatttatgggagaaaccgtattagaagatccaatttctaaaacgattttctcgagaaattgtctcagaacatttccatatttatgaaaatgaaaaatacattttagtcattttttatcaaaattatccatgcacatgacttgttaatgtcaaaaaatatttaaacaacatttagaaaatttgtataaattttaaaaataaaaaagaggcatgtgcaatttccttaatattatgtttggatgagggattttcaaattctaaagaatttgaaataccatatatttgaattgctcttatttaaaattatttaattttgtatatgatttgtttggataaatcaattcaaatttttaattatgatggaataattcaataccttcatatgtaacaatttaaaaataaatttataatttttcaagaatatgaagataaatacaaatttattttcttaaatagtgacaaaatggagatttactttttactatattcatccatcaaaatgaaaatcatatattttctaaaataagttttcataatagtttttcaaaaataaaaaaaaaataataaaaaaatttgataacctttctttcttggttcctccttccttataacctacaccaactcaccaatcaaaatcgtcatcactgactaccttcacgctgccacctccaatcagcattgccattgtcgcgtcccgccaccgacatcaccgtcattctctctctcctccgcgcgacatcactatttccctctcctctgtgtgcaacatacccatcgatctctctctccttcgcgtgtgacagtattgttgctgttctctattgttctcttttgtgtgtgataccactgtaactttcgttctctctctcctccgtgtgtgacatcactatcagcatcgttctctctctctcccccaaatgtggagtcactagacagagggtgagagttgagttagagtatctctggaaaaaatttcaaactctattttttgggagtattttaatgttgactgatttaatataattaaattgttagataaaaatacgcatttgaatttgcttttaaatgttttatacaaacaagtcaattccctcaaaagaatttaaattccctttacaaaatgaattatccgatttaaatatatcatccaaacacatattaaatttcatgaaaaatatgtataagttttataaaaagaaaaaatatgtattatattctcttatgagagagatgtataatttattttaaaattaattataaacatgaattaattttaaattcttgtccaacataaaattaaatatataaaaaatcatctaaatataattttagactcgaaataaattattatctaagattaaactaatcacactcccagagccagtaaagttagtctaacgtgaaaacacgcgccaagtgaagaagtgtattacagagttaagaagaaaaatgcatgaaaagccaagtcatgtgcattgcttggttcccattaccactgcgacaattccaggtggcgttaccccagcttgtcactactgctacctatccacatacgtgtcaaatttctagtgagacacgctttgtaaaatatttatattttattttattttattatcatttttcagtacttcacataacattataaattcaaaattttgtttcatcgttaattgttacatattctaaaagaaaacgtatctgttaatatttttaatttggattttttgtcttttcattaggacctgtgaatccaacacttggacttatcaatggaggaagctgattgagcggttgtttgtgtggacttacaagtgaaattttctcgagatgtcaatttttaacttctattatacagttgtatctgatcatcatcattttaatatctgaaatgaaaaccattattaattgaatctaaccgtggtttcaactttcaattaattaacggtgttaaactaatataatactacatgtttaagtgttgccttcaatacccatgatgtcctacactagtcagtttttagtcatatgaaattactccgctgatgccaaaattattgacaatgtagtttttttattacaaaattattgatggttttcaaattataaatactatttttatttttgaaattatggaaaaatattttgagacctcgtgctttgtgctcaaatgggtagtttagccaacttgttatgaaatcatcccgttaagacattcctcatgtagaactagctaactgtataaatcttcaaaagtcaagaatctctccatctcacgatcggaaagctcaagctgcatgcagtatctattgtgttcatcatgtcctaaaccattgaagaattatgttttaggttgttcatctcagtcaaaggatggtaacctctcataaggaaaatgaacatgaaaaacgtacgttgtcataaagcagctatatatatacaattaatcgttgtcactgaagcaactatatacatgtaacattcacacaccccctctcttttatatatgaggcaaaaaagcatgtaatgctataacccattgcagctcccatgttcaaaaaatccaacttagcttaaccagtggtagaagcccatcaattaattttcttgtccatttaagttactacaaatagttagaggaagcttccaaagttgaatcccaaaagggagtgttaatatagcttgcacgcattctcttgttcctgtatgaacaatcaaataaatccattcaaaagataaatgaatttaagataggtgggttggattgtacgagaccctaaccttaaccttgtagtacactaggatgagatgacttttttttagtggacaagagtcttgcacgtcctccataatttatccaacatttaaccatttatgttgatatactataggataaaggcataaagcacatataatcactttttggaaattatgattggattgaattaaaatctaacggggacgtacgccatgacccatgagaagttaatgggtagtggtgaacattctcattattcaagcacgacaattttgttcttttgtgtgcacgggtgtgtatatattcattttatatgcttagtttgttttatagtgatttcaactttcaagccactaaagctttgaaataaatgagaatggatttccttttaataaaattgcatgaggccaccgttggttcaaggaagaggttaccaaaagatgctgttggcctcctcttttttgcagggcctttattaatttttcgatcttactttccggtactgattatgaatttaaaaggaaatttttttattaaaaattatatgaaaactcatttaaaatttgtaggaaaatatatttctaggtatcctaataagaaaatccttttatctttttctttaggtcactggttaatatttatcttatttttttagtttaatatctctctcccctttctcaatatattcatgatacatcaagttaattaaatgagtagtgcttgtattctataagagagtaaaagagtaaattaaaaatatacaattatacatcaatgattaatattaaaaatttaataattacggcaccacttaaaataaaataacataacttttatttttttagttgtaatatttcatgatttgatttaatggtcaagatttttgttctcactcagttataataaaattccatgtcgatctctagataatattaaaatatttatattaaatatttataatgattattcttttttaataaaaataatttaaaatttattagtttttaattagtagatattaacatataaattacattttagatttatgataaataattcatattatgatataaaaaatttcttcaacggtttattaatattgtcttatctctttcaatccgttatttttatctttatttttaaattgaatttcaatatttttagaataaattattaatattaaaaataacattttattatcatttatcataaacttataatataatctatatgcttgaaaagatactagtaataaatttgtaatgtaactaattataatcaatgtaatttgtctaatctttacataattaagaggattaatgaaagaaagaacattttgatttttgttagagataatggtgtgaatcgatttttataacacttatttataatgtttaataagaattttctatttcggaaagtttctatcaagtcttttattttttaaaatgccataacacgattctttgtttatttattttttttaatgtgattctttcggttcaatttagcatgaaggcattaagtgaaaatttcaatagttttaatcaaattaaactataaaaaacagccactttatttcttattttgaaaaataaaactaaaccagcaccaacgacaccagacaagtgttttaagggtcaatacttcatctatggtatatgatttatgatggaacatttgagaggtgaatgtttttatgaataaacaagtgtttgctaaggcatttacatctagatgcgaaaattgtttgcgagtaaattcaatagggagtgaaacttctttttactcttttccttaacaagcatatgtagatgcaaatatttttaatttccgcctctctgattttcttgattttgacatgcaaatctacaattttagtataattttttatttttttaaaacatgataaatataatgccgattaaatattcatacattaaaactcatcaaaaattgtaacttaacatctcatcctgaattgacccataagaataatataaaagtatttttaaataataaaatatcacattgagacatcatttaaaaaaataaagaacttaacggaggcttttgaaaataaaatggcttaattaagcattctaaataattgatcatttattgcttatttaaataagtaaatttattaagataaacctttttttatctttgaataagcaatttgaaagacaaaaaattataaaaagttcaactgaatatcaaattatattggaaatgataagattttcatagtaaaggttttcaactgaatatcaaattaaaaaaatttcaactgaatatcaaatttcaactgactttcaactgaatatcaaattgaaaaaaattattaagtttgcatattaaattcaaaaaagttttaaaatgataagattttcataggaaatattttcaaattcaaagaagatttataatttatttattattttggaaagcttcaatcgtcctttattttttaaaatgccataacacaattctttaattttaaatttttttttttttttaaagaaccgccactttgcgccgccaaattttcaaagaaaccagcgtcagggcgttgaataagaagcccgtgtcaacgaaaagaaaggcattgacttgaaagtttgaaacttcaactctgaaaacgaaagaagaaaacaatgtctgggtttgatgactacactcgcttatttgatttcgagaccgagccgtggcagaccctctatgactggtcgacgcggaaccttgctactccggttcctcccatgtcgctggcggaggacacccaacaccacgtgaaccagactgtctcggctccggtcgagttgcccagccacccagttgaggcgctggtgcataacggtggtggtggttccatgatgcagaatgctgcaggttcatcggttcggcgcaagagagggagaggggaggcatggactgaagaagaacacatgtagacttttaacgttgtattattttaatgcagtaaatgaatgaaaacttatcaaattctcatctcatatttgtttttttaatggcaggtcttttttagttggactccaaaaatatgggaagggacaatggacaaaaatttcaagccttgtgaaaacaaaatctcctattcaaatcgctagtcacgctcaaaaatactttcttcgccaaaatgcctcactcacacagaaaaaaagaaagagcattcatgacatatccttacattataaaattggagttccttacatcattgatttacaaaattcaatttctcttcctgaaattcgacaagttcacgaaatgcaacaaaaacaacaaatgttgccgctgaatccacaaaacagcttgactcatcaaatgaggggatttgaaaattctgatagtgcatatcaacaagttcatggaatgcaaaaaattcaagaacaggtgaatgaaatacaacaacagctgaaattgattctgcagcaattttcaggggatccatcaaacaacacgactccttagaaatgagtggatttgaatattgtgatgacgagacattgtataaaacaattttctttggttgagtttagatgctaatgttatgggagattaatcttatttatatctttgtattttaaatttgtttgttatgtattttaaatataggcaagttgttagtttgttacacttaatcttatctagttgttttggtttcatcttatctagtttgttatactttgtaacctattagttcaaagttttattatcaataatatcaattcacacattcttctgtaaaatattttcttaacctatcttcttaatagctaatgctttattaaagatatttcttgacataatacaaagttgttttgccgccattctatttttggaatttcatcatggatatgattctttaatggtagcagatattgtagtctgttttaatgttcaagagtcatgatttttttttctttctcgaggtcataatgtataatttgagttgtgattggttcatatcacttgtttttagaggcagcattttgaagtgggatataagcattaaaagatgtgagatctcatgtttgtccttaacggaagttgtggtctgttttaatatgaggagtcattaattttctttcttgaggtcatgatgtataatttgagcctgtgtatccaagtgactggttcatttctcttgtttttagaggcagaattttgaagtgtgctaagcattaaaagatgtgagatctcatgcctgtccttaaccgaagttgtggtcctattttaatagtatgaacatattcgtttggtttggttatgttgtatagaaactgttatccatgatcgggttaccggcaatgagaagcatgcaagttcaacacaagaaaggaacattaggagagaaagggatgtgagaaatgtaaaaatgaaaatgttaaagttgcatgtgcctacacaagaaagaatattatattgccacatattatatgaaaatgtgaaagttgggctggtctgtacggtggagttcggagaatgggctttcattattgagcccatagacggaactggaggaggcccaaacgatggagggatggggattggagtttttggaagcttctagaatggagacgaagacggggattgggggttctgcatggcgtagcggacgcccgcttgtgctgcgaggtggaggacgggggagagaaacgacgtcgaagagcttggcgagcaacggcgcgtcgagagcaggttcatgtttcctcacatttttgtttttggtttgctaggtgttaattaccctttctttaatcattgatatatatatatatatatatatatatatatatatatatatatttattttgttttaatttgatcaggtgcgggagggcatgcatatatatatgaaccttggaagtggtttggaatgatctctagtgtgtgatttttaaaaattattttggttctgcatttactaaattataatatatcatgtagcattttacctgcaaaacacatttgacaaggcctaatcataagctacctatttttatttaaaggggatttcttgtgaccaattgtattgcatgtttgatctaattcatctttaattgtctgtttgtatttattgtattacttcatgatatatggttttttctgttgtgttgaaaaggcgtctcatttgttgtctttatcagctaatttgacattttacaattaggattataatggagggtgaaaaaagataaagtgatgcagaataatttctatcacatttcaagtctagtggactaccaaaatttcttgaacccaactgatttaagtttaattcttctaagacaaaattatttttattacttttaattttaagttctactactttgacaatgtttcctttgactttggattcaaatgtcttagtacatacatataaatttcatagatataaattttgtgctacatataaatttcatagagcaaattttcaattaactctcagtactctgtaactataaataactaatttgctaatgtccccgacaatcttatgaaaatttcatcaactaattctatatgtatgctttcatttttgtagtgattgttggagaagtagccaattttgcagcttatgcatttgctcctgcactacttgtaactcctttgggagctttaagtatcattttcaggtaaggaacatggtattcttcataacattaattattaggatgtttctgctttctttgacacaaatgtggatgcacatcttcatccattaaattttaatttggatgcggcttgcattttggaaagttacaaactaatatcatgatgcagtgcaatattagctcactttatcttaaaagagaggttgcacatatttgatgtgctctttgtatggtgggatctacaaatattgtgttgcatgctccccatgtaagagttattgactctgttaaagaagtgtggcaacttgctacagaaccaggtaattttcaattcctgattgtttggtttcaacatatcttttaccattgaatcttgtaaaaaatcaaagtaggaggatacaagatgagtgggatgcatattaagatcttaatagattcaaggcattcatttatggttaatgaaactgacattgagttctttccttcatcaacaggctttctaatctacatgtgtatagttgtggttggtttgcatccttattttctattgtgttctcgatatgggccaacctatctggttatatatgtcggaatatgctctctcacaggctcaattacggtatatcgattatgtgttcagtgctcatatgtgtcatgtaggtcacaataaaactaccctctataaacctaatgttgttccttgttgcataggtcgtgagtgttaaagcagtgtcaatagctatgaagttaacatttgaaggcaacaaccaattcatttactttcagacctggttctttatgattattgtaataggatgttgtcttttgcagattaactacttgaacaaggtaaactttgacttacttatattagtacatttactgttggcagtcattgtaatttgtcttccaaagtacaacttaaaataattatgtcaaagttaaatatatttttaattttttttattggttattggagtgctaatgttgaaaacagtattttgatttttctgaccttagtgattaggtggtaatttgtaatgctcaagaaatttaactatgcttttgcaatctttgagacttctatcattatctaaatgaccatgtttgcatttctaatctagttcgtggcatttggaaaagttataaacaaaagattttgtattgcttttcttaattggcattgagctatttcatttcctttcctttgccgttatacatgagtaatacgtaacatgcaatatttcagaaatggcatgccatattttttacagtagggatttccaactaacttacaattgaacttcattttagtattggtttttagactttctttaataaataaaaccaataatgttagaatcattcaaataagtgtgccgggttagttgtttaagacaatatgcttatcagctaccaattatattgtaatgctattttatttattttggaatcatgtttcaggctttggacacctttaaaactgcagttgtatcaccaatttactatgtcatgtttacatcattcaccatctttgccagcataatcatgtttaaggtaactaattgccttctatgattccatatatatatatatatatatatatatatatatatatatatatatatatatacttttgtttaaaatgtacctgatgatgctactaaattatgcaatcatatagtagtttaaaacaataacaacaacaaaagcctgtttccactaggtggaatcagttacatgaatcaaaagatatcatcgtgttttgtcaaaaaaccaattcttcaaaaatgctatttaggatctaaatcgtttttcatatatttttacttgaagtttttattagtattcctctacatagttttaactattggcgatcacttatcaactcttcatatagacatatggttgtttatggaaataaaacacaaactaccttttttgaagaacttggacacctaagatctattaaatcagacaaactgaatttaagattatatcatataattttggcatattattgaaaacatattccttaaaatgtcctcaatgtgtaatttcatattttgttttaaaagcatgcatgtttgtttgctagtacttagtacttgaaaattctaacacatagagtttattttgtttatttgttatcgttctattttattatttcaaggaattttttttcccaaaaagtacgttgcacacctaaaagtacttttgctgttgattttcactttcaaaatctgcatcgatggtaacgatagtcagtcacttttccatattcaaacaatttccaccgaaaaaatcaaatagttttgtcattttagagcagcattatattacgtactattatataattaaagtgaaagtctattctcattaatttcataaataaatgtaaaattatctaaataatatatcgtgcttcaccagttcagtgccgcaacccccactaacacaccatgtgattggattataaagatacatatatagcattgttgttattcttttcatttgccagtacctcaaagaatgaggaacataacataatttgataattatgtaatttgcatcagatgcgagggcaaactattctcatttctcaatttgctgtgagagaaaatcgggtcgctgtcctccaattttttccccacattcctgccattttctgctttaacccaagaaattaaaagcgaaagagagtgaatcaccaataaataaataaattaactaacaaaaaaaatatatttgtccatagtccctaccgacataacagaactcaaaaaacggcgttaaacttttaattacaatagttggtttctacttaggtttcagacaaatagattgttttcaaaagacagagaaagttacgtgatatactttggtgccactcgtgcatagattctttacaaaatctctttttttgttacttataggcatgaatttcttaaacttaacaatacatgcatctagtgaatacagagaaatttatggtggtgataaacaagttctcttaattataaatcaataaacaatacttagtatagattaaataacaatctaatagtagtaaaaattcaaagatagttactaaaaaacgtagcacgcatcgtataattaagaatgagttgaattaaattgctatcttgttaattaaactcaatttatatgtaaatgatataaaaaaaatccatagatcacatataaacccgacaagaataaaataaaattacagtacctcataattttgtgatctaaaaatatccctatggctaaaagctatatcatacagaaatagggatggatatttgtcactttcttctttttggaaattattttattccatctcaagttttggcaggagtttccagtgcgtaataaatattgtgacagaaatcttgatacataaataagtgtgttttagtttagatatcataataaattattaaaatgatttactttaatttaatttttgaaatatgaaatgaaataaagtagaatttatttttatctagtaataaataaaaacaagcaaatatgataaaataaaatatagctaaattaaaagttattttttgacataatttccatggaaataattattaaaattaaataatgctcctaagaaaattaaataattattaaagtcaattagttatagacaaaagaagatacgtatacaacatagaaagtgagtcgttgataaggaatggaggataatgataattaagagacttgtgagacacatattgtcattgtaattaatatcattaattttaattaaattagttttagtaactgaggattattcagagatcataattaattacatctatcatgcataaaggaagtacaaccgggaagtggatgatgcaaaggtggggctataataatggacccaaccatgtggtgtggtgtatatatatatatatatatatatatatatatatatatatatatatatatatatatatactgtatcattgctcttttacagtagtcgaagatcccgggaagggaaatgcacaagaagttccctatcccatagcccataggcacagggtgcctttacaaaaggagattgtggttgttgatatgtccctcctttgtaatagttatttataatttagatatatacagtacattataatagtagtaacaaagtgttcaagtagatgatatgaattaagataagaaaaacaaatataacagggagatctcaacacagttttattatttgagataaacgtttataaatgaatatggaaataagaagaagaaaaacagaaataaattttttaatattttatggacttatattagtttatttggttttatgaataaagtaaaaaaagttaattaagttgagacgttatatttatatatgtgatctatttattaataaaaaaaatattactacgtaagcttctccattgaactaattcttgactatatgcattggtgatcgctcatatatagatgactaaacttttagcaaaaccgaaataatctattttttaaaagtttatatgtgtgttcttctattttctttgatcttaatttttctaggacgctacctgtattcagcccttgtattgagataaacaaaaagtatatttccaaacaaaatagatcgacttctaatctataaagataatttgtaataatcttattcttgagaaattattagataatttaggatcatcatttaattagttcataatcatgattaatttctatatgacacttaattaaatattactgattattttttcttaaattcgaaaaattaaatacatgttatatgaatataaatattgattgagaccataaataaataataatttaaaattatctaataatttttctcacatatgcgctgcacacaacaatttgaaaatttaactagataatcaacatgtgtcattctcgaacgacttagcttaaatttatatatatgtcagaatatcaagcattttcttgctatacagtgggttgaatttatagaatttagaatatgtgattttgaagcatgctagagcttactagctattaattcacacataaatatttttctttttccttctggcatattaaaaggtccatatacaagaaacttagatttgaatcctctataattgaactctttaaagatattaaaaaacaatcaattttcaaacttcacctaactgctttaattggtagaggagattaatttgttccttggacgcatgtgttgtttaaagacaacatgtgattctaatccttctttttatttgtcacatgtgagttgtgctgaaaaattatatttatacaataaattaacttatgcaacttttatttataaataaaagagagaaataagaaatgaagagacaataaaaaaatgagataagtgatagagagaaaagaaaacgttgtataattttttacctttggcggctgataataaaaaaattatttagttttcttgtatgaatacaatttttcactggactttcatacaattcaactatagatgatcaagatcttacaaacaacatgtcactttaggaaaaacagtgtaaactaacatgtttgaaaatgaataatttcacgaaggatttttttttaaaaatctcatgaaattgacaaaaaaaatggttatttttaaaataaatcaagctaaatatgtaaaaaaaaaatgaaaagattgacaagaagagaaaaaaatggaccaattaagtaaagtttaccacgagctcattgtcattagaaacagttagtttaccacctcaagctttaatttggggaagaaaacaggaattcaagtaatgcataaagatgttaaaaattagatactcatgaattagaataataattctttatttatttataattttattcattcactttatacttattttatctcttaaataaaatatatttatacaaataacattaacaatatgttgatatttaagatattgattttaatgtcaaatatttaattcttcgagataagatcctgaaagctagaataaattaaagcccaaaaatcaaccaaagtgggatgcgttttgttctttagttgacaatatgttccacaattagtggggtaaagtttatatacaagtcaaaccaaaataaggaaagtttatgcaaactgaggaccagaggaataaaacattgaagctagagaaaacaattccttttcgtcctctttcttctttcacaacatacccgaaatggaaatgaaaacattactcaaaatcatattgaaatgaaagacaaatgtggcatttccatcgtgaagaatatcatttccctcacagacacctcatgtataggttgcagcatgcaatggaatatggatgaaaacaacaagtacgtgtgtgagttgaacttgaactagggttgttatttactcgtcatgcacaagcaaaactgaaaatcccacgtaatgttatattaatcaataaataccttacaacggtggggtaggctaggttgctttctaattttgcatataaccattattcacatttgctttttcaaaatctagggctagcaaggaataaagatatggtcgttgctcggtagatccatgagaattgactttactacccatttgagactaagacagaagaagacatatggttctcctcacaactacgtcgtcctcttcatacacatatctatataattaatatatttcaaacaacatgcatgcctttctttcagagcaacaaagtcatacttttggcctttcaccatcccgtggccaatggggtttagtactaccgacaatccacacactatgaatgttctgcttggcccttcatgcatttgctcacatcatgtttaatcaattctttttctggtgcaaaatttctgtagggaccactttattgcaaataataatatacttcctctatattttatacatatgtttaaccgttgtagcaaaattatttcctattataatttcaaaataattgtatatccttgtctttatagggtgtgatatttggagttaagtgtgtgtttgggatttcgagggaaagaaataggaagagatcaagggaaaaatatgggtaagaaaatgaagaataaaactggaatataatcaattagtttataaagaaaataaaatgaagaattaattgagttataaaatacgtaacaataatatcttttttaaaaaggactaacaataatttattggtcggttatatgttaaatgggcaaagccgaaaaccaaggctcatatgtacccataacccatgccacctctaaaatcaaccaaaagctgacaatcattttataaagatggataggtatatataatttaagcaagaaaaaaaaatcaagatgatgttgattaatatgccaaactttatgaagaattaattttgttggaaatttttatttatctatttatatattataaattagaatacacaacttaatgagtgatattttttttccattctcttaattagacattttcaatatttcctctattcttcggtctaaatgtgcattccacactctactcctacattttgttaagaaaatctctcaatcatctcaaattatattattttatccttatttgtatgtttaatatttttttgttattttctatccttttaattacacttcttattatttaatatagtattttattgattttttataagaaaatactagtttgttttaacctatttcatttattagacttttgattattcaatgtgattaacttgtgtttattatatgttgtagtgatttagtgattaaacatcattgaaattgcaaggaataaaacaattcaaaaaaaatgggtaagatcttttttaaaaattagaaatgaagcaatgaacagtgtttgaaaatgtatatgatggttaaacttgtattttagaatagttttaggttgaatttatattataaacatgacaaatgttgaatttttttgtttaatgtaattaattaattggataatgtggtatcattttatttggtatttgaatttattgtttttgatcgataataatttgaatataattatatatgtttgttataaactgtctgagtttggttatgtttgaaaatacaaattggatttgttgtcaaaacaaaaccaacattgaaaaaagttgcacaaattacatgggctgccaaaaaatcgatgtagatctctatatccagaataattttctacaaaattgtctttataaagtgcattttttacattagttttaagcaaaattatcgtgaaaagagacattttacattgatttttctcaaaattatttttgaaaatgttgatattagatatttcttatacgatttttataatgattttggaaaaccatcatcaaaagccaatgacaattgtttaaacattgattgaaaaatcgtcattgaagtccttctaaaatcgttgttaaacttttttataatattgtattctaacatcttttatctttatgtcttgattaaatttcaatagattgtttttaacaaaattgtcaatggttattcattataaatctaagatataatttatatatatttcaaggtattcatttattataaatttaatcatgtaatgaatttaaaacaaacacttatcccaagcaacacacaaattaaaatgcttgctaaatattaagtataatgggattaacaaattctttctaccaaatttattcgtactcacttagactggatttgtatttttgcgtaaaagggatgaaaacccagtgcttacgaagtctaagctaagcccataaaatcagagaagaaacggcaacaaagcaacaaaagacagagaactgggctaatctgccagcagaagggagctgttagaatcggaccggtcatcgaagacattaattcaaggattaataattcaatcaaaatcaaattaggatcaaatagattttaatataataacttaataattttgaaaaaataataatatgcataaatcaataataataaaagtaaatttcatttaaaatgtcataagttataattttaaaaaaaaatgtcattttgaaagtttttattttaaaaaaaagtttaagtgaaacagattaatctatcgggttttataggttattactagtttttttattggttcaacagtttgcaccaatttaaaggagacaccaatttttaggaagttaaatcggacatgtgacttttaacttcttgcaagtatgattgaaaatgctggtcaactttaaaataataccaaggatatgtatctgagttaattgaggagcatatgagaatgttataaatcttaatataattttctatttttatggataaaaaaaatactaatttagagagtgaagagaaaaagaagattacaataagaaatatggcatgtgaagatggaggataaacataaataccatcctcttgtcgttgctactcttcagctttttgtgatttttctaattttagttcttgtattttacttaattttgatctatgtaagattttaatatttttttatttataactcccataactttgtgtttatagggaccaaaattaaaatatatatatatatatatataaagttatgtagactatagataaattaaatatcttacaagaattaaaatagaaaatgtctaagttattagatctgaaattagaaaaatgaatttaaagaaacaaaatagattattaatagatataaaaatatctgaaaagttataagagataaataaattataaataattacaaatagattatatctgtccgccggaggttttcgcaggcagcagtggccttttgccatccttttcgaagcataaatatggttatggctggcaacagtataccatatgctattttgattgcgatggaatctcatcacagcattatatacttatcgtcttctttcaataatgctttcatttttcttaattggttcttggttaaattgataatcacacttaaaaataattacacgaggccatttctgaagagtaattgatgttaaccttgacgtcccaacccaatgtgattattaagggtaacatacgccttgaacttacctgtttagtaactttttttatgatgtattatttcttaaaagaaatacatatactaagggacacgaatgatttaccttttttatagtttatttgttgtaaaatttgtataattattcatcaatatgctatctttatctttggcataagtttgaaaaacttatttctaagcattgatgaattacagtgaaatacgtttttatatttagctcgcaggaaagtacaaatatatgaattttatataaaaaatacaaattatctcaatccaatttttaaacttctatttctattttcacttcttttataattaaaattttaaaaatattaaattccagtcgaacctatttttaaatttaacgataaattcatagtagtcataatttttataactaattttattaatatttctacttcaattaactaaatacctttctgttagtaactttcagttacaattttttttttggatagaaattacatttttttgtacttaaagctaacttgtcaattttttgccaattacctatttcctcaatcctcgccttaattaattaacttgctacacactcactcggaataaataaacagtgcatttgttatttttcacaaacccgcaatagtccaaaagtgttatttctgtatggggtccaatttatataaagccaccttgttaatattatatttggtaattattagctgtcacgttggtgatttctcggatgtgcttagtttgagagagttttgatggctctctttatttaatcaaatgaaattataactaatgtatatttttattatttaaatataatggtaatgcaatatctctattttaaacactttaatgagagtgtgcttgtgtataatatttttaaggctaagaatataacattataaactctattattagtcagatacaaaaacagattaataccatgtaaaatttataaataaataaaaacttagctctgaagtacagtacaaattttaaaaaaaaagtattaaaaccacttagtgaactgaatctgatatggcaaacatagtacattaaatataatttcaacctaaggagcaaaggtgcaatgactatattttacaaggctgttattacctataaaaccaaaggttgtgtttctgttacattcaaaacaaggcaaaagcaaaggaggacttcaaagagaggaaaagcaatgaggccaccaagttcttccatccactttctcctccaaattcttcttgtctttctactgcacagacccagctttgcagtgaaaaaggtgagctattgcaatttgcaatcttgaaaaagataaataaaactgtggaaaaagatctaatgcttgcactgaaccatttaaattgtagtcatatgtggtgtacttgggagcccactcacacaagccagaattatcctcagttgacttcaatcaagtgacacagtcccaccatgagtttctgggatctttcttaggaaggtattaaaaaaaaaaatgcaattataacatcttaactcacatatggtacaatttattacctattgaaattgtttgagtttgcttattttttgtagttctaatacaaccaaggactccatcttttactcatacacaaggcacatcaatggttttgctgcaactttggaagaagaagtagctgctgagatatcaagtaagaaccaagaaccttatcctctgcttagttcctctgttttctcttctctgtgcttccttcatctcattgtgtacttatacccttttgtccatactgcttctagagcaccccaaagtgttgtcagtgttcgagaaccgtgggagaaagctacacaccactcgatcatgggatttcatggggctagagcataatggggtgatccaatccaactcaatctggaataaagccagatttggcgagggagtcatcattggaaacctggataccggtaagttttcctgatttatgtgtttaaaaactcttgctattcttttcaaagtggtcagcaacatcttggaattaacggggtttgattattattattattattattattattattatggtttaatctagatcgttgacttatacacacatgtggaacatactcaaagttatctcatcgtatctctatcccccaccaccaatctgtttccagagtttgatcgtttcaaaaaagttgatttcataacattagtttattattaatttgaatcttgccgtcaatgggttgttagactagtttttttccacacccaaagtatgaatgttcacgaaccatcttaaagaaatagactaattgcattattctcttgtgattagctataactacacttacatcatttttatatagtaattatactcaaagcataattaacactaaaatgaaatggacaaacatgacatgattaagtaaaataattttatcccttaaaaatatgatcaaaatcatatatgagaagaagtcaacttcttaaatgaattttaatattttaaaagattaattttcgattgagtgatatcttagatcatccaaaaaaatattatcatcaaaataaaacaagatgaaagtaattatttataaagaaattgaaaaacttcttatggtaaaattagtatgtatagaaaatgtttggtgataatggagtagtcgactttcagaatggaccacctttagaaaggcgacatgggcaattaggcatcttgtcatttgtctgttatatatattaggattagaattttgttacaattattggtttatactacaccattagatgttcattattttaaataatttaaaagttataaatatatgttttcagtctatgcatatgttgtgatgcagaaggttggtcataaatcatacttagattgagacaaaactataagttgtgacttctgttcattacgataggactaaaataaataaataaataaaaagggtgggcttataatgtgaggtggggctaagaatggtgccaaggtggggatagtccaaggaagtcataataagctcaccaataagaaaatcgataagtgcattacatgagcttcattttgaaaatgctcccaaactgtaagcatgaaaagtgggtgggggcaatgaaaactaaaaacaggaccatcatgatgctagcttttagccaatttggatgagattgagggagaaggggtagaaggaagtagaatctccgttttacaatatgcttatcttattttgaccacactcttctctcttttgctcccaccgcattaccgctaggtgtttggcctgaatcaaagagctttagtgaggaaggattgggaccaattccttcaaagtggagaggaatctgtgataacggaattgatcatacttttcactgcaacaggtaccatcttcctttgagtttgttgggatatttataaaaagaaaattcgaattaaagtatttaatattggatctcgttaacaagtctcctcagaatatattttttaaagaaaatatagttttaattcatcaaactattatttttattttaaaatatttattcaatgctaaatatattttgtaattataaagactttttaaaaaatcaaacgaaccaacattgaaaatttatggagatggataaattgaatgtaaacctggtcattacattcctgtcattttatatccaaggttttctttaaaaaaactcttaatctgaattcctctctccgtgtctagaacgatatggccttgttagaaaagaagaatattttgaaaaatattaataataaattattttcaacaaattatttattatttattaaaaatcatcaatttttctgaatctcacctctcattcagtattctctttcctaatttaataaattttaattaatatcatattgaatataagaagaaaaaaattccttatgtgtcaatatcaaatataaataaatctcagttattttatttaataagaatattaagaatgatttagaaacaaatattttaaataaaatttatataattaaatgatgtcgattaattttttattagaataattttttctcgttatatttaagattagattaaagaaagtaaaagaaggtgttataagaaaaagttatattagaaaatatgttattaacccttttctaaccatgaagtacaacaatctttggttgaatttaggatttatcttatttagtcaaccacttattgagggccactcttcatgaaaggattatgacattaacttcaaatgtgtacacactattcttgtttttttctccttatctatgttccttccattcatacacactctgaaggtcagcattttccatataacatgaggggccactcattcctcactcaagacaaacgccattaacaccaatttgaacacactaaacaatgcaggaaactaataggggcaaggtacttcaacaagggctacgcctcagtggcgggtcccctgaactcctcctttgactcgccacgtgacaacgagggccacgggacccacaccctatccacagctgccgggaacatggtcgcacgtgtcagcgtcttcggccagggccacggaacagccaagggtggctcaccaatggcacgtgtggcaacctacaaggtctgctggccccccgtcgccggcgacgagtgcttcgacgccgatatcttggcagccttcgacttcgccatccacgacggcgtcgatgtcctctccgtctcgctcggtggctctacctccacgcttttcaaggatagtgttgccattggttccttccatgccgccaaacatggcattgtggtggtttgctccgctggcaacactgggcctgcggatgccactgcggaaaatcttgcaccctggcatgttacggtagctgccagcaccatggatcgacagttccccacttacgttgtcctcggtaacaatatcaccttcaaggtttgtctctttcccacacacattttcttttatggaaattttgaaagagtttaactttatccaccgtgagtgtaatttttattttttacaatgtagttctatagtcccttaaatgtttataatacactaagttagtccttatttcactttatcatatcaagataatttgatgatatgtggcattgtaagagatttcatgtaaaataaaatgggcacttgtcatgtcagtcaaaattaatattattattgcaaaaaatgatggaaaaaactaatatgatctaggagatagctgactcaatattcttgtacattgcttgatttgaagggcgaaagcctatcagctacaatattggcacgcaagttctacccaattattaaagctacagatgctaaattggcgagtgcaagagctggagatgcgtaagtataaaaaaaaaaattgaaattcgttatagtcgtcagttgttgagtgatcatttggcataattaacatagtactagatatggtaaataaaatttatgtgcatgcagggtgctgtgccagaatgggaccctggatcccaacaaggtgaagggaaagatcgtggtatgtctccgaggaataaatgcaagagtggacaagggagagcaagcttttcttgctggtgctgtgggaatggtccttgctaatgacaagactactgggaatgaaattatagctgatcctcatgtccttcctgcttctcatatcaattttactgatggcagtgatgtctttaattacatcaactcaaccaagtaagatacttaccagtctagtcgaccacttattaatactaattcatgctatgccttaaagttatgcctactttggagtttgcactatactattgttattatacttacaatttatggtcaaataagtaaaggaagcaattctagtttttttgtgattgttattgtttgagctatataaagatcccgaaaggataatcatgaatttcagtttttcaacttgactacttgaaatttatatattgctaggttcccagtggcatatattacacatccaaagactcagttggatactaagccagccccgtttatggcagccttttcatcaaaaggaccaaatactatcgtgccagagatcctaaaggtgacattactcactagtgtaatttggcttgtaattttttgtaatgtgttagatatctaacaactcttaatttgtccaatatattcagcctgatatcactgcaccaggggtgtcagttatagcggcctatactgaagcccaaggaccaaccaatcaagtgttcgacaagcgcaggattccatttaactcagtttcaggcacatcaatgtcatgccctcacgtttctggcattgtgggactattgagagccttatatcctacgtggagtcctgctgctattaaatcagcaatcatgaccacgggtgagtgagattttcttcaagtttctcacgcttcaaatcctttttcttaagccaatctacaacaaaatgtcccagaaatataaagcttagatatatacatatagaaagtaacttagatatagtttttttaattcttctagtgttaataaaggttttcattaaaagattgtgcaaggtgaaactctaattcgaattagaaaacagcgattacagtacctaagaaactatatgtaagattatgaggggaggtgaaactccaattctaattggagaacgacaccaatagtatctaaggaactgtatctaagtttttgtccatacatatatagaaagcaactttgattggtgaggttaaagtggctatcaaaagttgattatttgtcctctgcaactttcagctacaacactagacaatgaggtggaaccactactgaatgctaccaatggcaaggcaacaccattcagttacggggcaggacatgttcaaccaaacagagcaatggatcccgggctagtttatgacacaacaattgatgattacctcaacttcttatgtgctttaggttacaatgcgacacagatctcagtgttcacagaaggtccatatcaatgccgcaagaaatttagtctcctcaacctgaactatccctcaatcacagtccccaaactctctgggtcagtgacagttacaaggagattgaaaaatgttggttctccagggacgtacattgctcatgttcaaaacccgcatggaatcaccatttctgtgaagccaagcatcttgaagttcaaaaatattggtgaagagaagagctttaaagtaaccttcaaggccatgcaaggaaaggccacaaaaaactacgtgtttggaaaactgatatggtcagatggcaagcattacgtcaagagtccaatagttgtgaaggccttcttaactagaaattgaattgatgcaatttagctcatttgcatttctaattgattggtagcctattctaaattgtatgatatatcttccaaactagggcttctttgagagttatctctgacattgattgataacaaagaaaccagcaagtggctttctttgggtgtacttttactatgattccaaggagaaataaaacctaacacgttcattctccttctagttataaaatctgggaagtttcttactctaatcatatttcaagccttacttgttggcattaagtttcttacatgacatgttaaaacctcatgttgtagtctatgatgtaagaatattggttcttatttcaatttgtattgagaatattgtacacataaagttttgactttgtagtaacgaagtgaggaactatgatatgaaatatttagtatgtaaaacgttgaatatatgatttgcgattgatttagatttgtttaaatgtgataatgtgtgggttgaacatgttgagtcaaattcctgagtacaatttgttttcaatgacaacaaacccctcaacaagataaaaaaattgcaaactttcttaacctgattattttgctaagcgagcagtatagtacagaaagacaaaccacctacggtgaaaatgcatcgagtgccttctgggtctgtagaagttcaattcaatctaattgattatatttactggactgatcctcctttttttcttcccagaactttttgtttccttaaatgatattttagtttttaattgtaattctggcaatgatagaaatcattagagataagatgtgtgttttaggacgctgattgagcaaacaaatcctacgcctctaatgagaggagaaacgagccctttagtggctgattcagattgcatcaagtaaattagttcaacaaccacaatgcaatagctgctcacttcattcctatgtacattttaatggcttttagcaggctttcttacattggatccattggcaatgagtacttgagcaaaaataagaaactagaggcagcagatatgggattgggaaaatttacaaaacgatgttggaagtatgttgaaaagtcacgctgtataattattaatgaatgtcttattaattttttgcttctacctattaactcttgatgcataatctcttgccaataggagcgtgaggaacttactacaccaagaagacgttgaagtgatgcatcaagaattgattcagtaattagacaatgaaaacacctcaataagaatttgagtttaagttacaaaagtctatctacaataggttacaggattacgttaactcataatctgccagagggggtattatcggtttatcaaaattagacacggagcattttggttttcaagggaggggggggaggcattggacattgaggcataagaaagacgatagatttatttggataatttttactttttttgcttaactcaactaaaactcatggttgttaagaattaagatgttctgttgagcaatattttgaagatgaaatcatgaaacatactactactagcttgcgaggaaaataaagaaagcaggtgtattatttcaattttaatatgaaaaaaaatatgatatcaatcaggctaacaaattaaacatgaaatcaaagacaaagcaacttcaaacttttgaattgaaacaccatcacgataaaccctactactcccagaaaggaagacacttatttcctttttctccatttctgccctttgcgccgaactttgagtaacataattcagtagagagcggtatgattgaacctaatccttgtacttcatttcagataccaggaagccaggcatgtcaaatgtggcagagaacttctcaacatcagctttgagatcttcaatggccttgttgttgacgaggcccttgttgaaatccttgagaagtttgccatgctccttctggatctccagtgtgagagtcacagcacggtgaaggaactcaccaatctgctcaaagtccttttcaaccaaacccctagaagtcatggcaggggcacctgttcacacaaactccagtcaggcactcacccatgataaacaaagcacagtcacacatttcactaacatcagagaaaaatacagaaacaggggcaataaaaaaaaaaaaaaaaagcatttttgtaattaatacatcaagataattaattcatttttagggataaatattaaaaacaaataacaaaaaaacatattagtttatagtaattgatttggcaatcatattgcacaatcaaacaactagaaactcaataataatggcagtctgcaagcttagcccgatctaatacaccattgttaaagcactagaaattaaaaacacatcctcaatgaaatttcttccaatactaatctacaacttaccaagataccttgtacaaatgcattaaaaaatccacaaaacttagatacaatcactttgtgttttaagcattgttctccaatcaaaattaaaatttcacttcgatatatcccagggctcaaccctggacaggatgtggaatatgctagcctttaatagaaacattattacttacattccaattctgataagaaaacagtacaaaatttcgtaagaaacttcattaagttctgtgataaaaaaaaaaaaaaaaaaatttgaggatatagtcctagccttaggaaatcattatttgatcttaaaaatgagatcttgttttgaattgagttagtaaagcaagatctgtattctagcacataaaagagaaataagttggttaccaattcgcactccaccgggggccaaggcactgctatcaccaaaaactgcgttcttattaacagtaatgttgcagagatcacagagtttctccaccttattccctgcaaagcaataaacacaagaaacgagtcagattcagattcagatacattggcaacaaatcgaaatcaaaatgcagcggtccaatcctatatatattaccagtcaatccaagaggtctgagatcccacaagacaagatggttctccgtgcctccagtgacaagactgtaccctttccccatcaagtaattcccaagcgcaacggcgttggccttaacctgcttggcgtaggccttaaacccgggcgacgaggcctgttttagcgccacggcaagagccccgatctggtggttgtggggcccaccctgcagcgaagggaacaccgcaaagttaatcttgtcctcgaaatcataaaccgcgttctccggctgccctttcttcggcggcttcgggcccttccggtaaaagatcatccccgcccgtggaccccgcaagctcttatgcgtggtggtggtcacaatgtcgcaatactcgaaggggctgttcacttcctgcgcggccacaaggccgctagtgtgcgccatgtcgcagagaagcaatgccccgcacttatccgcaatttccctgaagcgtttgtagtcccaatcgcgagggtaagcgctgccaccgcagattatcaattttggcctgaagtctagggctttttcctccaagcggtcgtagtcgatgtagccggtggtggagtttactttgtaagggaggctctcgaagtaaatggaggtggcggagatcttcttgccgccggaggtgtagtagccgtgggtgaggtggccgccggaggggagatccagccccatgatgcggtcgtgggggttgaggacggcggtgtaggcggcgaagttggccggggagccggagtagggctgcacattgacgccccaggattgggcgtcgaggtggaaggcctggagggcgcgtgagcggcagaggttttcgatctggtcgatgaattcgttgccgccgtagtagcggttgccgggcatgccctcggagtatttgttggtgagggcgctgccgagggcctcgatgactgcgaaggaggtgaagttctcggaggcgatgagctcaatgccgcggcattggcggtgcttctccttctcgatgaggtcgtggatctcgggatccaccgtcgccaagggcgtgttaccccacacgctcactggatccatgaatgttgaagatgaaatgagtgaagagagtgttgttgtgttggtctaagcctttgagctggaaggcgaatgtgagtgcccagtgcctatgtgtgcgtttttaaaagctttgcgaccgcctgtgaattgaccgttgtaccctgtgcttccggttggttaaattgtctccacttgttcgcctgctgctcgttacagacagagtagcttcttcctcttcctaaacttttgccgtgcctttttttagtaacttttttcccacttattacttaattgccttataatatttatattcatttatagtatgtttgaaaacatgcttcacaaccaataaatcacgtctttaatgtggaaaacgtaaaagcaaaaattacgaatatttatttttggtgtaaaaatttatgtcctagcttgttccaaacaggatattagagtgtcggttggacattagagactccaacgtgtgtcaatttcaaagcatgaagtacttgcttccacgtcattcacattttttaggtaaatttgcttgtagatgtgaataaaatcatgtcattattcgtaatgttctggtttttaatttaataacaacacatgaaacaacagagcagtttttaacaggacaagaacaaaacttattaatttatttataaggaaaaaaacagaaaagaacaccgatctcgaatagtgttattagtgggattctctttctgttgattaaaaagacaaacagtggctagtatttaaaaggtgtgctgcttgcactcacactcgtagatttagaagtctatctgttatcaaaccagtttagctttgattagctgatcaatcaagcatgggacgagttaaatttggaaaatgcttacattaaaatatatatcaaaggcttttcattcaaaaacaagcatcagcttcacttcttaaacttcaacataagttaaagcaagctaagaaatccaattgttcaacatttgactggaaacctgaaggcgatgccctcgtagcatatgtacattgtacgtcactgcaagatttggttttaggtttcattctcaattctgtgtaacgttggtagcaccgtggtaggtgggggcaatatagccaatttattcccaccaaaatcaccaaccctctctactgcactgatgcagacgctttccttccccgacaccttgcttcactaacatggggattgttaatttttaggtttctgaatatgactaggaactacgaaatattgtatttttcccccatccaataaattttgattgatgaaattgagcctcttaaataatactacaataggtctatgggattaattttgatttaacaatgaagtcaatgttcagcaggcatgcatattatgttgtgcatggtggctgattatcgcacgcgcagggggtaaattgacggatttgcattcaggaaagcctgcttagtttaagttcatggacataagtctttcatctcttgttaaatattttaatagtttatatcacaaaataatatataaaccaatgagtcaaaagtatactaattaatgtaaaattttgtcttttgtattacctatcataatacaacatattcagccaaaatcacatcacaacaacaacctcttgtgtcttcacccccataagtcaaaagatatttaattaagaacatcattagagataaaccagtggtaacttttactctgcaccctctaatgcacctttaacatgacttgatgtaacaagctttttatcctttaactttaattaatttagtttttatcttttattatatatatatatatatatatatatatatctttattattagcattttagttcacgtttccattttcacattttatacatgagctattttaaaatcctaccagcttctatcaaaacatttattattgtacactttacaggcataccagtttactaatattcaattcaatgtggtgaaattatttttaaaatgaagccttttaagccaccctactcagttctataatcatgagaaatctcgtagcatcgtcaagagatattgatatgttatcaataaaaaaataaattccaggatgaggaaaaaatctgcctaccaaaccacttgaacaaatgtacatttgtagattaagctgaaccactccaccaagtttgaattgccccaaactctaccaacatggccaagaaagtcgtaattcaaaatttctcatataaatgagatgcaactagttcactgactaggaagcattttagtttcttacttcataattccagaggttgatgtggtggttgacttaaatcgcccattggccattgtcaaagccatttgtaaagagtctttaaatcacgtatgttatttgcggttggcacgtcccaacttctaagtcctcaattacccacctgcagtttttaatttatgacttactttattatattcaataatgctctcataataattccgtgatatttttatttaattacaacgcaggacaaactgcatctacatctaggctatattaatattagcgtattaattgaggaaatacctaattttacgatctactcaagctatgccaaaaggttgttgatatactgtatttgttttaacttttaacattaatttggtcattgaattgttttacttcaataattacaaattagtaataatagttggaacggccatttgcatgtaaaaaagagagagagaagggcgagctatctgagttctatgatttgattttttttctctcttaaaaaatgtccctttttataaatagagaagccaaataaaaattaaataaatttctaacaataatttatacaattatcatagtaaaaagttgccaatatattttttgaagaaaaaatagtttgatgcatgtcgtcatcatgaagtaactattatgatcatttgaaaaaggtgatcacatctcagatagaggacacagaagcacatgatatttctttcttggatgcatgggtttttttttgttactggtcatattcttttaaattttaatatatgaacatgttcatgtttccagcagtactgtactttactttttaaaaagaattattaattattataattcgcaaatcttttagtcgtatattaattaatttcccgggatcgctcactcttttactaagaatgcgaatgtaatggaagggcactttttttctttttgttattttttattctcttttctttaaacaggaaccaaccgacacagttttttccaggtcttgacctgtacttgtgtggcaagctggtaacgcaaagctaatataaaaatgtccttaaaaaaagtaatataaaatggcttttaagatagttgaaaattaattaacaaagatattttttaactaattatgataatttcgtcattaaaaaaaattgaaatcccatttagaaataaagatacaaaagtgaagattaaacacattgattttttattggaatcaattttatttgagacgaacatgatttttatggatgaaaaaaactcttcataaatatcaaaacaatcgcattgttattacttgaattcaagattattggttaatctaaaataactctacatcagtttatttatccatacggtcaaaggtacaaggagatagtaagtgtaacattcaaatcgaatgacaccagaatgaaagggatgcaaaaattgtgcatgtatgagaatgtatgactgataataacttaaatgaattaattgatactacctctatcaacaagatacatatacttttcaatagttcattacttaagaacttcatagttaagtgtttgacttaaagtagttataagatgagtaatattttggaagcttccctgaaagcatatgagtgaggacaaaacatgctgaaaaatcttgtgttgatttgtgggatcagtcattgatcctgaaagcaggcagaatgatagtcaaagtctcgaaaatggctacctacagagagttctgattggtggaagattttgaccaacaaagatgttgaatgaagtgtcgtagtgtgagagccgccaagaaattgaaaatcaaagatattatagtacgcgtaagaggacgtcgaagagagaaagggagagacaagcaccctaaggctcataagcttcacaagcaccctccttagctcaacccaaccattaacgtttcttgagccatgcagctgatatctattaatataaaatgtcctcaaactagtcttgccatgtgtcccctcattattggttttaggggggacatgcacatgcgtatgtgatattgtcgattttatagcaagtatgaaggtgtataaatgcatcattgcaactaggaataaaaataggttaggtcaagctagactttgacaggtttgaacctagtctgtattattatcattaagtttaagtttgatttgttacatgttaaatataagttactaagacctaagtgtaacctgcataaaggtctgtcctagcctaaaaacctatatacaaaatctgattaaataaaaacaaataattaaaagtaaaaaataacataataaatatgtttctcttataagttataaattatcaaatataatcttataagttatagtttatatagacacattgttcagatttaattgatttttttgaaagcctatggcctaacctttttaattaaaaaggtttttaaaaagcttaaatttaaacattttaataaacaagttaggtcaaacaaaaccttaactagactagattgtagatccctgacaaactttctagtctatttcaattcctaatttacaactttttgatatgtcacgaaacgtaagtttcctgacatgagaccagatcctaatgatttagggaccatattaattgatagtatcatgttagtataaacataatcataagagatatttatatcatgaaaaccttctcactcgggtaaactagaagccaaccccctctgtcatgcctctcgcatcctcctttcaacacaaatatcactcaagtttgatgtacatagttggttggatgtaccaatgacaaatttaaagtatgtaaaattttaacaatttttttataaacaaaataaattagtctaagagtacctcgtatcaatgtatattttaattaaaatttgtaaacttaagtttaaattaaacttaaatttgtaaagtgtgtttgaaaaaatatcataagttttatttctttaaaacagtttttaaccaaattttactctaaaaacatattttccatgaatattttaatggaaaactaataatttccttagtaggtgaaaaagaatactatagaagatcaatgtgcagttgagttttataaaagctagggtgagtacagggcgagaccaacagttgcattttggtgcgattgcaacacgccgagtcgtgccaagattcggtaaaaatatcttctcaataattgtgattgtgcggtgccaatatttttggttaatggttggttccaaggccacatctaattaatctccataaccggggaccacagcttgattatttatgtatgctggtttttttcttttattttatcagaatgttttcagacatgcacattcactttccttgtgtcttccatttacgattcctagttttctttcattttcaaataatttacaagcaaatcaccgacgacagacaccgacacacgtatatatattcagggcgctggcggagggtgttgcttcagcttcactgatattatgatttggcaatccacaacgtagttaataggtcatacaccaatgaaaaatagcaattcagatacaactatggtgaccccatctcccttatactagtacattattaataccaagattttaggagttgactcttgcaatcatctttcatgcatcacatatattttttttttcgtattttaagtgattagtgattttaatataattatttgaattgtttgaacatgtctttttaatcgtaataaaagagatatatgaagttatttataataattgatttgtatttaaaataattcattattatggataaagtaagaaaataaagttaactaatatataataaattcgatcatttttaattataagattcaaaattttatttatataataaacaattgccataaaaatagttttcatcactttcataaatttttgcagcatactttttttcggagaaaaaggtgatgagattgataaagatgtaaatcatagaatcagggtagggtgactaaaatgatggaatacatttgaatttttgtgtgaccgcaaaattttccttaagttaaaaggaaaattctagagaacaactgtaagaccgacaatgttatatggagcgaagtgttgactagcacagtggcggacccaggatttttaatttatgttcacacaattattggtggggttcgggggcagcgctcccgaaaaaaaaattgtaaaaaaaatttaaatcaacattttatgcacaagattataaacccgttcaaaatatagtatgtgtaagatcaaagtatttgaaaataacaacccctaagtaataaaatgagccaaagatgaaagtcaaatacaattaccaacaatattgatagtttaatcacttgaagagtaaaaaatattgtcacaaactattaacaaagtaatttaggctatgcccaagatttctatatcatggagataaacagagcataaataatcaacttttgtatattgaactttacttcaagagaatgaatcagaagagatcctaatccctttatataagcttctactgcaatgagaataattggtacttgctagtaatacctaagctaaacacatatatcacaacttttatataaattcattcctgcttcttgctaatagaagtgtccatcctttgctaataatattttttgtaattaaaaataaaaacacaaaatgttttctcaaaccacactacccctaaagtgccattatcttatcttactctgggataagagctttaaacccactacccaagcaaacaaatctacacagcatgattcttaatttcgtaatccacaccccaccactcttgaatcacaacaattccacgagcatcctcttttccaaccacatatgcgtcaaatgtctgctcagtagaaaatattataaaaaaaatacaaaatatttgtgtctgcacgtgcggacaggaaaacaagtgtgggtctgccactggactagtacataggcaacatgagcacaaaatagggatagtagaaatgaggatgttaaggtgaatgtgtggttatacaaagatgagtaatataagaaatgaaaatattcgacaaaaggtaagtagttttgatgtatgaaaagatgatgagggaatatagattgagatagtttaggcacgttgtgagacgatcactatatgctcccgttagaacaaaagtttattaacaaaagttcgacacagagaaaggtaaaggtggattgaaactcacttggggaaatgttgttaaacaagatctaatagagtgtgatatagattagcgaacggtgtgtcttataacaaagtgaaaaaaaattataaatttggtggagggttaacccattagtatgtctatgttctagtcttcatttttaattcttttcacctttcttttattttagctttttttttttcttttgtcttatttttcctttttctttccatctctctttctcttttttgtctttttttcgatctattattggatttatctactactaatcctaattaatttagattaaaggtgatgttgatgttaatttttttccaagcagcttttatcttagtgagcaaatagttttatacaaatttgtataattttattataaaaattaattgataattttacaggaataacgtacgttataattactttttactaacatattcaattataaaacttatttatataattaactaattgttaaacctatattttgcacggggtgtttataaataataaaaatgtcattttttacaatattagttattatacaaaggatatcaaatgagaaaaaaaggtttttaacctaaccaataaaacaaaatttacactttattaattccattataaaatatttcaacaaggaaattaaaaatttatgataatagtctatctattgaaatgtaaagtttttatatttttattctgtcacaaataactatatataataaatttattaattttgacaataattatgttaaaagtcatacctatcatatttttaattagttaatacttaatagtataaaataattacactttttttatatgtgtaaaactttttatactgattgtgcataaaaattaactcaatttttcttttacttatgtgtcattttatattttacacatcattgaacatatgaacagaggataataataaaatttttaacaaataatttatctctatctaataaacattttgtaacatagattttgatacctattgctgctgctatgatatcctttaaatatttataatgtgaaataaatacattgaagattgaaatatagtatattgtgttttataattttagagaaacttggttgatataaaatatatacaagacaaaaataatgtcaaatgagttttaaaagactaaatgaataatttaaactaaaaaaaaaataaaaaattcaatggaatgtaacccatcatccagcgcaactggatgagtcacatacagtgccaaaagacatgggtactacaaatgctcactttagtggctatggaacaaatgaacaactatcagctcttcctttttccgttgtaggccaagagacaaagtttacaaattgattgaaatccctataatcattttctctactctctttcttttatttgtggccacagtcacacggtaaacattagattgaggaaataaaatctgtcaatgattaatgcttaatttatactaaatacagttaaacagcaagttagtaagatttacccgccttccccttccttcctacttgtctacggaaaattacctgactgagaggaaaatgaattgttgctaataaatcacgtatcacaagttctgctttaacaaatctcttttcatgtgtgctaacataccttacaaatctccaattatattatctacaaatactaatacatgaaaatttttagaaccttttgtaataaaatagattctatatacattagaggaatcaaactttgtccaacatatttaaaaaaatttacttatttactaaacgtgttaaactatattaaaaaataaattttcttattaattatttactaaatgatgcaaataacagggcacagggcaaaaaaaaaacagatctagtctacctcaccaactccctccccctccccctcccaaacccttatttatacacacactctcacattctttcttcacctcttcactctctttctctactctttctttcttcttccccggctcgtaaaccatggctttgttggtggagaaaaccacgagcgggcgcgaatacaaggtcaaggacctttcccaggccgacttcggccgcctcgagatcgagctggccgaggtcgagatgccgggcctcatggcttgccggactgagttcggcccatctcagcccttcaagggggcccgcatcacgggctccctccacatgaccatccagaccgccgtcctcatcgagaccctcaccgccctcggcgccgaggtccgctggtgctcctgcaacatcttctccacccaggaccacgccgctgccgccatcgcccgcgacagcgccgccgtcttcgcctggaagggtgagaccctccaggagtactggtggtgcaccgagcgcgccctcgactggggccccggcggcggccccgacctcatcgtcgacgacggcggcgacgccaccctcctcatccacgagggcgtcaaggccgaggagctctatgagaagaccggggaactccccgaccctaactccactgacaacgctgagttccagatcgtgcttaccatcatcagagatgggttgaagaccgatcccaccaggtaccgcaagatgaaggggcgtctcgttggggtttctgaggaaaccactactggtgttaagaggctctatcagatgcaggcgaatgggactcttctcttccctgctattaatgtcaatgactctgtcaccaagagcaaggtaatgtctcttcttttcccagatctggtgctttttatgtgtttaaatgtagggttgagttcagatctgttgttcttggatgggttttgtggcattggtgatatgaggttttgaatctgttaactgtttgactaatgccgtctgagaagtctggatcggtattaggtgttattttagtgtgttgaaacttgaaacgtcagaacgttagtaagtagcttactaattagactctagggcaatgatcacatgtttgattccgcaaaataaggatttattccgagtaaacattttttatttgaagctacattagataacttttgaattttactactgattttgatttaggattagaaaaacattcaaacataaagcatgtcgtttcaaaattaattttgcaaacatggatccaaactgagtttttcgtgatgagttgtttatggattagggtcttgaaaccaataagtgggtcattgggttttgtggatctagtggattatgaattgattttgctttattgctcgtgttattttttattaaccttttgatctgtggttgtgacagtttgacaacttgtacgggtgccgtcactctctccctgatggtctgatgagggctactgatgtgatgattgctggaaaggtggctgttgtggctggatatggtgatgttggcaagggttgtgctgctgcattgaagcaggctggtgctcgtgtcatcgtgactgagattgatcccatttgtgcccttcaggctctcatggaaggccttcaggttctgaccttggaggacgttgtttctgaggctgatatctttgtcaccaccaccggtaacaaggacatcatcatggttgaccacatgaggaaaatgaagaacaatgccattgtttgcaacattggtcactttgacaatgagatcgacatgctggggctggagaactaccccggtgtgaagcgcatcaccatcaagccccaaaccgacagatgggtcttccctgagaccaactccggcatcattgtcttggccgagggtcgtttgatgaacttgggatgcgccacaggacaccccagttttgtgatgtcctgctccttcaccaaccaggtcattgctcagcttgagttgtggaaggagaagagtactggcaagtacgagaagaaggtttacgttttgcccaaacaccttgatgagaaggtggctgcacttcaccttggcaaacttggagctaagcttaccaagcttagccaggcccaggctgattacatcagtgtgcctgttgagggtccatacaagcctgctcactacaggtactaagtgattgagatgatcaacggaaagtgagggaaagacaaaatcggttttataaatcggattgattgcttaattttccttttttttgaatttttggtgttagactttcagatttgaggtagaagaattttagcttcttttttctttttttaatttccgtagaatttgtgttcgagtgggtgggacgggtaaggaggaagacatcctgttggtttctgtgatatgaaaccaatttggattgaataaggattgttttgtctgggggatgtgtgcattttgctttattaaatactaaaatgtgtttctgtccaccatttcaatatatcaaaattaatcaagagagaaaaaaattcctaccatgtatccagtttcataacacattgacacatcgtgtattatttggtgcttctgcattatttttttaagaaaggctatcagggtaattaagtaattttattatgtaaactcttttttttatggaagttcattcgagtttttctctttttttatttgaaaaaataatgatagcactggatttgcatcgtttatattacgagttcctattttctttgcatatttttagagccttataagttccaattaattcgattttagctatatggtgaattaacttaaggggtaaagctctctcataagtcataagtagaatcaagcttaagggaaatcaagttctttgttaattgaatttacacagattggtgagttagaattcaattttctcaattgttaatttgatttgatgggtgtttacactgtcgtttaaaacctacagttttaccttaataacaaaaatggcttaaaaaatcaaacattttaaaactagtcaagggaaaaattgataaatattaatatctttaactagtcaattgttcattctcaaaatcaagagagattcctttatattactatcaaactgataataacgtaggataataacaaaggtccaaataacctatgatatcgtttgctttgatttctttagtttttgttacaatgataaaaacaaatttagacctcgcccaaattataaaaaatctgatttgttttcatgggtgcttagaaaaagaaagaaaaaagacaaagcatctttagtggtagatctcaaattaggatcttagatcatttttcggtaaattttatagtgtcacgtaggattgaagatctttcaagattcctcctattttgttctttaatggtagatttcattttgaaatcttagagaacgagaaagagaaaaaaaaattattcttttttgaataatatatatatcttaaaggtttttatataagaactcattttttcatgttggagatctctttatcttttttattgaaaaatttaataaaaataagattttgaacttaaaatctttaatcaagattttacattaaagttgttctggaataaaaaattccctacctattctgcaaaatgactctaaattttaggcagtaatccaatttaggctcagagaattcttgtttcacatcaatttttgcaagattccgtgttagatggttctctgtttttacgtgaaaaaaatgagtccaacagcttctcagtgacgcattgaagaatttgaatttgaatatcctaacgtaacgtcttggatgctgttggtaaagagtggtaaaaaaaaaaatttctttgctagaacataggcgctctcgttgtgtcaactattattactgtgtcacccctcttcgatgctagtcttgcattgccattaattacagtaaatttaactacctgtcaaagtcagattcaatacaacccttgtctgtgccataagggcctgaacttctcaatattggtctggaaaaggaccagaggccaattacacaatttgcaattttgcatgtccgatacgccaattgtatttttatacgcagcctcaaagttcaggagtcaaagtatggggggtttgaagacaggaataacaaaaaaaccaagtatattgagagtggtagtaaaggttgattgagagtaacaagtcacaagcgactattgagatattgctaaaaacgtcataaacaaataaaaaaattaacggttcatttgtcaatacacaatactctaaatttgtttaaagtttcactatgttttttttttaacttaaatatgtttttagattatcttatttttaatcctccaaatttgaagatactttctttagtttctggaattcatataatatttttttaaatcattctttactgtattaactaaacgtaaaataagatattcataatttatgaaatttttttacaattagaattgattttctactttatatgtataattttttggcaattaaaaattatcatcatcaagtcaataaaaaaaataaaaaaacccattaattattttaaaatttgctttaaattttttcattgatttaattttaatagttttaaactatcataaattttattttaaaatataaaatagaaaattattttttgagtgtaaaaaattgtccttattctccattggatcacactggtaaaaagagcattactcgactttcaaaaacaaaaaaaaaaactttaaatttaaagaactaaaaatgaaatgatccaaaattgaaaaattaaaaacatatttaaatctgttttcactaatacttttattaagaatcttgaataagctaatgtgaggtgtgaaaataagcatgaagaacatggatattaataatgatttgctatacaatgaaaagacaaaaacagacacacacaaaggaatgagaagtggatctagaaaagtaaaaaagggtcgtatcttgcttagtcctcaatcctcaataaataataacagaaaggacaaaacatagtaggttatcaatcccattactatacaagtcccctatttggtgggttgcgtgttcgacaaatcttaaaactacgatctcagttcccttctgtcgaaggagtggcctcacataaataatctttgtgtagtattaataaataataaatttatgcgaaagtgatgttgttatggcattattttagttcaagacagaaaacatgaaatgtggagtatctgacatttggctcgctctaattattgtttgagatagtgtttttcatggaatcatcattcagttggattcacatgatgcctttagttaaggaaatataacgcatgacactcaatcactatggagaagcactaagcaagttgtttgtatcatatcatatcctatgggagcgtaagcaaccaatagaaaatttatattttagtttaggcattaaatttgcaagtttgttaaatatcatttcacggacaggagtttcaaatactagctcatctcatcttgtggtaggtttggttggattataataatttcaaatacttgattcattttatattattttatatttttttcttctaaatcttaaactcataagttttttagggatttaacattcaataaccaaaaattactttaagattcaattaatctttacgcaagcacgaaacattttacgtggaatttttttctcatgtttattatttttcgttcacaacattcaaacttagaactctatataagtaaatcaattattttacaacttgaaagagacgttagtttaaagaaatttatcgtgtaagtgattttttttttttttcttaacctgaatcaattttgaataacattttttttactactttttactacaataggaagaaagagtagaacttattcgggtaataaaacatcaccaagtaactacattaaaactatataaaagagctagtttgtgataaggaaaatattgttagaagatcttgaaagattaccagtacataaatttatggatatttattcgtgtgcttgggtttcataattttataaatttatttagcctttaaatacaagtttaaatacgttacacttttataatcaccgtggaatctgaaggctaaatcatcacttacatcattagagaggaatatatagtaccctcttctagggaatttattagctttgattgtaaagaaaagagaaaattcgaaaataccaattgttagatgctgaaaagtcacaaaggtttagactctaggctttttagaggtttccggcccataaaggtgaatgttttcaaactgggcttctcaataataggagacttactattattttcagaatcaaagttttacaaaagtaatgtaaatacaaaatgatgactaattgagatattcaactaaatacaaatacttgattattttataaattcatatattgcttatagaataaaattaaaaatttcatagtaagttagaaactattgtttagcaaaaattatattttcaaaattaaactataaaaataattaataataacattaaagttcacaccaaaaacattaaaattacatattatactaaaaaatacaatttagttcctaagtcttagttttaagatttttcaattgaattttacgcattatttgaattaaaatgtatagtaatatagtatttatttaaaaatatgtataagtaaaataaatttgaaaaaagtgtgctgggattttctgatcttgacggagatggaattggaattttttttttattctttcctctattaaacatttaaacctgactccaaactaattcctaaaccgcctttttaccatccctacttaaataccatcatgttttatctgtcatcttaggcccaaaagctttcattccaaaagcctcacagccctttgccttgcctgccgaagcagtgaaacatttgatagatagtagccagtgtagaaaatagtttatcacctcattacctgtcagaggagcactggcttatagatagtagcaatagatttgtatcaattaagataagttttgaaatatcacaaattttacttaagggtttatataacatgaacaaaaaaagattatttgcctgtcattcaactacttaaaatgctgtgtcacagaaagggaaatttatgtttcttgtagggaatagaccaaaggtaactcttataatagaaaagagtgcttatttatatatatatatattaaatgtaaattcagataggaaaagtgaattagttaatgcagatgtgatcacattttccaatataaatgatagaataaaaatcttcatttaattaaataaaaatgacaaaaaagaaatgagtaaagagatgaaaataacttatttcccctctctttatttgattgtttctttgcaggcgattttattttaacaactatgatttatcttctttttggtggttgttgaaaaagaatgaggtggggtgggtaggtaaactgggtcctctttccatactaacactataaaagatgagggccacaagtgctcgagtatggagtgtggatcccctaggggcaccaatgcataaatgctcacttggatagttgttgttgttgttgaaagtggcctaccattacctataggctatagcatagcatgcttggatatatctagtgttaataaaacatcaacattgccatcacaggccattttgtcaagcttcacaaatctccagccaagcatagctcagttttttgagtttgacattggcatttggcacatggctagtggctattgactaactttgcaatgtgaaggctttgccaagagaaacataactgaaaccatgtggtctaattagtgctagtaatctcttgttaattattatatctgatctgttgctaattcaattatttttcctgtgcttatcttccattagtgcaatgcagcacacaatgaaacattttagcatatgccaacccgggttgttgtcccaagtgcttcattgttcatttgttcagcacatttcactatcatattatgatattattcctaaccaactccccccttcccacgcacatcattactataataccatagtatcacaggaaatatcttcatgcaaatacaactctgtctttgtgattgctatggaggataagaacacattatatgcgatacgttagttccatgccatgaagatttcataatctttttgtgaatagaagtagagaagttgctcctaaactagtattttaccatagctttcagctacgagaatactttgttttcgacaaaaaaaagaaaagacttagatcttatgcaaactatccaaatcccccacactaagccgatcctaaggaatttgacgagatcccataaacttattaagagaataaccaaacataaggaagagagagttcataaaaagtgaataattcctagaacttgctgaaaatggctcccacttttgaactttgacacgagaaactattatttctggcagacttttactaacataaaatggaaactacgttcctcttttcataactaatctaagaataagatcgttggagaatgtgttactagcactcttttctatggaaactatgtgtttaaaaactaagatgagatttgttttaaactcggtttgcattttgtatttttcttcttcttatttcctattttctccataccaaatgtgaagaaatcagcttcttttccctgaaatctcgctatagccacgaaggtgcagaaggggattggactcgatgtgaggagcctcattttaaataaaatttagacccattacatattaaataagatacgaatgctcaggttgattgctctgtatgaataatttcctgttaaattttgcaacttgaaaagaagcttgggagaaccacaccataaaaactaaccactatgggtagagtcaagactttataaaccccacactagattccatctttccaatgtgggactgaagtcccacaccttgcaattgataactaaactctacaataaatagattttgtaacagataggcatcaaaatcgcaaagagtatgtcaagttgcagtggtatgttctcaagaacaaaagttagatattttcataattaagctagtcataccatatgttacaaggaaagaactaaataaaaagcatttgaaaagtataaaaacaatgaccataataactacacaggaaagctcataaatgacacaaacaagattagatggaaaaggaaattaagaataataacatacatgatacagccacttgggacactttcctagcttccttcatccattcaatggaccataactgtatcaagttttgatgccttgaacacctcttgcacatccagtaatgacctcacagcccctattataaggatttgctggtcttgcatgacaattgtagtaagaagctcctgctctatcacatggaaccatgtccctcttgagtgtctcatagctaatgtactttatgtgctgaacaccttccagaactctcctgttgctctctgagtccatttctggctctgccaagcactctccaatgcttttggtgcaaacccttttggtcataacggcagtttcactcaaattgaggtccacaactaataggccattgcagattgggagaagggtgtgaagcagaagaacaagtgccaaacatgggaaagtcatgacaatgaatctgggttgggacactgttctgtgttgttttcagtttgttgttaaggttgtgaaagtgaatgtgagagccttagtgggtggatagtcataaattggagactgtgtgtacaactatctctccagttttcgtgcaaaaggtaaaataaaaaatgaaaattgtttttagaagtgaataaataaaactatatttatctttaaatttaaatatgttaagactactatatataggagtatttcaaattaaataaataataaggaatttatttctcaatccccttttaaaaatttttattgcacaaagtttacgattagacaaccagttaattatgttaaaggtatcatgcgatgaaataaatatataagtggagaagtagggtggaattatattcttttcgacacatcctttaatatatttattattattaagaaatttttatgtaagtttcattagatgacttgggttcatattttatttagtaaaattgccatgaaaagacaaacgtgataggaaatgagaagttaaaaagtaaattgaaacaaaaaaaaaagttacaggattaaatcaaaaccaataataatgtacatatgaagcgtaaatattaaattttcctcaagtatatatgtataaagcgtataaattgtatttatgtctaaagtagaccaacaataatgtgcttgcttctgatttaatttaaaacaggttgtgttttcaaccaaagaaattctaatataaatgactaagtgaaattataaggttaatttaatgataaagagaaaaaaggagggagagagagatcctggaattgatttttcttttaataaaaactaataatcaacaactaatatttatggatagaaaaaatctttcaaatacaaattcactttgaaagattcttagatcgataaaaaaataaaaaataaaataaaatgaatttgataatgaaaatgagtttgatgaaaattaaatgtgttctattttagagaagaacaatgtctagctggataattagtgagttatttttggatcaataactcttgaggtatatatggaagaaatatcctgaaatggagatgacattgaacgtattttttatttgtaagggtgttacctttagatccatcgttgattgttttgtcatttttatccctaacaattaacaactaatatttatgaatagaaaaaaaacttcaaatacaaattcactttaaaagattcttggatcgataaaaaaataaaaatgaatctgataattaaaacgagtttgatgatgattgaatacattgttaaatatgataaatatgatgatacatattcttaaataatgaaagtaatgatgaaaagtaatgctacggctaattttgccattattttttatttttctgctaaacggcttctaatctcgtcgtacatattaatttgacaaacaagaaattatcgatcattcatgtattatattgtattaatcacgttaatctttgattttacaaattcttcactttagtctccaattttgtaaaaatcattcatttcagatattttccactatcaatttatacagaataagattaaagtgaatatcattttataaaatctaaaactaaaaatgaaatttttgtgaaattagagagtaaactgactgacaattacaatttcaaaaactaaaagtagggttactcagaaatagacacatttctagtttagagtgtatttggtaatttctaaaattcaaataagtaggtaaaatggaataagttttaaaatcacgagtgaatcatgtgacccacggtgaaattttagctaggggagatttggcttcttaaaatattcaaccagcaaaagttatgaaactaacatgatttgaagacaacatatgattcctgcaagcgagaagataaaccgttgtaattcgtgcggtgtatgtagcgagagaaaatatcgttgtcaatgtgcgttctgaacaaatgttttcatgctgtgttagatggaattccatcatgtaatggaaagtaaagctgatctattcagcaaatacttactgcacagctctctacgcaaacatgaagaaaaactccataatcaagactttttaagtttatagtaatacgtttgaaagccaaacagaacttgaatatttacaacactgtcaaccagttaattaacattgtatccatcagtcccccaaagctgctaaggattttggatttttcccaagataaatcaggcagtaagccagaataactcaaagtgtgagttgatccatgttcttaatgtttctagagattccatgagctgaccgcccttcatcttgttcatcatacgggtttgctcggtagttggatattgcctcttcattgtcagaacagcctggcctttcggtaagaaactgttcccagaaaacatcattcaccctgtctggaggagctgggttaacttggttgttacttggatcctcctgggatgaagctaaattggcctcagcagctacatttaggtttgaggaaacaccactatcagattctttaccattggcaaaaaatcttgattctgccaattttccaatttcttggcagtcaatttggggtgatctggccgagtatgaatttctgttgacttgcaatggacaagatgccagagttaagtttagttggcaggataaactatcaccttcttcactacttggctccaaagagatcagttttgagctctcagcagttgttgctcttcgcgataaacatgaatccatcttaaaagtaaaagaagccccagtatctgcaagctctaatgtttcaggtgcaaatgtaagagctgttcttgtctgcactccttttggttctacttcagacagctttttctgtgggctttccccatcttcatttgaactctgtgtgctacgtgataccaagttcatatctgaaacagcgggtgacaactccagtctaagtttattcgagaaatcttgatggaaaaaatttccaaattccattctaaaattgctatgactgtccaccaagctactttcggcaactggttgcacgtgatcaacctgaggcaatcgccttttcttatatgcagataaatccatggactcgattttgcgtgaaagatgttcaacaaaagtaggattctgaagagccttctcaaagaagttcagcaattgtttctgcctcttctcaataccatctaatcgctgcagaaaatcttctagcttaggctttgctgttgactgatgttgtttgaagttataaatattggattcaagagaagttttctcacgggaaagtttgtctatttcttcctcaaatgctgccctttctggatctacaagagaacctggaggatgactatgactgtggataggtttcctgcgatgtatattcttaagaagatgcttctgatctttcagaaactcatcattagcaaattcccatcgctctggatgtatttttcgaaatccctgataatagagcaatatcaatagaccaaaacaaataaaaccaaataatggttttattaaatgctcgaaaatatgtattaagaaaaagaaaaaaaatgatcacaaacaataatttttttttcaagcaacaagaactacaattttctttgaataatttaccattaaatccttacaggtatatactctttacaagaaagaaacccaccctctggaaagtaaaagtaggcagtgtttgagttgtgggaaagtaatattaaagaactgaaattatggtctgggtttatagtaaatggaaaaattttgaggactaaagttccaaggcaacccatgaataaaaaaaaaaccagtaacacaaaagtactaatagcctcacaggctcacacaaatagggatctaggaaataggaagcaattctagcaagagaaagcaacaaactttctagagtttgattgcactcaaagttgaaattaattactgtctgtaatagtacagagctatagaatatgcatgggtgatgggtctcaaaatgcaacctgaatgggcctacacagtaatcatagccaacaacatttcccaaagacagaaaattaaagcccaaatatccttttatgactcaatatccataaaagaaactaaggcattagcatttaaatacaagcacaaaaatagcacctatcaagaaacaagtaatcagtacctctgtggtggcatgagctttgatgacaatcttggtttatagcaagggttggggagctcaaataaggtacatgagagaagtattgggtgatttaaaagaaaatgaactagttgcaaataaaaataaatgtcaatttgggagaaaatttgttgagtatcttgggcatattatctcaaggaaaacggttcctagttggctacagacacaaaaatgatcaagagtgttagaatggcctatatcaagaattctaaaggggcttcaagggttcttgggtttaacaagaaattaccaaattttgtaaaaggataatggcaagatggccaaacctttaactgatttgaccaagaaataaggttatcatgaagtttgaaagatgtgacaataacagccccaatattaaggtgacaacatttttcaaaggaatttgtgattgagtgtgatgcctttcgggagggtcctagggttagtgaatagtgacaaaacccatccaaacctgcttacgagaaggaactaataggtttggctttagttatctaacattggcagccttaccttttggggagtcattttttggtctattaaaaccaaagaagtctaaaagaattgttacagtagtgagtaacaaccccagatcagcagcgttgttggtcagtcaaaatgttaaggtaccagtttaagatgagatacaaactggttatgagaatacaaaaatataacggttacaaagtaaccatgtctactggagctcttttcctttcctttgttagtaattatatcttcactttcaaattcagttcattttaatatcagatcagcacaaaaagatcattataacacctatttcaaccaagaagttaaggaaaatgtattataaaatcgagcatttttatcaattgatcaaataaagtgccagggaatatgtgctttggactgaaaataaagaactgtgagtgtaaaccatcaagtgcataaacactcaacagttcaatagcacagcccaagaagagtatttacttattattaggcatctattttgtgttaagacctactaatagacatatgcacctccatcagccatcttttttctggataaagaaaaacatttatagtggaggaagaaagtttaaaggtaaagtaacaaatcctattcatgaaaacaaccgaaaatgctctagcatgaatttttcatcaagtttggtaattttatcatacaatattctccagtgctcctagaattcccaatggtttccaaaacacaacattaaaaagtaccactctgcgaaacgacaatataagaaaattgccaaattgtcatgctaatgtctaatgacacctgaaacttaggtggtattaaattcgcttttggagaaccaagggaaaagcatatataagtttttagaaactgctttatactttttactattagacgttgactggtattaaacacataagaagaatccaaaaaagacagaaagagaaattattgagatctaatgatctatattgacatttgttatagataccaaccactatttctaagataggtcaagtattaatgtacaacaaccctcgctagcagcctactaagattgctaacattgtaagactcataaaaactaagaatcttaatattctaattctgataattattcaacatgcatcccttgtcaataatagaatagcagaaaccaggattaaaaactttggaacacatttggtgatttggtaattcatgagtacgtgatatatatcaaggggttgcagaagatcgataaaccttctctgatgaatgctaagtcctatactaccagattcttattaccttctgctgagtgcctaaattttctggtacttgagcaaggaataccacaaggcacagcataagattattctgatcaccttcctcaatgacttctgaatcctatatcccaattcacattccaaaaaaagaaacctatgtttcaaccttgtcaatatctttaactttaagtaacatatatcttcagatagactctatgagatccattgaaggtctctctatctcactatgcattctctccatctcacatcatcatcattaacatttcaattcagctcagtgctaatatccaacaacaacaattacaaaaaaatagtaaaatccggcgatcatttcaagacatgcaaacaactaaatgaaagacagaaatccgaagaacgaattagaatcgaataaaaacgaagggagcgcatgaaccgaagcgaaacaaaggaatcgaagaaacgtacgtaggtattgagctggcggatgaagctggagaagttgttgtgcttgaaataggtcgggagaaggaggcgagcgaactcgggagggttccagacaacgaagctgttgttggtagagctccacgaaacgatgtcgttggtggaggcatcgtccaccatgtcgtaggtcttcagaaggaacggcgccggacctccggcaccggcggattgtggcgcaccgtccatttaggaatggatctttctagaacctctgagagagagaaagagagatcatgggtaaaggaagaaaaccaggaatttgcaactacgctgacgctatgcagtttagagagagaaagcgagaaagagcggttttgtttgacttcaacgccgtctctaccgtagcctgctgcaggttgttgggggattgctacccaccttggaatattggaaaatatatttttgtttttctttttaatttcttctctctcttatgtattactatcatatagactctttcaaactcactatattagagatactcaaatatttaagaaaattttacatataataaaagtaaatattttttaaaaaataaatcattctcacatataaatataataaaattttacttatttgcgtcaattatttggctttaatatattgatatgataaattcaagtacgacgaattaggagtgcaaaaatatcactaattttgaagagaaagcaagaaaatttaatttttcatagcattttgaggattttcaaaaaaaaattctttaacatactcagttttattatttattaaaaattataaaagatatttattaaattaattatgtgacctataagatttcaatttttttaataaattttaacatatagaagaaagtatgttcaatataatgtgttgataatatttttcttaaacttaaccttgatttaaataatgtttagttgatttttatatgaaatttataaatatataaactaaatatctcattttacttgaacgtttttgttctgaattatattttattttcattttgatggtctaaagttaattattcgttctctctcttttttttctttttttttaatactttgttcaactactaacgatagaagaagagaaacggtggtgaaatgatagtgttgacatggtgttaggcgaagttgaaaatcaagcaaaacatctattcatcataccaatgacatgcaagaggaggaaatatcagcatagcatcactatcgtagaagaataatcagagtttttttttttacttttccaaaaacattttgcatactctagatggttttattctgactaaattatgtctacatacttctcatcgtatcttctgcacataaggatgaagaaattgagagagttcaatctacatggaatctttttgcttcctcccagtcttgacaaacagtctttattttgaatattgccttctatacttatgtatcatccttatctctgaaatttacaggtgaagacgacaaaattttcttgcattttatacagtattttgtaagatccaatggaattacttttcttgatacatgtatttctttttcattgtatttttttatagtcttatttttccatgttacttttttatgtggttttttataggtggataagagaagaaaaattaacgagttgtatatatttattaaaattaaaaaaatagatagtatttgttaaatcattgatccaaactgatcaatccattttttattgaatgattcaatacaaatagactcgattcaaagatctaatatgtaataatttgatacaataaaaatgcagacagataaacaaaacaacgcttatgttttcattagtaatatataatgacattaaatgtttagttgcaaataactgttttggatgttttaagattttttagaagtgagtttaatttaattgcaaataactgttttacaaatagtttctttacaacatttgctcctctaactaattgttccctcttttgagtgtgatttctatgttatatattgctatgtttagagcatatcaataatatactatattaaataagttgctagtaattagatgtttgaatgtataaatatatgtgttgagtcaataatttgtatgtcttctttttaacctatttatctatctatatatatatatatgttaagaattaatgttttaagatattgaaaagatcaatatttaattacttcacttcaaaaacttagtatgcaacatttgtaaatcataaactatccataaaaagatataataattatttaaaattttataagtcttaaaaaattcttattaatatagtatttaatactttttcacaccataagaagggataaaaatacattttagttttagttattcaaaagtttttattccttataagtttgttatataaaataatgagtaacttatacattgtacaaactaaaatactagttatatgtatgttattattttcaaaataaatcttaatttattttaaattctatgaaatactatttttttaaattttaagtaaattaaaatatttgtatatattaatttgatttattaaaaatacatgttaaagtgatttaatttatataattaaataattatatttatctcgtatatctgtaggattttaaaaaatatgatattttcctcattttcaaaaattttttcaaaataaaaaataaaaatattttcatgagacacgaaaattatgtttaagtctttaaattttcattcatcgtcttacacacgtggggattatttcagtagcgtgaaacttccagaataactctaaatcagttctcttcagcctgcgctctttcgcttcttgaaaatctttctgaggtatgttctttcttccttttcaaatatttcaagtttactcctttgattttcgttttatcttattatttgttttctctctacctatcttcagaatcgagtcacagagtagagcgaaatcggcatagtggtcgcatcattggttttttgccctaattttatttatatggttgaatgttgcagcttagggttttcttcaaaattagtttcacgtatttgatgtgaaattcaatcaaatttggtttaggagtgttcctatctacattttcatgaataactatagcctgaccagtgaattaagccattcgttttgtttttcacagtttgtgaattgtgactgagtttctcttcccctcgttcatggcttcgtgccctagcctcgcaatgttatttatatggttgaatgctgtggcttagggttttcttcaaaattaatttcaccttttttatgtgaaatttcaaccaagtcaaggcatagagtgttctgttttgctgagttatccgatatctgcatcaatagcgcactatagcagtgcaaagcggccactgtaaagttttgaatagcggtgtagtggctgcaatcacggccaaaatagtggctctagcggtgataagtggcgctagattgaggcttctttctaaacccatttttgcccacaaaacagcatagtttttcggttaagggtgtgttcttagtgcacagttgagatttgcctccccttctttagaatttaaaaatccctaattggatatagtttctctcgcttttatctaccgtgtgacactcactatttgactaacttcggtgcatctctggcagtatttctgccaacactcaccttccatatttttctcctttgaactctgaacttctgttcttttatctgtgcaacacccaccctcactttttattgaatgtttaagatgccttgtatttgaaatatgaacgtgcctttcaattttgtttgtttccttgacttgtattgtatgttttgcttaaaacctataaccttttattattaatgaatatatcatgaatgttgaatgtttgtcatttaaactttgagcgttaaatgtatattgtacagataaattatttaatctatatataaaaattcagaatattgcccatctcactatgataaccatgcttacttgataacatgtaccaaataatatgtaccattatattgcttgggagaatgtatggaaattgagtctttgatgccacgtattccttgaacagatacaaaaatgccgaaagtaaagacaaatcgtgttaaatacccagagggctgggaattaattgagcctacactccgtgaacttcaagcaaagatgagggaaggttggaattttacatcatgtgcttagtagattttattacgttcttgctgaaatccatgaaattaatagttttatatcctttatgtggcagctgagaatgatccacatgatggcaaaagaaaatgcgagacattatggcctatatttaagattgcacaccagaagagccgctacatatttgacctctaccatcggaggaaggaaatttctaaagaactgtatgaattctgtttagatcaaggatatgcggaccgcaatctaattgcaaaatggaagaaggtatctaaaattagttattttattctatttttgaaaccggtgttgtttttccatttcttttaacataggaggaagttctcaaaaaatctgctagttaccaaaaaataaaagaaattctccaaaacaaataagactaattcaataaaatgagccaaaagctgcgtgaaaggtctattgtgaatttgcaacaaatcatttgcattaatcatgttaagtaccactggcctaacaaaggacatggcttttgaagacaggtttgaattttaaaatggatttatcaagtagaaactaggttagggtgtgtatgaaattgaaagaaagctctgcaggagaaaatactgaaagagtccatgatccaaactcttctatctaacttagttgagggagaaagagactcaagtaaaaagtttaaaaccaaaagggattgtagttcactatatcacccatattcaaatctcttaagtaaattaaagtccctatgtaaataatgatcttggattcttagccttaattagaaatggctaatgagcaaagtagatagttgaaacatgcaggaaaagtctctgaaataggagcactccccatctcaacttcctctcaaaacttgacaaggataccattataccataccatcacccaaacattagtagtgtattcctggaaaataatcttccaattccaaaatctaatatgagcagtgttgcttacttggtcagcatcccacctgttctggtgggggttgtacttgctcttatatgcttggtgagttgttgactcttttggcattagtctccaaaggaaagtgccaaagtcatttaacctctgaaagcaatgtttgtgtgttaatatgccaaattatgaacccctaaccccccttcattttaggcctatgacaaacctcccaagtcccaaaaagaatgttctcttctctgtttacccacagctgatcaatgttttgtgtctttgggtcaatctgagctcacattgtctgtctgatattgagtactggtgaatttagaaagtatgttatttctgtactcatttgtgccttctccgagatgttaattgttgtaaggttattgttacttggtagctaaaaacgttaaagaaataggtattgttttactgtcactaagattttatttgatttgtgcattctgtgttttcttggattttgagtacttaaatcattatgtttttggtctgaattgcagcctggttatgaacgtctttgctgcctgaggtgcatgcagccacgtgatcacaattttgccaccacttgtgtttgcagagttcccaagcaacttagggaggagaaggtcatagagtgtgttcactgcggatgcaagggttgtgcaagtggggactgattgaataccgattctagttttagttgccaatggagggtttcttagaattactttctttgtgcttttagctttctgttgtccgaaatcctcaccatgggacaccacttctccgggttgtattactgtactaaatgatatttatattgggaatattggtttcatattagtcatctgcctagttcaaaatctgactggagctttgtacctttacattgattagcctaatatggtgtacttttgcttgatactttacagcttaaacaatgggcttaaaatactcgaaggttagtgtaaatttttaaagctgctttggttaagattggagtcaagctaaatattgtaaaagttattttttatttaaagaaatcaattttgtgagggaaagattgtaaaaggcaaagcattattatgagataaatacatttttgtgtcatccatctcccagtcaattcatttgatgagtaaatcttgaaatacacaaaatgaaaataactggtgatatctagtctaactagttgagagtaaatactatggacggtgttgtttccttgaataattttagtagtggtgtaagttcttgtaatcgtgttgaacgtttgttttgttaaacataaaagtttggagggttgtttcaacttaagattaataatttgcttattttgcagtcaatttatttagcagttcttgaaaacaatttttaaaaaaattctctttcagaatgtgatttaacgtagatgtttatttcaaagtgtaattaattatattttgaagaatattcttgaaaacattctgatgaaaaatgtgattaccgagtaaactaaaaatgtaattagtatagtatttaaaagtggatcaaatggggggaaatttcctctgaagtgctggaaaagagctgaacccatcaaatggaggatagttcaattaaaaggagcagggggacaaaagaaaatattaggggaacccattaaaaaaggctacgctctatattgttttactgaaaataaggatattgctagagccctacagtgtaattgatccatgtagacaatttcaccgaatagagtaagggtgtgttcggtagagtggaaaaaaaaagtaaattaaaattaaaattttgaattaaagtaagatttaaaagtgtgaatttcatcatttattttctttttcgttctttatttcctcaaatggacgggcctaggagttggttgttttacaaaaaccattaccccacacatattgtattggtcactaagaatcagtcacatggaggcaggggacaataggatataaccaaaacatcaatataaggcagctcatttatcatatatgtctatcatgatttgtgtgcagtattatgttaatctcaatgctgattaaatgcatagcatacactttttcaacagacaacgtgatgcataaccaatgcgtacgcaaacatatccacaacacaattcatattaaaagaaatcaagtgtctgtgcagacacgtgtatcagtacagtaaatgtacctagtatgggtacaccaaccatgcaggagtgcccatgtaccttacccaacatctgcttagatgtttcaatagatatcattataaccaagtcataatattaagcattttgatgcatatcaagttgagaatggaaagtgctttttgattgccaaatcatttgccaaaaacaattttgtcgtccaaatatacctctaattttgaggcactaatgttccagtcgaatagatccatccacatataatctatggcaagtggcaactaataaaatgttcagaaaacaagattaaaagctgaaaaaatgtttcacaaaaccagatattgttgaaatctcatttaaatgataaaccactaaaaccagtgtcatctcactgtcaaggactactgttccttggcacatttgaaccatttttagctttacattggagcaaaatatgaagcattaggcacaaggctgcaacccaataaaatttacaaattacccctcacttaatatgagaagtgcccaacatattgaatattttggttatagacaaaagaacgacatgacagaactttcaagaagacatgatcacaacttcattctatcactaaaccatttggcagaatcagcatttacatctcaaaacccagtaaccaatctaatgagcatcattgcttgatgagcaaaccatctagtcgcccccataaaacattcaactgagagtttttgtcttacctgtgtaatgataacctagtctgcagccatagaaagaaaaaaacgagtgaatttataacttaaagagatgaatattcaaagtttcaaacaaaactacttatggtaaagaaattcgaattacaaaaaaaaatgttgtgcagatattacaaagaagaaatgtttgactaaccttctgtgatccatcgctgaattatttgtggtcctccctcgtacataagatatagcaaaatgagtgcataaagtgatttcaatctgcaaatcaagaaccatgaagtcaaactgttattttaaaaggggggaaaactgtcaaaagtaaataaaaatttgtttgcagagaggacagccagcatcgctaaattagatcttagatttttgttttctaacaggtaataaatatggaaaatttttcccatcacaaacaatgaactaggagagaaaaggagtacagtgcagaagtatcaggaatcctcctgaaacagaaaagtaaaatacacaagaaaggaaacaaaatataaaataacattggctccaaagagatatctatgataaaaggaagctactgaacactagctcacactacagtatttttgagtgaggagtttctatgaaacagaaaattcttgggtgctccccagaagttccccttctatacggtatatcagaccagaagatgagatcttttccatttaacttaataaggtgtacattcatagttgaaatttattaattttaataccagtagctggaaaaggattaagttctaaaaccagcttatgatcttattaaatgtttttacattaatggaatccatttgataaatgtataaaactaagcaataagcaattacatgatttcttgggtatattgaatttgccctggcagaatttatgctgacaattatcatttcctagcaatattgattgacttatccctaatgttatggggaaacaaaatatcctaatgtaacttgcttcatcattaaacttacttgaaggcaaatatataattggtaaaaaattactcagttccataaaagtgcaaggatatggcacaatttctaagttgtatataggactattttttctaagctattttaataacttgaggttctatcaaaataaatgtgcaagcagaggtgaaaatacttaccactaaaaatgtcaaggaacaattctcttgacagcttaagctgtttggtggagctaagaaagatttatatctaacacccccttaaacagagctttttgagtttgaagtgtggacaatgcacaaacccactttaccttggggctcaaatacaagttaattatgaagaagagaatcaacaaggatcaatctcataatttcttatttatgaggcttgtgataccatgttaaggaccaactctcctaatcacacaaattgtcaggtggaagcacttaatggtaatggttttatatatttaacaaatggtaagttctgaagcctatgccagttctctctatggggtcctataggattgtggaacatggacgaattgagagtcaggatttgaataaatgtcctagtgaaactcttggcatttgctatctttctggaaacaaaaattctcgaattctggtgtctccttcattagtagataagtagttgataataatttctgtggtagcagcatctactgaaaaccctttgtctctcattattgtaaggtattttattgaccttgcaagctccttttttgtcagcaagccttggacaaagacattgtaagtgcagttatttggctggcagccattcacttccatatttatcagtaagtcttcagctttatccaacgagccttgtttacagagacccttaatcataatggtataagtataaacgttaatttgcaaacctttaccaggcaaactagaaaagagttcccatgcagcattcatttttccagcactgcacattccgtcaagcaaaatactataaattacaatattaagatccaaattactcttctccattgcctcagccaatgacacggcctcagaaagaagattttctttacataggccatccaatataacagcacaagtctggagattgggtacttgaccatatttgtgcatattaaaaaacagttcttttgcagctaatggtctacctgcttgacaaaacccacctataagagtggtccaagtaacaacatcaggaacaaatcccatcttactcatttcctccaacagatgcatagccttattaatgtttttgtccttacaccatccatggataagtgaagtaaaaaccacaatgtccggtaaacggcccctgctaaccattaaatgaaatactctcatggcctcattcattttattttgcaaacaatatatatgaatcaatgaattataggtgaagacatccggcccttccccagtcagaatcataaaaccaatcacacttttagcctgcatcacttttccttctttgcagaaagcatcaactaaaatattgagcgtttgcaaatccggcctcattcccattttcatcatctcatccagcagagaacccgcctctttccatcttccaaaattgcaaagaccttgaatcaagcaagcgtaagtgaccaaattaggtcgaacaccttttccattcatttctgagcacaaattcaacgcctgagataataatccatccttgcacaaaccatccataattgtactgtaaaccaccacattaggtttccaattcctttcatccatctcccttagccaccctaccgccgccaaagtgtctcccgtcttacacaacccattaatcaacgccccatatgtgtaaacatccaatggataccccattttctccatatgatcagccagtcccacagcctgagccacattgccctgcacacaaagcccgttaatgagagtggtgagagtcatcacagtgggctccaaaccaagtttgaacatagtccccaacacagagaacccaaaagcagccaacttcaaacggcaaagacaattgatcactatattaagagtaatggtatcagcttctatgcctagagaagaaaacatgtgcttaactaaagagatggcagtggtgtaatgcttcaacctcacaataacacccaacaacaaagtaaagtccttcacagaaggcaaaggcttcattctagacatgccgtggaacaagtccaaagcttcatcaatattcttcaatttatctgacctgcataggtttctcatggaaatcaagaactgggttccgttgctatggctctcagtgtcatcagtgtttgtggagcaatgacagtgctttgaaaaagacagagaagaagaaggagagtggatggaaatggaatgagagaaagtacccatcatgtgatgaagaagacgaaaacgagagaaagagggtactcttcgaagcattaaaaactcactcttttgcttccgaacaccatcagtgtcggaaacaacttgctgcaaccgttcttggttgcagaatctggcaagggtttaggtttttttgtcaggaggctggtttaggattttgaaccgttaataaggtacaatattaatattattgttgttattattattattagtagtagtataaaacgaaaatcaaataaaatgcggacaagttgtgttttgtttttaataaaaaattaaaaacctagcaattatgcttatgttcaaataaacaaaaagctcagttaacagttaataaaaacataatattcgtataaacatgtcatttacatagtataaaataaaaatatttaagtacaaagcatattaaagcaaacaaataaaaatttgcagatttaataaaataaatttgataggagaagctgggtttgggcgacgcgagggttccttccggtcgctgtaatcgtaagtccttcaaacttctctcgtccctttcttctattcaactgttagtcttttgaacccaaacccttcgaatgtttcgcatatcgaattttatcattcaccattgatctttctgtgtttcttcatttatttatttatttattttgcttttcatttaatctgaaatcatctgttgctgtgttgtgcaaaatagggtttggcattgaagggaatcgaaaatcaattgagtaagaacgatgtcggtgacagcgggtgttagtgatactgtgatagcagttagggataagctcagaggtaaaattggccaaactaaagttaagcgttattggcctggtaaagttcctgaatgggctgatgatgagaacgaagatgctgcccccgccgatattagaccttccagggaagctgccctggaaaaagcatttcctcgtcacgaagaagatgctgctattgtcagaaaagatgatcgtaggctccgccgtttggctgagagccggatagataaccgtgaggaggtccgagctgatcatcgccgcattcgccaggctgaaattgtttccaccattgaagaggaggccaggaggcaggaatggttggagtttgaagaagaagatgagaacgctctggcggaaagaaggaggctgattaaagagaagttgcttcaaagagagcaggaagaggcgcttcctcaggaagaggaagaggaggaagaagaagaggaggaggaggaggaatctgagtacgagactgactccgatgaggaatatacgggagtggctatggtgaagcctgtgtttgttcccaagtccgagagagataccatcgcagagcgtgagcgtcttgaggctgaggagctggctctcgaggataaaaggaaaaggagattggaggaacggaggattgagacgaagcagattgttgttgaggagatccgaaaggatgaagaaatccagaaaaacttggaaatggaggccaacattgctgatgtggatactgatgatgaagtcaatgaggcagaagaatatgaagcttggaaagtgagagagattggtaggatcaagagggatagggaggatcgggaggcaatgttgaaggaaaaggaagagattgagaaggtgagaaacatgacagaggaagagaggagggagtgggaaaggaggaatcccaaacctgctccaccaccaaagcagaagtggagatttatgcagaaatattatcacaaaggcgctttcttccagaatgaatctgatgaccgagctgccactgttggatctgatggtattttcgctcgtgatttctctgccccaactggggaggataaaatggacaagacaatattacccaaggttatgcaagtcaagcactttggtcgtagtggaagaaccaagtggacccatcttgtcaacgaggatactactgattggaataatccgtaagttcaatttctcctatgttctatatctttcaagaatagtggtagattgtttgttctattctttggtattagatctttgttgttttatcctgagaatttttttttggcatatctgttcatatttacttatgaagttcatctgctgtggcactggtccaaaatgatcttggacattacttttatgttcatggaatgaaattgagatgctcatgtcaaaaaaattgctgctatttgtcatcagaagaatgagatgagtatttttaagaagaatggttttgtgatggaggccccaaggcccaagatcactaaggtgtatgtaaggataggcaaaaggttcacatgatcaattttaggagagatataaccaactgccaaccctgtagcagagcatgggaggagggcatgtgggcttgttctaaggagagagagaatattagcctgagaagggtgtgtagaaggtaggctggaattaggcttgggctgggagagaccacacactctcgaaactgtctaggaatcttttttcattttgtaccattgtacacagaagataccaggatctgaactgattaagacctgttactggaatacaaatatttgtatgcttaatttctttgttttagtctttctagcttgctggtacctatcattttgctttttaaggaatttgattgtgggtgagattgagattcaagagggagagttgattggaaggaatatagttaaaagacatgtttcatttagagtaagcatagttatgccatctcacaaatcctatttaatttttttggcattcattttgtagaaatatgtacttggcttgaagtttattgtttacaactttcttagtttctcaacttcacctgacaacctcaccttttatgtgaatttagctggacagtaagaagggattatattgaatgtcacaatttaaacgagttgcatattagcagcccttgatatggtttgagatcttgacacaagtgcatgctcatgagttatgcttatttgttttcatagtacttttgggtttcacttttgtcatttgcttgcttgtaatttgtgaagttgagaggataacataacatatagaagttatgattctattttaatttatagattaaggtatattctctgttctgagaacatatgaaatactacttttatgattgattctgtttgtgttggatgttgatgtaacttgttaaattgattctgccattcttctgattttattacaacaaaagagtctacacaatttttttatcacacctggattttatcatgcattgtgggttgataggcttgcagtcatgctatcacatattgataatcatctttggaataatggggtttagtatgtttatgtagcattctctgcattatgaaagaaatttttgcattggctttctgcatcttccttttcttgtgtcgaatcgatctcccttgccaagaatttggagttcgttaatgcattgatgataggaattcaattttcttaatgtgcaactaaccccttcccctgaaaaaagggtttctttagtactactgcaatgagccttttatgcttatatattgactgctgcaatattatgctctgatgttcttgttattgttgaattgtaatgcaggtggacttacaatgatccacttcgtgcaaagtataatgacaaaatggcagcaatgaatgcacctatagtgaaacctaaaggaagcaggaaattaaaggattgggaatctcgatgaacttgaagttacaaaagtatgcatgaagatatcatcctttcagttattagactttggagaaataccagagtagatatgtccttgtcctatgtatgattgtgttctgtcttaaacagaacgtaaagtagttcatcacggctggagcgtgtatgttgtggaccatggaaggcaattgtgacaggaattcagcgctagtttatctggatattcttccccagttaatgaatcatagctgatttagagtcctgccagcccagcctaatgactatgacttcctttctttgttttgtcatcattttgacttttactggctggctatgaggatttaattgagattgctgcctctattgatgctttaggagccactgtttttcaatctaagatcatttatatgtgcaacttcgatactgactggaactcccgagacgagagtgacactgaattgatggtgtcaattggtgtactagttcactagtaaatgtagcataaacttccatgtttggataatcttctagctgaacaaaggggcatattgaaagttattcattcaacccgctgcttgtttgtttataggagttttttgacaaattaaatcatatttatattaatccaaaaaatattagagtaatttttttgggctatatataatctaataagttaaatatgaggtccatccaaaataattttttaaaagagcaaagttcaagatagaagggcgtattttatagaatccgcatcataaatcaaagagtgaagggacaaatggaaataaattacactttggtctcttattattttcatttcttaaatctggtttccattttttcttgtcaatttgatcctacaatttaacttgtataatttcatccgttaatctgatatttgctgaagtggatgtgcagaagcgtcacattgatgtttttgctaattattgaatgtcaaattaatagataaattaaaattgcacaattaaaataattaaatgaccaaatttgtgaaaaaagaatgaggggaacaaatttgagaaatcacagcataaaagatccaaaatacatttgagccaaataagataagaagaagaacggaatatatcttccactggcttgaacactttttattcactgacttgcatgaggcaaataaaataataaaagaaaaattggaaaataatatttaggtaaaaatataaatacatttttatcactcattttttacatcaaattttctcaagagagtgcgttgactgctgttgttgctgcgagtttgttcatgtgtctttctggaaaaggtgagttgctgaattattcatatatgtttagattcgttatattcgagcaccacttatcattatggtacatgctgcgtatggcttctgtaacatgtttcaatgttccgttagttatcagattcttgacaattactgaatcattttcgcattttatttgtaattaaaagcttcatattctattcacttatatatatatatatatatatatatatatatatatatatatattccacatattttttttaaggagtgtatattgcaattgatgggtgatgtctacgtttataacattacaaagtctattccgtatggcattgtagcttatggttgtcttataagcattacctcccccccccccccccccccccaaaaagtagaagaaaaatcaaattccatctagcataatggaacaaagaaagagttgggagataaaaagaaaaaagattattgatacaatcacagcagttgatctttcgctattgcacttaatattcacttattcagaattgattacctacggtcacagaataagaattcttcattcacagtattagttattagagaaccttttggaaattttcatataatttcaaattcaaaagtaaattcccatcaaatttaatggacaacttaaagattatgtgaacaggcatgattcatgaacaaccttaaaccttaaagatgtttgcatgaagatgcaatcaagagtcagacctacaacgataatacttagagcagcctctattttgaggatttgagggtggaggaagacaccctccagttttactataagcttcaccagagccaccaccattacaaactggtttatctctctgtaaagctccattggaaatgtatgatctcttctgctccaaaaaccttcggcttatttcggactccatcaacagctcatcttcttgattgcattcagctatggaaccattgcatgtgcttgcatgacttatcaatgagagcacagtgcagctgctgaaatgcataaagctgaagagcatgaagtagcagaaacaaagaagtctaacggtggatgattttgaggccattcttctgttgtctcttggatgtactcttccctccactctcccactaataagcactatatagataatattagatcatatgacaccacctttttgaaaaggtgcaagttgcattagtgataagcagttggagcgcacttcaccaaaccttttgttttggacaacatggaaattatgttatttgccatgtgctacagatgtttttctttctttcttttctgtgaagactattgatttactctgctaataagtgattgcatatgtatgagataactgagttgctctcggaagataaaattctaatatgtcccaagtattctgtatactataaatagactaattaaaaattccataccaaataatagtaccccaaaatgaaaaaatatttatagaaaacatgtggttggttttgtggcatttgaatatgatgatatttttttggttcctagttttgttccctgggtaaaatctattcataagaaaaaatttgcaaaagggaagccaaaaataatgagataaggtgatatttgatttgagtgtttattttttagttttattttttcaaaatattttttttcaaatttaccagatttagaaaatatgtatttgaaaaaaaaatactttaaagtttcatcacattttcacttttttaaaagagactaaaaatattaatttgttgttttcagttttggattatttttaaaaatatttttagaaaaaatattttctaaattttaaacaaatatattttcacttattttttattttctttaaaaataaaaacaaaaaacactcaaatcaatcaattgccaccttaagtttcttatttgaaaatccttacacacatttaagaaagtataaatgaacaaatgtggagttaggtaaataggattataggaagggtattatcatgacaaaagaaaaaggagagaacagaagctaaggtgtgtgttgatataatcatacatctaaaatatttggtacatattcctcgaagttgccccacctaaactctcagtcttctatcagacaatggacctcaacatacaattgtggtggggtccctatgggctatggatttcgggatttcctttgactctaataaaacgaggacaatgactttgagttcctttcacaccaatctcaaattattgcactcatggaaattgtaaagccaaggatggttccaagcatttacttaatttcttcctctattattttagtttaattacacaaagtggcacacactgcacaggtttgaatcttcacaccttgcatagcattcttggaagcatttcctatcaatagtatgaactagtttgtttcaaactgatactgtgtttggataagtactcctatttaatatcaagacaaatacaggcttcaatagttgcaagcaatttggacctggcaataattttttttcatatatttaacatgataaaaacaaaatgggggtagtgaagttttttttttttgcacgtaggacacaacaatttttgtttatggacccagtttgtattcatttatcaggttcaaatgatcagagtttttttgtacagtgggccaaaggggtttgatgttggattcactacacttcataaaatagatgtagactatcgagttcacaaaataaatattacgaatatatgcaaaaattactccatgccacacaattgtgggacaacaaaagtagatacatgccataacaatttttcttagcttcaaagaaagatattgaacttcatgtcattatacagtttattatttgatcctgtattattgtcttgtgtttacaaagcagaagccaaaacaacacgcatggccaggaaagcactcatcatagtatatgatttccttattcttcccattgaacggactgaagacttcaatttctgctgttgcctatcctggagcatcctctgttgtaaggatttgatgctggcggtaagcagtttttgctacatggtgctatgttgcgcttggtaacttccataataatgtacttgtttgcatttttagcatgattttaagactccatttcaacccttcacataagcttactgcttcattcctcacaaatcattacattttctggtactgattttggagttaagtctgtccatttatagtgctaaaacttgaaaaatgagaaatgagaaccattggtggtggtcacggaataaggcataaggaataggttcaccttcaactaatttttgcacagaacttttctctagaaactagaaagttgattctataataatgttgttcaatctcatttattttaactttggcgtttaagtgatggtattgttgacataactgttataagcttatagatgattccacttattagcaaacagaggttcttttcaaaagtcaatccaaatgagccagtcattttcaaaataggtggagtcctaattagaatgaatcattacagtctacaaaaacacataaatgaccaaagcgccctacaagttactgttggccccagatgaactcaagaggggggggtgaattgagtttataaaataattcgcaatttaaaatcaaattcaaaacaataatatgaagataaaagataaagataacacaatcaattttacgtggaaaacccaattgggaaaaaaatcacgacgtccaaattggataaccaatccaatggacaactccactatgataattttgtgtacaagagttcctagtatcctagtttcctagtctacccttacacaacaattatcccagctggtatccttgtttcccagcaaaaagctctcgtctcaattcaccaagaatagagacagactggtatccttgtttcccagccaaaagtcgcacgtctcaattcaccaagaacagagacaaaaactggtatcctagtttcccagttgcgacctcttccaaagtcaagaagaagaatacaattaaaatagttacctttacgcttctattccttaagcaaataggtacctttaaatcctgatggagagttgaagaatcaaacttgccaaatgcttctatatgatctcaccacaactctctcaatgatgcaaacacaaactctctgaaactctaatattatttggaatggaattgcatgctataaacacaagagtatgtttctatttatactaatttaatgatatgattttatccaatgaattcctaaaagatattctattttatcttaaaaatattttatcttatcatgcaatgcaatcttaaagatattctattatattatccaatgtaatcttaaaatattatatcttatttttgaatgcaatattaaaaatattctatcctatttttgaatgcaatcttaaagataaatgtattggcaatatcaatcttctaatctccttacataatatctaaaaaaataaatagaaacaaatcttcttaattttatgtcatcttgaatgatattaatcttcaggattcttcacttaatcttatcttcaaataatcttatcaattatgctgagatagaaacaaatcttcttaattccatgtcatcttgaatgatatcactcttcaggattcttcacttaatcttatcttcaaataatcttatcaattatgctgatcttcataaattcaaaatatcaataacttcaaaatatcaaatccaaaatattagtaacttcaaaatatcaaataattattatcattgcaattaatctaataatgtgacattcattatttgttatcatcaaaactttataaatcgttttatgcataaagggttcaacaaatatccaacagttaccatctgacaatcacaattcacaacgaaatgatttggttgggttgtgatttcaaatgcattcaaatgggaacaagcaacgtagaaggtgcagcacattcatgatgtgaatgaaaatcatagaatcccaagtaaggccattaatctagaatgttactctaatagatttactcgatcaggagacccaagttttggaggtgagcaagatttattttacagtgaattctgtttaggaagatgtaaatgagaaagtactgaaaactacatgaaaatataactttattacaatgcaagcatcatacatatgcaactattatttatttataacattagcccacctctattcattcttggactaaggaatttattcacatggatattgcttgtagtctggcctcaagtggcatagctatcacatccatatatctgaagtgcagtcaccaccaggatatctcatctcatgtgcaaggcagggaccttgaggctcagctccaaagtcaacaaagaagttagggttaattttcagacctccattttcagtatcaacatcaatctgtaacatgtgggatcctttctctacaagctctggataaaattgtttatcccatgcactgaagagtgagtttgtaacatatagccgcttaccatccgaactcaacagaatcatctgagggccagctctcaacttatttccctgaaaattacaattttgatctcttcaccttagaccacaaaaaggtcaaaattataagtgtaattatttaccacgtttaagcatcacataagataaaatacaaaagtgaccaaaaatttaaggcaccaatgtaatgcacgtctattatatctactacatctaagaaccaatcaactccaaacatgtgagatgcaagaagcataacactagaatcactaattcaaaagttaaactgcactaaccaggatgtctggaacatcagattgccaagtattaccatcttcagttatagctactatagggctttctttctgaagtagtcccccaacccatacttggccagtcagtacaggatttttagggccctcaatgttatattgtcttatatcaccatgaagccaattcacaaagtacagaaaccgatcattgagagatatcagaaaatcagttataagcccaggcatttctggaagaatccagttttgcactttcaatggtttcactgatattgcaacctgcaaagtcagtctagtctgtaagtattattgatcattatgcgttggttgaagctgcacaaacactaaccacacgactatacaaaatcagtatggatatctatgaatagagtagattatgaagaaaattatatagtctctattatttcatatgagcaccgatacaatatatagaaaaaatgaagaaaaaaaaaggaaatgataaataggatatttcaagaactaggaatcccaaaattacaggaatgaaataaaaatagaatagctgaatgtaaaccttccgattaacgagatgttgtgattctcctataatttagggattaatttttgactatatactttttatgtacctcatgactccatgattcatcctcagtcttgaaaaagcgtaccatgttacttgacaatgcacacccaacgaaacctgtatctttagaaggatcatgcagaaaccttacctgcatttaggacaagttgcttacaaattatctcacctttcacataatacttcacaagaacaagctagagagaaaaaatgtagcaaaggacaaacatatttatgattaaatcacaagtacattaacataatagcttcaattacagcaaaaaaaaaaaaaaaaaaaaacataaagtgcattataactggtggaaataattccagatttatatattaaacaatgtacctcccagggtagaagccctgactcaccaaggtccaatgtttgtctcagttcaccccagtccagctgtatacatgtagatgcctcccttaaagaccatcagagacatgctgtaaattaaaacccaagacgtgacacaaattccaatccgtaaaaaattaacacaccacatttgaattacaaattccaatacgtaaaatatagatttattatatagtatgtcgactgcctcgaaggaatactaattacgttaattatactaagattcaagtccagtaactcagtcgaatgtgaaacttcactaattcagagctttagaaaacctccaatttgtttaccacatagagtagtttcaaacattttcttaaatcaattgtatccacattggaataaaatcatcttttattttacttgtctctttttcactctcttcaattgaaaaatacacgtcgactaagaaaaaatagcagaagaaaaaaatattcttacttaaaagtgatatttacgcaccaatatattattttttaattactgaaactgaaaataaaacaagtaaagaagacaaatgttttgaatcaatctatatgatactatgcaaattttaggagttcatttcagtactccctccaaagaagagagactcttaccttttttttctttcttttggaatttaacattaattttataaattcagtaccccctccagagaagagagtctctaggcaccacaattaagtaggattgcaaactggacctagagaatattgtggtgttcatggattgtcgaccctccctctccattaaaaggattaatgtttgttgatgttacaggaccttccaatatcctacttctatggttgaatggtcgatttggtccaaaaaagtgtacagcagtttcaagttagtccttgaattcaaataaattgaaataaagcccttgaagatagcttgtcttttacatttgtcctttcaggactaaattgcattttaatgataacatgtaaatgcaaagacctatttgaaacgaaggatgaatgtgagagaggaaagctactttcgaagactttatttttagtttattaacatactaacttgaagccgtcatatacttttaagaaccaaattgactattctgcctacttctgattgaattcttagttttttggggcgttagcctttttttatctaaaaaaacttaaaagttaacgcatgatgttttttattttttattttcaaacggcaaatgcattttatcactttcaaaataaaaggcaaacattttcaattacaagcaatttaacttcaattttagtaaacaatcatcttagttcgagccaaattttctaaatacatcaacgtcaatgtattgttgagaacagtatcttccattctgtaagataacagaaaagaaaagaaaaaaaattgccaaccaaggattaggactttaaggtcactgtcttaatatacggtcaatgatctcttgtgtttgatgatgccattggcattcaataggttacatgtatagattgtctatttgctccctgtattgagccacaactctatctcttcgaattttcatgatgggtgtcattagaccattatcaatctgtcattggagaaaaggatttaccaaatatgtcagttttgtgatgtgaacaacatacaagatactactgctttgaattccaaatctaaccttgaagggttcttttacaagaaggattggtccaatttgaaatggagattctgatgtcctgcatgatgaatagttcaattatagaatacatttaatttgtttatcattcagtgactccaccataacagtgtccaaaactagtttactccctttaattgtcataaaatttaagtaaagctaattaaccaatagagtcaaacactgtccttcccccagaaacagaaaaacactagcacaccagagatatctgaacaaggcataaacttttttccggcattcattacaagaaacagaaataaataagtcttaccaggtctttaattctttatatatcaggctcgtcactttttccttactgacatctgaactgttggaatctataattgacaacttccttgctaccttcaaaacttcttctttgttaggaacgattacagttcctagacgtcgcttatcctataagttacagttattaccaagaagtataatcactacattttgtactatctgaagtacattttatatataatgcttgagttagctatcagaaattgaaagaattcaagaattcacctggccaacaacaacaatttgttgaattatgctactcattttcaccttctcttattataacaagtggttaatactcaaggaacttctatgatttccaaaggtgagatcaaaccagcgtaaaaacaaggttgagcaaaactcaacaacttaataaacaaattcaagaacaggatcttgtcttactcgttcgtgttttaagaacaacttgtttgttactcatttataatattgtttattattcattattgcatgtaacacatgttgaacaccgtagaattgtactttacatagtacgtgcaaatgcaatacaattatacaaagatatatatatacaatgtatacatacattaaaatgaaaatttgagacatattatgggttgggaagggggataaatatcggggagatttacacttgtagtcaaataagtgaattggacaccacaccttaacccaaaatcttaaagctcaagtttatgattcttctactcacttatatggtgttaaacttttctatttctataagatgtgagactttaactcggacttatactctaacatttatgaagtaaaatcaattgatatccttcacaatgtgctaaaaaactaattttattgaacattaaaaaagatatttaaaaagaaaaaacgtggcaaagtaggtggcgagggccacgtgttttaagaatttttttattagtgtaaattataaagaacttttcttcaaataatagaagtatagggagctttcaaatttaacttgttcaggtaaacaccaggttccttttattggcagtgtcgtttgtttcacatctctaatggatgaaaaatatagaaaacgtgcatacaccgacagatagatatacaaattttaagattccatgctaaacagattacattgaactcaatattctactatacctgttgtagatgtcgaagagaactaaattctccaactgttagttactaagcgcagctttgtttggtggtacgtgggtggtaacgaccataaattggaccaatcattagaagatactataacttgtgttaatctttgttagtatatatttaacatttgatttttttattattaaaccatgcaatcatatgttactttagaaatctatatttaatcacataaaatgacaaatgggtaaatataagtatacaaataaatttaaaatttatagtcatagagtattatttaaagtatgattttgaattatttataactgaaatatccgtgataactttttttattttaatttattttgttatgaatatgtagattttaatttaaagcttataaaattctcacaatggctataattccccatcagccccgaaacaaaagggaaaaaaaattgtagttgccttttatggactctggttttgttcagaagcatgagtcaaactgaccacagtatttgggatggttgtagggaaaggtaatgttatgttcaaaattttgagtaaactattattttagtctttaaaattatgagacatcgttataatagttcataaaattttaaaaatattaaataaatcattcaaattaaaattattgtcattttaattaatctacgatatgtacaacttagtattattattataattcctaaattttatattctactatcattatagtccatactttcataacagtgtcctaaaatttcaagaactaaaattgtaatttattcttaaaattttgcaagataagcttgtgggaaaatgtttttattaaaaccaagtggtagttttttttccttctatgctttattctccctacaaatgtctaatttttgctacttttcatttcaactagtttgtggtgtgtgttttttttcagccccaaaccaagacgaatttattaaaagtcatgatcaaagattcaaagagaacaatagcatcatcttccaacaaaggaatcgaaacaaaagcaggagtagagacaagaacacggtgaagttaaattgaaaatactataacataaaaacttaaaaaaaaaaacatttatctgtaaataaatacaagttgtctctggaaaaaaaaatgcaagtcattaaggtaaactacaataacaacactattaacattagcggaacgtttgctaggagaagaatttttttcatattcaagaatgaataatatttgattgatattcaatatttttgtggatatttaaataagtttactgaaaatcaaataattatgtaatgttttatcaattactttaattatttacaataataaataatctaataaaaccaatattatatttttacagtattcaaagaaaattttaactcaagaaaataagattttcatagaaaactaactaacattttttggaaaatttctccctactaaacactcataagggattagtcaagtaaaaaatataaaattaatttaatggttgaaaacggagctttaagggtgaagggagaaaaaaaaagaagatgttacatatttaaatctttctcactacatttttaacaaaattaacatttgctaataaaaaaatattaataaagtgaaataagatgaagcttatcttatgataggtagggatgaaaatggatataagtggtctttgacttgacctagtttgtttattataaaagttaaattaagattttttgaaaagtctatttaaataaaaatgtcagactcaaactttaaaaaaagctagttaaacctatcaaacggacctatttataagacaatataattcaagagacccttgcattactctttctctctatcagtgttacttgtggttaggggtggaactttttaattaaaaaggccaagttataggttttatataagagaaacatatctattatgttattttttatttttaattatttatttttatttaatcagaatttgaatttgtatacaagttttcatgccagattagatctttatgcaggacacgttcaaactttaataacttatttttaatatgtaataaattaggcttaaacttaatgataataatgcgggtcagattcatgactgtcaaagtctgacctgacctacttccacccataataataggtttcatgttcaaattttcaattgtttctttcaaataagataaatataagtttttctcaaatattctgataaatttgttatgccatgaattaaggttgattctaataacaatttaaacaatttagccataataaaatagtgacatattaatctatcgtacttttttactttcgaaaattaaattcaaaagttcattaactgatttgatagtattactgtatcaaacagttttagggactatttaggctgtgtagatatgattcctcttaggtgagggactaaatagcaaatgtaagtgatttttacctagacctattaaaaatagtaaaacgccaccaggaaagtagtctcgccgccgcattgcatccctaggggcacgacaatagtaatcattgattgtagtttataaagatacacacgtgctttcattttatttccgtagcattttactctgcagcagcagcagccaacacccatggcgtcgttttctgccgccgtcgctcagttctcccgtgtttcacccactcacactctgctccactctcactctcacgataggctcttccattctcaatgccgcccccctttcttcctctcgcgcccttcccattcactccggtacgttcctatcgactactaggtttcgcatatcaacgtcgtttcctcgatccttttcgcatttggttttagatcaaattacaccaatgcttttgtagctccatgtctcgaattttctatctttgaccacacattcaacagctagtcactcgctattgtgttttacttgaacattccttattggatgatgcgactttactatttttaattctttttttgtttttgctcttaaaagaaaaataataagccgagaagagagagcgaatgtcagttatgaaacgtgatgtttgattattaagtttatcagctgaatgaggaatttgagggtatattccctcagtttgaataataagattataagagcaaattaacaaaagttataaacatcgtttgtttggcagatacgttctaaataagcttttaagtgattggttattccacacacagtatattctctactctccccttttttttttgtttatttatcctttgcagagcataaactgttttctcggaattttggcagtatatacgtgtttaaatgatattctccccatgaaattaattggatttttgtgttttgctatatactgattctcaggaagggtcttactttaccacgaggaagggaggcaccaagtacgacagtacgttcttcatttacaggttgcgacttacttttatgatagaacatgtcctttttgttttgaaatagacaaatatagtaacttatgtttttttctttatttgctagcagatgtttcactgagtgtgtccttggaggaaaaacaactacccaaaggagaaacttggtctgttcacaaatttggtggaacctgtgtgggaacctctcaaagaataaaaaatgctgctgacataattcttaaggatgattcggagaggaaattggtggttgtctctgcaatgtcaaaggtgacagatatgatgtatgaccttatccacaaggctcaatcacgcgatgagtcttatatagctgcattggatgctgttttggagaagcacagtgcaactgcacatgacatacttgatggagataatcttgctagtttcttgtctaaattgcatcatgatattagtaaccttaaggcaatgcttcgtgcaatatacataggttataagctcatcaactctctctttctctttgatactctgttctgttttctcttgttcagttatatctatttcttttataaatcctcatttgaacctaggaagttatcttcatgttgtccttgtttattataagtcggtatttatcgctttcactttccggtgttgttttcacattgtaatagtattgatgttgatgtatattgcactagctatgtcttggttgctattttatagtattgatcattgcttatgtcttggacactagtatgacaataataataatatatggtactttttggtcattaatatcacatgacagattagatgtatttcatggaaaatactattagtcacatgatctgtacttctgtagtatacatgtaattgatcatatgacctgtagtatacatgctactggttagatgacctgtagtatacatgctactggttagatgacctgtagtacacatgcaattagtcacatcacctgtattatgcatgtttcttcatgtgtcaaaaatcaaagtatatataaatgttcaccagctttgactttattttgtttggggttcaacatagatcttaacagaaactagtcactgcactatgcatcctcgttcagttgagatctttaaaccaatcaagttttatttggttggtgaccaagagatatatacaagggagataaggagtgaaaatagaaaagttaaatttgctgaccatgttgtttcgttggaaccatttgtcagggttggaacacaagtttgaaatgggggcagagaggaggtggcagctgaatgtgtttcttgagtgaattctagagttgaagataacccttagattaccaccatggtgcttttttgtcctgcatgcgatggtagtataagacctaaagtgacttgcgaaaaggattggtgtaataattacttgaagaattagagttgaaactgtgttcttatcaggaattagatgattcaataagatattagtttcattaaacttcatttatagtaagatttacgataaggacatcccttgtatccatatatttgcaatcagtcccgttctgtagaatcatggaaagaatttaattctaaacttaagctttgaagacaaactttggaataaaatgtttttcacttgagtaggagcagaaaggaatatatatgcattgcaatttttgcaacaaaaggaaaatgatttagaagtgaaaattgtagaaaatatcttaccacacatttctaagtttaagcatataggatcaatattacaaaatgatgaggaagttaatgaacaagtcacacgcaagatataagctgggtggttaagattgagaaaggcttctgttgtagactgccttgccttaaatccaaattaagtcaaacaattccagtctcttctcttagtctatgctcaatcaccttttcccataatttcatagtgtgatctctgtaaacaccttttccacaacaaaaagtgatatttagttttccataaacattattgcttaaaatgaatttgggttaaggaattgcattttaagcctgactaacatttttaatatcttgcagctggtcatgcaacagagtcctttacagattttgttgtgggacatggagaattatggtctgctcagatgttgtctctagttattacgaaggtatggtgtgctgttttatttagaaagatatgctttttccccctttatatgaatttagctcattgcatcatgcttctgttccggttctacagaatggggctgattgcaaatggatggatacaagggatgtccttatagtaaatcctactggttctaatcaagttgatcctgactatttggaatctgagcaaagacttgaaaaatggtactctttgaatccatgtaaggtaatcattgctactggattcattgcaagcacacctcaaaacattcctaccacactgaagagagatggaagtgacttctcagcagcaattatgggtgctctatttaaggctcgtcaggtcacaatttggacagatgttgatggtgtgtatagtgcagatcctagaaaaggtttgttatgctttgtactttgtgtctgagttaaacaatgagtggactggatcatgagaattggtttttagtaaccagatggagttctagctctgacatattgatgatgcttttgtcttgtgtttgacttccgtaacatgaagttttgattaaatataaacaattatattttctgcagttagtgaggctgtgattttgaagacactgtcttatcaagaggcatgggaaatggtgagttagatgctggaaagcctcaatgctccttctgctcataaaattaaggagattaacttccaaattgtctgttgtacagtcttattttggtgcaaatgtcttgcatccccgcacaattattcctgtgatgcgatatggcatacccattatgataaggaacattttcaacctttctgctcctggaacaaagatctgccatccttctgttaatgatcatgaagatatgcagaacctgcaaaattttgtcaaaggatttgcaaccatagacaacttggcacttgtaaatgttgaggggtgagtcatgaattgcagttgtgttacattatgaatagttggcattttttgctgcatgaggatttgtatttaatttaaggttttctttaaccaatattaattgtccaagttgtagattccaatgaatttttctctgttgcttttttgcagaactggaatggctggtgttccaggtactgccagtgctatttttggtgcagtaaaagatgttggagctaatgttatcatgatatctcaggtgcacttataacttttttcaattttctagttgttcacgttgatatataagaaatggcattaatcagtaacagtatttgtgtaggctagtagtgagcattctgtgtgttttgctgtgcccgagaaagaggtaaaagcagttgctgaggcattgcaatctagatttcgtcaagctttggataatgggcgtctttctcaggtgctaaatccaattcttctaaaaccaaatgcatgtttctgttcaattgttaagacttgactcacttgagtgatatcagactgaagatttatcattctacattttgtggatttaaaaactggatgaaacatttgagtgccatgcatggttttaaattgctgttgcgatgtggttgtcatgactcatgagtcaaaaaacttttatgttgcggctgcaactgtggtagcagaccgcaatttaaaaccatggtgccgtgctcttaatttttttgaggtgttgtattatcttttctatgtaatttgtcttcattgcgtaagtgttttaattttcgtcttaatattaattaacaacaagggcatattagggttaaaataaatatgcaagctacagtccacttattatgatctagaacagtggaagcaaacatcagtgatgcagatatcaacagttgggactaagactattatttttggcactagattgatataaatatcaaggattactataaaatgtcaagcaaaaggatccattgggaacttctttaaagtgccaaagatgaaggctgaaggacatcaaataacactaaggcttgagccttgagtcttccaggaacaatagatcattatgcccgtagattaacctaagttaattaggatcggtggtagatgaacccaataataaatcagaaataagacaaagaacgcgaaagggagaggggaagaaaaagtagaaaaaagacaaaagagaggaaaaataaactaaaataaaagaggagtgaaaggaggaggaaagaagaggaaaagaactaaaaaagggaatgactggaacatagaactactaatgggtttaagtttgataatcaaaaggaaatgcagtctcttggaatatactcctgtcctcttcctcacaagatagttggatgtgaaagttgtgttaaatggaatgcttcttcttcgtcttctttttccccatcagtttgtgcttatttcttttgtttgttaactatcatgaagtagaaacttaaaaaccgagtaatttcatttcttctgtttatattagtatatgtgactgatgatgttaaaatttaaagcttgctatttaattacctttattgcattaaaaaaagttatgtataatctctcaggttgcagtcattccaaattgtagcattctggctgctgttggccagaaaatggcaagcactcctggtgttagtgcctcccttttcaatgccttggctaaggttaggaaattatgtttaagatattgcttaggttagaaatttttgcttattttgttatgtattttcgcttgttttatgttctagtttgttttcataaacaggccaatataaatgtccgtgctatagcgcaaggttgttctgagtacaatattactgttgttgttaagcgagaggattgtataaaggctttacgagctgtccatgccagattttatctctcaagaaccagcatagcaatgggcattattggacctggattaattgggagcacactacttgaccagctaagggatcaggtgcagtttctgtagacgattttgtatgcatgaatagtttttttgggttttaccttgtttatgttttggtgtgtaatttggcttttattatccttgctgtgaaattgactatttttttcaaatttaaaatgccacttcaaggaaataatgcctataattgaagaataatgtttagtttttgttgtatggttcttccaaggttcttatctaattgatatcagatatttccactgtgtttctcaactacaaatgagtgacatgtgtgttgatgctggcattgtagtttttgatagggactagttaaagggttattgcgcagcctgcccatgtgggcacggggctgggaagcaagatggaatgttaggatccaattgcaaggtatgagacttgagtctcatatttgaagtttaggatgtataagactgttgactctccaaactacaatgactcgcttttgtggtgtagatctcccaaggttcttatcattatacaagatagagaaaattcagatgattgctttcaaaacaagtaattgaaagaaaaagaatgagaaattgtaaactaggacttaaatagtaaagcacagttacaattggcttaactgaagtttagttagtcttcttaatggctgtagacagctgaaattcctattgtaagcttgcagaacaaggtagctctagtatataaactcatcttcaatcagatagtaataagtgattcattaatcaataacagaaaatagattcagactctctctatctctagaattttattaaatattaataggtttcttatatggggtatttacttgtctaactctaacattgttatgcataaaaactataaaaagaaaactacgtacttcattgcccagaggctccctcactatgcgaaggtaagggagagggatattgtacgcagctttacccttgcatatgcaaagagactgtttctggattcgaacctatgaccaacaagtcgccaaggcacaactttccggattctaacattgttatgcattgggagattttttttttatagagatttgatacctgacaagctttttacatttccatgttaaaatatgttcctggtatactatagtggggtaacttcattttatcatgttaacatactataattgaaatatgtggcaaattcacatgacaattcttttaatgcaggcctcaaccctgaaagaagaattcaacattgatttgcgtgtaatgggcatacttggttcaaagtcaatgcttcttagtgatgtgtaagttaaccactctgactgaaatatgtctttgaatgataattaaatttcttgcttgtataactataagaggccttttatgtgagaaagcagacttcattttacacttcactccttttactgtttttggaaagctttattgtttattatatatcatttatgtattgttatttggatgaaagaagattcttatatttttaagtaatccataataacatgattaggtctcctacatagaatggactcaaaatgtaggcaatacctgattgcttttggggagccatgtttcttgatatggatggtttttggacttcctactttggtttgacaactctctcttgctaacaattatgaagttaatctgttggcaagaggaattcattggttaatacagtggtcctggagctacatcaacaaaattcatcctatgatttgttggttatatgtgcattcttgaagttggtttttgttcaatcattatatactattattgctccttgcaggggcattgacttagctagatggagagaacttcgagaggaaagaggagaagtggctaatatagaaaaatttgttcaacatgtacatggaaatcattttataccaaacacagcattagtggactgcacagctgactctgtcattgctggctattactatgactggttgcgcaaaggaatacatgtagtcactccaaataagaaggcaaattcaggaccacttgatcaggtaaagtaatccatattgttcttttgatgtataacatgtttgtgtttgttgttgacttatctcatgtaatcaatgctataagatattttttctgcaagtactcggctgaaaatggaaatttccagacattaatttggattaatttattttctaattttttatttgttttgtttttttataaattaaagaataattcatttaaaggaaagggaaatacacatcatcacattatcaatattagggagtttggataggaagcttttactcttatttctatcatttacttcatacctctatccactggcagctgtctattttttccttttttcttttttaaaatcaaaatatcatcatgtgagtttctgtgtcatttttgcagctatcatatttgctagtaccagagtaattgtaattttattgtccagcagttatatggctgtcactaacctgtagttagctgcgtcagactcagcatagtattcagtttggctaaatttcaaagtgataagctggttattgaagtgcaagctaaagttcactatacaagactatggagccaacaaaattaatgattcaatgcctcatttcagttttaaacaattttctcactcttttctctgtttctctctctaaacccaggttcactggactctgttgactagtggtaccattgttctaacaggaatcatttataagtataagcttgttacatttaaatgttgatgtcaaccagtctgcaacttgttctcttgtcattccattttatttagcaatttggaaatttattgctttatacaccacgtgatgtttcatagtttagttattaacatctacgatcaaatttcatggttagcataaactggaatgctgaacaacagtaggcattggcttgggttcatgcttttctgatagaacaagtactttgaacttgaagacatgttttaataatatttttcataattttgaaagtgttttctttaagcttcagcagttgttgcttcttagtactcatgctagctttttcacatctatgctctctttatccagtatttgaagttaagagctcttcaaaggcaatcctatacacattacttctatgaagcaactgttggagctggtcttccaattgttagcactttacgtggcctccttgaaactggagacaaaatactgcaaattgaaggcatctttaggtttgctttgatgtgttatttctcttttttttgtggattgacactgtcaattctcagatcttgcattcaatctcatttgtccaccctcttgcaattttcccattctaaagccaaaaaaaaaaaaatagaatgttattttgaggattattaatgactatatggcgattattcattaatctcgaccagtcaccatgagtattgcctctgaatctgcagtgggactttgagttacatatttaataactttaaagatggcccggcttttagtgaggtagtttctgaagcaaaggaagcaggttatactgagccagatccaagagatgatctgtctggaacagatgttgccagaaaggtacaatttataatatggtatatgtttaccaaattttgttgtcaaatgttaataaagttcctttatgctgcagacatattttgaatttggatttcgtttaggatttatgagtaggctgtaatttaaatgatctaaaagactatatccaaattaaatatttatatgtttgaggctgatttgatcaaacattttgaagcttgaattcggtttcaggctagaatttaaatttgatatacatctacctatccagttatcaagtatttcgattcatgctcaaatttgatatttttaattgttgacatgctgaaagcatttaatgatttaaaaacacaaatcaaaagttgataatattattaatattcctcttttgtgcctatacacaattgaaattaatattatcaatagtcctctttggtgccaatacacaaattttgttgagcaaatatcctaattttaattttaaatgtagaaataaataaatatattggtaagtattttttaatttatttattgtgaaatccatatttagttgaccaccccattctagaaaatgtttggtggttgttgtaactaatcggaaggcttgcttgtttctgcaactaattggaacatgtaggctaatcacaatgtcgttattggttcatgttagcattttgttgcttcatgtaatctgatttaaattcaacatcctgaagctgctttgactctacaggtgataattcttgctagggagtctggtttaaagctagaactgtctaatattccagttgaaagccttgtgccagaaccactacgagtaagaaccaatttctattgattatgcagtttttagttttaatatttagtattttgattgacatagatgttttgatgattctgtgcaggcttgtgcatcagctcaggagtttatgcaagagctaccaaaatttgatcaggagttcacaaagaaacaagaagatgctgagaatgctggggaagtgagtaaattctaagacagtattaattctatgtgcctttccaaaaaaataagtattaattctatgttaaagtatctaatagaatagttctaccaactgcttcatacatgcataattcatgcatggaatatcttagggtttgttttgtttccatacaaattaaaaaaaaaaaaaaaaaaactgctactttattttcattttcttttatattttcaaagatatgtacaggtaatgttgaaaagggggcattttataatttttagtgataaccgaaaagggaaaaaaaatccttacaaattaggtacccttagtttgttatatatttatttaattctgcatagtacatgacacagaaacatatagtacttatttgagacacagtaggtgggatagaaattttctgattagactgatgacgtaccaaaacgccaaagttttgcatatcaaatcttcaattggttggttaataaagactctctctccaacctgatggaaggatgcctgttacatatttcaagcaacctagatttccatatagaccttgatttcaagtaaaagtatgacaattgatttatgttgggtttgcggtctccagtttgtgtccttgactatatatataaacgtctatttttcatgatgacatctctcgtatatgtatattatgtccattaaatatacgtatatttttcatgtcctccacatacaactctgagattgttatgtttgcactctgaaggtcttgagatacgtgggagtggtggacgtgactaataaaaaaggagtggtagagctgcgaagatacaagaaggatcatccgtttgcacaattgtctgggtcagataacattattgcatttacaacacgaaggtataaggatcagcctctgatagttcgtgggccaggagctggtgctcaagtcacagctggtggaatatttagtgatattttacgacttgcctcatatcttggtgctccatcataactcacaagtttcattctgcaagcataattttctatgtttggtttcgcatccattgcttcgtgacacattatctgaagcaacgaagagttgcttttatgtccaaaacgtgaattttgatcgaaacgtatgatgtcgatggatatccaaacacatgcagatttgtatcatctatttatttatcttgattttctttgtaggttatttgctgcttataacgttgtaatgtaagcttgtttctcttatcttttgtctggaagaataataagggaatggaacagaactccgttacccttttttgtgagttatattgtaaaggaacggaagtaaacagaattattataattttcaacttcgctaactgcctttttaatctatagtaaaaaaaagactgatgatgatgtgcaagtttaatctatagttgagtatcgtatcctccttttgcacgtagtagatgcttgcacttacaatgtaaaaacaaaagagtaattaatttaatcattaaattattgaaagaatattttaaaataattactaaaatatatttaattaactttactgtctttataaatctaaattctgtcgctaatcaataattattaatagtttaatactaaactgaaatatgcacaagtttcatatattttgtacttggttatttagattaagtgcaaatcatggaaagaccatttttattcatggaagttgaactactttttattcttttacttccgtcactccatcagtatttaaaaataaaaaaaattaacaccacattctttgatattcttgtttcctatatattcatattagcaccagactctaacattcttgtttcattttttttttggagcataattgacgcaagtctggttaaatatgtgtttcatttttcatttaatgagtttcattccaaaattagtataatccacataaactttaactaataaaacaaagttgaaaagaatttttttagaggaaagttgaaaagaatattaaaaaatgtagtaccatactttctcctttttgataataatagactgaattataattttgattcccggtttaattttcatattttaaaaaattcccaattcgaatcaaatcctcaattttatataagttttatttaatttattttggtctaattaaattctatatctaatatatttatttaagataccgtcaaaatcagtgtcgttttttggtttctaatatttgacatttgctcttcacagtttgaaatcggtgtcaagtatctatttcatttaaaagcaattattagttgcaatcaagtaacgtttttaatcttaaaaatgaacagtatattccctgagtgacgagttctctttctccaaagaaatgtgctgcatattctcaccaaagaatatactatgttcatagtatgactacaaacaagaacttaaatattttgttgaccaattaagctcatttctacatatcacatccgcttattattcattcaaactgtatggtcctcacagcaattggggtcctcacaaaatacttgccatctgtccatgttaggctcccaaatttgtaatctccatgaaacttttgagttgacaggaaactgacactaaagttaaggattcgtgcatctgagttgaaactcaaagtttgaggttcaactctaacttttatgccatatggaacgttcactagagctttgtagactgcagtaatatttcccacgtttgtcactgttctcattactgttgcagctctcttcaggtttggaactgatatggaaggaaggttgaggttcagtttttggtgttttcctttcttacaactggtggtggtcttggtcactttgctaatggatgtactactgtgacccatggaacataggaattgaacataatcctcagtggtgatatcatatatcagtcctggatccagtgctttgttggggtccacgtgtccacccccaatatcaaaagggtctgctgccttatgtgtggaaccctcttcagatataagacttccatcagttccagtttgagatgctacaatttttaagtgtaacaattaattagatacattggatacagactattatatgtaataatgtaaatatgtaattttaatttgttgatttaatgatttctactgactcacctgttgtaaccaaagctgatcttatggctgcaggtgaccaagttgggtgtttggatttgatgagagctgctattcctgccacatggggacatgacattgaagttccagataggaatgcaaatccactactccttgtagtgccttttggtggaaatgcagccaaaatgtccacacctggtgcagctatgtcaggctacctccatgaatcatcccccaaagtagaagttaatgatgacatcatataattaaaaacggagtaagagcaataaatatttatggtaagttgttgactacaatttacagatcatggcacactagataaacattttttaagcacgctcaaatcaaatttgcctttgttgttataataaagtatgaactatatttaattgcttttgtctcaaaatttccgggaaaaaagtttggtctgattgaataaaaacaaaatcatgtctgcaaatgtggtccagatatacctttagcactgttggagacatgctactgggtcctctagatgagaaagatgcaactcgtggtgatgtacattttccaataacagtctttggaaaacttaggtttgctgttggaaaccttccagataagcataatattaattttaactcaatgaacattttataagccaatgttgtcaatctaagtatattagctcaccttgatcttctaatataggttagtatttgtgtccccgcttcataatctaccttgatacatggaaatgaaccacattgattgagtccatcttcatgatattgtgcatatactagtccaactcctccagcttccttcactgtaagtgctgcagaaacaatgtcctgttgatctgatactgaaaagcatagaacaattttgcctgctgccattgttgcatttagacttccagattgacaatccttgcttgaaaggcagacacgaacagtagatataaaatgtacaggaatttgatataaaaaaaacagtaaaaatgaaagaaaaaaaaagaggtctcacgccaaattatctgatgggtctacagctatgcgttcagaatatgtgagcccaacagatccaagattgtgttttccaatatcaatggactgtccctatataacaataatcacaggtttaaatatgtatctaattctcataaatatgatttcaggtgattttaatcctataaaagtgagtttaatttttatgcagtatcagtgtaaaaatttgtattgtcaacaaatcaaaaattgtttttgatatgatttttgtaaaaatcaacaaactcaacgtacataatattttgcgattgaatgacaataatttttacattgtcaatgcattgacatagattattagaaatggtctttgacattactaaggaggtgacatgaaatacgaataatcatgttacattagtgatcaatgtaagataacatgacttttttgcatgtcacgtcaccacttaataatgacaagaacattttaaagaaagttgattaaaaatttgcaagaactaaaattagtggaaattcttgttgaagaaccaaaaccatgtaaagtcttattttttttaaacatacatatataacacatttaagacagttgtattaagtgttagcatatttgaccgggttgattcaaaaatagttgtagcatacccacacagtgcggttatttccaagggtgatggctgctggaaaggccctatctatggtggtagctccgactgtgatgatccatggtgcagtatttgtaacggtttgagagacaggaccagaatttccagcagaacaaacgactgtgatccccttaaaagttgcatgaaaagaaccaattgctaatgaatcacgttgatcaacataggagaacaaaggaatggaaaagccaagagaaacagttaagacatcaactccatcatgtatagccttatcaaaagctttgaggatatcagcatcagtgcaatctccaattggaaagtcccaacaagccttgtagatagctaagtgtgccaacggtgctcctcctctggctaaaccagaagcaagtcccctataatttgcatttcctacaaagtaacctgctgctgtggaagctgtgtgagtgccatggccaatggcatctcttgctgagagatattcatcagtgttgtttccttggaggaatttcttagtctgatcacttattcctttcatgaaccatctagcacctattatcttcttattgcaattggtggagttgaagtgctttcccccttgacaaattcctttccaccttgatgggatttgtcccattgcttcatcattgaaacttggtgactctggccaaatgccttcaagaaatcatatttgtcattggttacattgccactttccaatgccctgcttagttatttttgttaaaaggataattaactactagtactacctgtgtctatgacacctatgatggttccttcacctaagttgctgtcagagaaagcagtttttgaagtggaatgatggacccccataaagtcccagcttctggtagtatgaagtttatgaatgccatttggaatgacagaaactaccgcaggaaactctgcattacatggtatataatataacttttgaaatgttctaaactgggttaaataacaagcctaattaatgcaaggatcattcatacttgctattgcttctgcttgatattttgtcaatcttgcagcaaaccctgaaaaaccatgcttatagctgtaaagaatcgaattctttgcagctgctttgcttcagaacaaaaagaaaacacttaacagttatttttttttcttgactcttattaaagtaatagaatatcagctccattagaaaatgagtatgtgagggacacaggccataccttcctaggagtgatgataacattttgtggtgatacattttagtagtgtgtggattttgatatatcttatctcccatgtatacaatgtgcacctagaagcatttatttaataattgattgtgctcaatgacatgtatttacatgtataccaaagcagaactagaaacttaagttgcactcacagagcttgtttcagaagagttgaccagagagtcttgcagtaagagaagagcagaagcaataagcaattgggcctttcttgaccatctccagtttcttgaattagtatccattatcagattatctaataggaggagagtttcaaaggctttccaaatgcataaaaacatacaaagtatgtatgatgcatataatgtaactttttgaaaataagaaaagttgggagtcctttccttttgtgcagtgcactttttaattttttggcccaatcggatgaaaagtatgcacaaatatcttcatcatcagcgagtgttggggaggaatatgtgccagttagtatactgcttttatttttatggctaaagtatactttctcttgtcttatttttgtttgtttcaatttagtctcttaagtttaaaaagtttcacttctgtattttaaatatttatgttagatcaaattggttatttcatcagttttgttatacaaattaatgatgttaattttggcctatttgctaaatgtccatatgatgtcttacagttagccaatgtcaaagtttttaaactcctaatccgtctgtctaaaaaaattaaattcctagtccgagttagcactcattgaaggagacaaatctctctcattagtacctttttttcataggactcaaatcaaaaccttaaaaagaatcaagctagagtccacttggaataacaggcattggtagtatacttctttaatttgagtgattaaattaagcaatcaagaaaatcacacaaaaaaagagttagacattaatgccagagatattaatcacagtttgatctgattgcttatacatctctaatcttttgtttgtaaaattcaactctagctatcaatgctttttcggggtatagtgaaatgatgcagatcataaagtggtgtagtaatgtagtccaaaacccatcatcatcccacgattattgaaaccttttctttttctaaactttgagtcccatcttttgcttttaagtcatcaatgggactggactgtagccagtcttttctaatgcaaaaggaaaaggggaaaaaaagcagtttcttgagtgtttttagtgttgtcttccaatcaaaattagaattttacctctgtaaaccgaaacttgcattaaatgttaacataaaacaaggagatggaactcatattatgattgaaaaataatgtcaaaagccatctaagaaactgcatcttaagttttatacaaagcaaaattgccggagagaaaattctaagcatagcaaatagcaaaaaatagcttgagtaatctcaataaaattggctgatttggatcctgaccatgaaaaataactatatattaaataataaagagaaatacagcttaaaaaatttcgaaccgttggatgaggattgcagggtgctgcagttacttttggactgcagagatctggtccctatttggacccccttcaaaagaaaaataaataaagtacacgagtatgacaattttgaaatttacggttgcagttttgcatgatctgtgaatggatcggcctttcatttacaaccaaaaaattcagaggataaatttccttctttttctcttttcatgttgtacatctcaaaatggtacatgaataacataatactttattattttctataccgaaatgcaatgcacgacattttccttgaaattggattgcttagaatcagatagcaaatgcaagaagaatctatgccgtttttttcccactttaaaaagttaataaaatactataagcttataaaacttgggtcattggaatgaatgcagaggctgcaatcaaactttaagtcatgtttgcctacacagttcaactttaagtcaaataaatgactctgggagtaaattacaatatgcatcaaacttttatgtgacttacgtaacatcaatcaataccatttatttgttttctactttctcttaattggagtagcccaagcaataatatatatgtaaaaaataaaaagttgcacgagtaatatactagctgctttggaaattgctcctctttgtgaagaataacacctttctgagctccactttctctatacctttatcaattttcaccaatgtcattttcgcatggaatctttccttccaataatggaataggtgatttacagctggattacaacattttccaatccaactagttactgaaagttcttgcaccaaattctctaatgcataataacttgctaactacaacttcaacaaagagtatttttggaaagagacgaggagggtttataaactagtttgaccaaataccgttagcatatatgatctcatttgattcaattaaaaactaaatattaaaattgtaatatattatttatcttgaaatttattgattattatattttttttatctataaagttctataatattgtgaatttttctttttcaattttattttcacaaattttgctcttccacaatttttttcacggattgatcatatttattatcttataatttatttgtggtaattatttaaatttatttcttctcctcaaagtcaatagacgttaattatcttatttatgatgatttatttttgacgtttcacccctttttctttaaaaaaaaaaaagtaatttaagtgtattgatgagtttcacccctttgtaaaaaaaaggtattaaaatgtattaatgacacgtttatgacatattgacatcttcctctctcctctctgcttcatcccatcagtgtttttaagaaacatggatttgtaatattttaatataaaaaaattgaataataataattcctcctcttacttattaaataaagaaagtatttgaaagtttttaaagttttaaaacattaaatatctttatttttatttaatatttttcattaagtattagaaagattttcaagacatttgtattttaaaacttgttcgtaggaacaattgcactgcttaaaaaaatgtcttttaaaaattactttcctactcttgttttggatcttatgatactttcataaataaaacattgttttatctcatacaacatgtaattgataaatgctgacattttatgaatttttttataaaataaatctatttttgaaagtttaacattttttttaaaaaaaatactatactgaaaacaaagtttaaaaattatattgaaaacaattttttaaattaaaaaataatttcaatttaaaacaattaaacactcaagaaatattgtttagctttgtcagatgccaagaaagaaatagtagaacaaaaatatagctttctcctagtaaaataaaatcatatcaactattaaaaaaatcatatttatcaaatctatacaatttcactgtatttaattttttaaagtgagtaatttatgtttctttaccttcagtttcattgttttaaaaattcaatcgttcataaatgcaatatttttcacaccaaacgtaaacgtaaaacatattgttttgcaataattcgtttataaataacaaaacataacatagccatacaattcaagaatcgaagcttgtatttacattttctaaaatggctggttcaaccatcaagattcttagcatagttttgttccttgtctgtcatttctcaaggtaaatgctttcttctattgtatgaaacataatttttttatatactgttgttagtaatttctccatatatcatgatatcaggctatatagtcaatgttctttgaaagatctcactaatttccaacaagaaataaagtgcaaggaaaacaagaatggagtgtgactatcatcaataagtgtccgtgtgttcaaaagaatgtgatattaaattgtaaaggatttcaatccgttggatccgaaaagccttcacttttgaaggtcttgcacaatgtttgtcttgttaatggtggtcaaaccatatatggaattcctgtcaaatttagatatgcttcggaccaaccatttccattaaatctcatttcttcggagatttcttgttcttaaatgtagatccaagaagttttctcttacaaaccttgatgccatttactatagcttgatttgtaggcattataaatgcagaataaaacattgattcttgctatatgttgcatttgtttgtcaattcctttttgtcattcttttaattcctgtcatttttttttcacttgtattgatggctttagtttgaaatcaataataaggcctctcaaacgaaaaatgaactaagttcattagtcaaaccattgaatcattgctcctaaaaagaaaaagaaaaaataacaattgaatcattgaaaatagataaattacgatcattctaaaattaaaggaaaatttcataagttaactattttctattagacttaaatatactcattgtaatttattcgatattttgttttagtctttgtatcttttttataaaaaattgcccatggaattcagctttgatacacagacacgcgatgaagcagctgaattttttaccctccatcgtactattccttcgttgatatcattagcggttgttaatatatatatatatatatatatatatatatatatatatcaattaacttctgctatgataacaatacactaagtggtgatattaaaagagacacaaaccctattttatatggtggaaacagggaacatagtccacccaataatattgcaattgaaatttggaggatccatggaacctccactgaccaccctaagcacatgacactccacacttgttatgctaacctggtgttcacgttcttataaaaaccagcaggcacaataaaataaaaggtaacgaagtaattatctaacaattgcaattttctttctttatgattttttggggtcaattctctttcatatataattgaatctcaattatcattaccaattcaattattttcaactgctcaatctgccctatatttttgccaataggtaaaaaaaagcatctagaatgtggtgggcaacttaacatggatacggcatacgtaaccacaataaagaagacagaaatcagtaacacataacatgtgctttgttgcgaaagttatcatccatctactgactgagctttgaatcaccatatgtgcgttcacgtattgtgtaggctctcatcatgtgaaattaaaatcaccacatcacgacccaaattttaagattatatccattttcaaaaaattaaatttgttcagtatatcaatgcaattatgtattttcttttaaaaaaaatccctttatgtctctttctatcgccaccaattagatgattgttcaagtggtgcttcctcctccacgaaaggtaaggtaagaaggcttgatttctctccttccaaaatggaggtatagaaccttagctagatttaccaacagtgttaaaggatttaaattttgtaacaactatttacttaaagactatctaaccacctcatccccaactcaattgcctaaacaattttgtagatttcgttatcgtacaaaatgtttttttttttttttttaagtttcgtaactacaacacatcataaattccgggcaggtggtctcattattcatttgaccagagaacatactgctccatttggtaaatcattatttatttgtaaggtatcgagtggaaatgatttatacacacactagaccttataggtggatggagagttgaaatagatgcataacgggcaaagaagaaagattatgaaacatcaaacatgcgataaatatacttctgattcaaaagggggaaaaaaagaatataatacaattaataaaataataaatatatagactatagtccttctattcctaaaaaaagtagaaacaaaataatcatgctcacgatcagccggatcaggtaacccaaccaataaccatcctttaaaacccatccgtcggcttaaaagaatcaataaagaacgccaaactcagagatccatgtttagttcagatgagtagattttaagaacacaaaaaatgacattttgaaaataataaacaattacaaagaaattggtgatgctaatagatcaaagcagctttacaacctctggttttcttgggtattctcaagcaaaccttccactatcatatggactaagatgcccttggatagttgtctcgtttatcaatttggctaccggcaatccattgaatcaaaagagtctgcaaatcctacaggtttagaggggatgcttgattgggtttgtgagatggaaatgtcattaaatattgaggaagtgccttcattggcttggcagctcagccactttatatatgctctccatggtttcctcatcaggattgagaatttgaccaattgcctttggaatgttttccttgttaattagtaccctacggaaccatgtaaccaagtgagacctttcatctggcacagtatcatccaatgcctttctaccggtgataagttccatcaaaactactccacatgcataaacatccactttggttgtcactcttccagtagctggcaagaaacagagtaacattaaatataatcaaacgaatagagtagactagcactaataaaatgcatctaatcacatccaatgcaacattttaggaagttttatgcttgcaaaagtcttgatgctaaatggatcaaaacaagctcaaaattaactagttttaacaaaagatgtgtcaatgcactgagccaccaaggcaatgggatggaaggataaattccacagcagtgattaattgcgacagagaactaccacctaagctcatgacaatatacagcaatccaagatttgatgcaaaccagagtgttcatcacatcataaaggataattgggagtcagactctgtaaactgtataaatggctcaaaataacttgaggcatcgaccaccaagaactatgcagaaaacccctacccaactgaaaaaaacacgtgaaacaggcaaaatataacattgcaaagaaatagccacaaagaattctgaagtagccatgtatctagggatttagtatcaattactttccctttcaacttttttttttttttatgtgtggttactctattgaactacttaaatttgctgaacaccatcgaagtagtaacctacaactataaccaccaaataagtaaaatatgaatttcacaattaaggcacaattgtacagaactaaaatcaaaggctttctatacctgcatactcaggtgcaagatatccaaatattccagccaaccgtgtcccaacagaatgcttcccatctggtgcatttttaaccaacccaaaatcagcaacctttgctctcatgtcattgactagtagtatgtttgagggttttaagtctctatgaatgaagctttgctgagctaaactgtgcaagtattccaccccccgcactacatccaaagctattactaccctttgtttccaagtccaaggtgcatagccatgcccctgccactcaaacaggtgctgtgttaacgtaccttgaggcatatactcatagaccaaaagcctttcaatgccattgatgcaataccctaaaacagcaaccaaatgtctatacctaactttactaagaactgcaatctctgcttcgaactctttcagtcctttgttccccattgcaacagattccatcctcttgacagcaaatttttgttccatcatgcaactgccccttataaactactccaaacccttccctgcctaaaatgttctcctcgcagaaattattcgtcacttgtcgaagaacttggtttgaaaacgttggaccatctaaagcatgaaggtcactgcgatcaccactgctctggctttgcaactcactgggaacaccaccatatccattagaaacatggacagcatcaggtttaaaacttcctttcccattttcacgaccattaaccctactgaacttcccctgtcgcctgttgacaaaacacttccaagacaaacagcaccactgcaataaaaaacaacacaataacaactacaccagcaatccaacccagcgacaacgaagaactaccctttgcggattcacagccacttccaccagtcgaagaccctgaaggagtagttccatttggtccacctccaggactaagagctttcgcaagcaaagcatttcccagagtcaccaacttcacctttggcgggaacttgggaaccaatccagagaggttgctatcagacaaatcaagagtctgaagctgagacaaagtagtttgattcatttttcaaaaattataattaaataaaataatattaaggagtatacaaaattaaataaagatataactataaagaaaaaattttatatttaaacttaaaataatactacctcttaaaacaataataagttaactgttctaaataataaagtattttaaacttagaattaattcattgaaaatgataggaaaaaaaaaagaaaagaagcagaaaaacaaaataaaaaagagacagatggacaggaaaaatcacagcacagagtcctttaaccacgtaaactgtgatggtctcgtgggcaaagaaaagaagcagatcgaaaaacaacaacaaagaacagcattaattaataatttagcatgaactgcaaaactggtcagaagacgggaatccaacaaaattatttggcaaagaagtgcattaattatcgattctgcaacgccatgccatcaagaaacgccttcagattcctctctgaaggaccaccttccttcgctgcctcccttgccaaacccttccatttctctgcattccttctcaactctccactccccatcacctcttccaaacacttccttatttcttccttttctactatgccatcctcatgatccaccctcactcctatcttccacacatcttctatcagtttcgcgtttgtcttttggtccgaccactgaggaaacgccaccatgggcacccccgaaaccaagctttccatggtcgaattccaaccacagtgcgtcacaaaacaacccacggaaccatgcgacagaacctccacttgagaacaccacttcaccaacttccccttcccttccaattcctctctaaaacacacctcctcctcttccttctcttcctctttcactctaatcacccacaagaacggaaaaccacaacctaacaacgcacctgcaatttcctcagtttgtctcttagacaactcaaagtagctcccaaatgaaacgtaaaccacagacttcttttcctttgagtcaagccactcaacataaccatctgagacttgtaacaagtcaccaccaaaggaagtatcttcagggtccttcccatccaagaacgcagaaggaatcaacggcccgatggggatcacgttgagcttatcaacggccctcaacgcttcttcttccaaagcttcaaaagtatttaccagcaccttagggttagcttccaggtcaagctgtttgatctgctcttcaaacaagggaaagacgaacgacaacaaactcggtttcgactttagtaaaaacgatggcatgtcacggggtgaaagcgaaaacgacaatcccggaagcactattttctctttggtttcgtcgttgatgtaatcagcgtagccgtgaaagtagtggtaaaggatatccagcaccgtggcgggttcgatccagtacatagctgttgggaggttgagtccacgcgccacctgtggggcccacggaacgagtaaggtgtagagtaagcaagtgaaagggtggccctcgttggcgctggagagtatgaggttggacaagaacaccgaggcacggcgcttgagttccgaggcgtagaggttgtaatcggagtcggtgccgcggatggcgtggaagccgtcgtcgtagccgtcggagaagggggcgagggagaggccggggacggtggttgtgttggtcatgcggcggtgcatgtggagagtgatgggaatagtgacacgtgcacccatggcagtgagtcgcttcgcaaactgaaaagcggggtttatttggccttgtccggggtagatgacgaggaggaagcggtggtggagcatggtggcgctggaactggctagttaccctcttttgctgtgaattcacacttagacaaaaatctttttttcattcatatacagcctcattgaccaatttaatgtgctacaataataatatatatgtttttagttattttttctattgttgaggagttgggtattataggcattatcattataatgcttctggaatttttctttaaatcagtattttttttatggtcagttatgttggaaatcgacaatcacacacaaatctaaaaatcgaaaagagaatagggaagagagatatgacacagtattttaccctggttcacccaatgtaggctacgtccagcttgtctgtactataatctcctcaccgccactcgttacaagtcactcggtttacaaggggaatataaataggattaaaaaaaaaaccctaacagtagctattcatgggccctagcccaaactactaataaagtaaaatattacaaagaatcagaggcccccagttggctttctgctgaccccgccaacaagaagggttgtcatctgactgcgaaagatgagccatatccaacaagttatatgctgtggttttgaaagtgaagagtaaatcaagtttaaggattttgatttatcgtgaagaaaatgaatgtagttttattttacaggaaaatgaatcaagatttttttagaataaaaatgaatggagtttaattgctagaagaaaatgttccaaaacatataaaatgcacttatttcatacgtatatggacatccaatgtgaatgcttgtatgtttgactacataagaaaaatgtgaaattcttcgtcatgtcgtttgaaattgaaatacatctcttagacaatttctctgttccacccaagtttttcttcgataattcaaacatcaatgttaaacagttatcaatgactactaaaatacaagaatattatcattaatttcatcattttctatcatatttttttatatttgaaaaaaaaaaaaaaactgttgcatcacatgggatgggatactagtatcaaatatatagagtattatcattacaattataattataacagttggggctgtaagaggtttcgaatagtatgcatgatagaaaccatagattgcatgatcacactgtgttcattatacataaaaaagaattgtgtgacatgacgtttgtggattctaatctcaaaagcatcaaaagctaagtctcaccagctaactgccttcatttaattttgtatgatctacctagtagcttcctgaagagggggaccaccctccaaataaatttcctgctatggctcccccacatgcttcgtgtcatcttaattttgggttaaataattttttttatctctcaactattttagattttaatttttagttcctcttcaaatctgtccattttagtttcttatttattttcattattcagaattaatatatgtgagattgatttttatcctttattcccattccaagatcagtgactaattttgtacaataaaaaaatagacgagagactataaacgaaacaacagttttaagagaaactaaaaataaaaattgaaatagctaagtaaccaacaaaaaacttatttaattaatcttgtttattactttgtatattaagctagcccaactcagtactccctctctcacacaaaataggtcacagataggaacatcccttgcatttcatatcaataaactcaactggcacatagaaagggaaaaaaagtataagtagagatacataatattggataaaaaattagaagtgtttttaacggatttgttattaaaaaattatatttttaataaaaaaattctcaaaaatatttatgacttatattcaaacaagtttataatttttttatgtttttatgatgtaacatgtacaacttattaataataaaaagtaatatttttttattttttagattatttaaatattattttaaaattatgccatttaagttacataaaataattatttaaataatctatacttttaattataataaaacaataacaaattttaattaatttatattaaaataaatttttataataaataaatacatgtaaaattaaatattaaatttatttaaatattaaatttattttaatttataaatttttataatttaaaaaataataactcttcactaatgatacacttaaaataatatttataaaatcaattaaataaaataaatgtcttaaaaatttattaattaaataaccacttgtcacataattgtttattctgaaatttaaaaaaaaaaattcttgatttaaaaatagaaagatgaatttaaaattatagagatgtaatttaacttaataaatatgcctttttttaaccggaaccaaggatatttgatattttttcatcgatggagaatgaataggcccttacaccgtcaatattcctgagatctccttgatgttgtggaaaatatagaagcctttattaagaaaaaaaaattcggtggaaaaggaggctcaacattactacatgtaccattcaatttttttccgaatgcaatttattgcagcggcattcttgagaatttggcaatccatgccattaggaatagtctcaaatctcaattctcaaaaggttaatgtggaaacgtcaagaatattcttaacgattaaccatggtaaaaaaaaatagaatattgtttggtcaaaataaaattatgtgcaataatattttcctcactttagttgacatttctcgcattataataatctgaatcattgatttctctatcacatttactccttcaacaaattttttcaattttaggcaatcccttttaaaatgtcccttctagttacatttgtaacactagttgtttttctgtgttttgtagacttggacttcttcatatgcttatcacgataacatttgtcttatgctcttatgcatttttgtttctccttcacatgaatagagtatttctcatatattagggttattaccaaatgttcttaagaataagacaaagaacacaacagaatacatgttttatcctcatactcaatttttacatctagctttgctagatggttagttgataatctgattgaagacattcatgtgttgttgaagaacgaaaccctcctgcatctttaacacatatagtttctacttaagatatagtttgttcgtcaacgattttgacatgtattgactctccaatttctttcatacctccccttagagatgacaacttcatcacatgataaagaacgtcgtttgccaagcataagcatatggtggttgtcgcaactctctcttacaactcctctcaattcaaaacctccatcttctcaaactttgagtcgcacagtgcctctagaaaaccttgctgtgatttaggtttgatttttgcattttgcatattcataggcgatatataaattttataacaaatttttgttgatgttgataacttttcttgtagttttacaagaatacgtgttttctccttatttaaatttttatctataaaaaaaatatataaattctctcggtcccgagcctaatttttagagtttttcctattaattttaatagaaatttatatttcaacatcattatccaatcctaattaatttgcggaacttgcctcccgattttgtttttagagcgtattagacgtgattcagtttgtgtagcgtagtttgtttgttgggtttcatttactcagactcggtgtgccaaaaaataatattcaatcctactagggcaccttgtgtcagtactcacttgacaactttgctcctgtttcgagccaatgtttggtgtagctagccgtgtaggtttatggcttcagcgaccagattgtggtaaatttattgatttcgttcgatgtcttgttgtggaatggtgtgcttccattttttagcatattgggttactataggtgatgttgtaggcttaaagttgtatctgaatttggggtgtttaagtggtgatgcctctactagactggttttggtgtattggcttgtctttatgtcttggtacttttcttttttggcttgtctcaatttgatggtgctggtagtactcctcgctccgtctctgatatatgatagtagtttatatatatatatagcttaattattttaggtgtcttaggtattgcatttatgtaattttggtctttcatatttcaattgaggaaattaaattcactaaatactttaattgtgcgattttgatttataattgtaatacttaaatgatccaattcgcaaaattgaaaactagaaaacaaaattgcacacctcataaatgcaattacaccttctttaatttattttcactgatgagcaatcctttattttaacaaaaagtaatcattatggtcctgtttgtagaaaagcttattaacagcttctcttatgttataagtgtctttatgaatgtttgggatggtttttataaaaagatcctacgacataagatttttttagcttattttaataagttgtaggagtagcttattagcaagtgcttaggtgttatttttagaagggtcagctttcgaaacccacctttgagtgttccaaattcttatatatatatatatatatatatatatatatatatatatatatatatatatatattcattcccttcaccgtataacatttttagtctttcagcttttcatttttctggctttatctaaaattttgttggctttctttccctagccaaaaacattcacacgggttgtttggttatgtgtaagagaaaaaataaataaaattgagagtaaatatatgaattaaaatagagaaaaagaaatgtgagacatacgttattttttaataatttattcttaaataatattttttctcttcaaccaaacaatcctagagatgaatatatattgaattcttccaaattaattaacacatctactcgtgtgatagatcaagtctataagactatcaaaaaaacaaattgatactttttacaagcattttataatctcaagaaaatgttttaatttattcagctaatttcatgattcaaaagatattcctttcttttagatttattattcttatttttttgtttttactataaaaataggtaaataataatttagtgattttatatttttaatatttgtatggtatacaacgttatttttttatttttttagttacttttaaatgttatttttagtttgattcttaattttttttaaaattgtaaaatgaaacattttataagttcttatacaagaatgtatatccaaatactataaaattatgaaagcacttttcaacatgaatatccaaatagcaacaacttattaaatgttaagcatttgtaacataagctcttatcgaataagatattaattaagttattttttcagactggcccataatctacgaaagatatgcagctttgaattgcagttgtcatgcgagcacttctttattttaaaataaaataaaacgagcgacaagatccgcaattctaattacagtccaaactctgtatctcaatttccgcttcggctgtcgtatacttttaggagggcctttttccaatccctttattctaattgcactctcctaagtttttttttttttttttttatatatatataaaatcttacaaaaatactgctaagtggagggtaagcaacaaattctttaatttatatttaattattagttgaaacttattaaagattattttcatttttgtttagtatcgaattttttttaataaatgttttttatttatcatttacaaatttcaagataactaattattttttttcaattatattcttatttttttatctgatcttcaattaatttacatacatacatgtattatggattatggagtaataatgataaagggtgaaataggaaacctataacttctgtctttgtccctaaatataagaatattatttaaattttttatacaaaaatatccctaattattatagtctataaataatagtaattgctatgaattgtctttttctctatcttgtgaagattagataattgaggaatttaatttttaaaattaaaattcaactactattattctcttctcgtgcaaaataatttagttagtcccaataattttaggaacaattttgaaaaatattagagttacaaataaatctaatggtattaactaaattaataaattttcttaataattatgaattaattataaaagtcttatatttaaggatgaagagaaattattatgtttcttagtttctacataaaaacttttaaagacaaataattaaaaagaacaaagatcatatgagatgaagagagacacattaaatgtggagataaattcaaatttgtgatttctattaaattttaattattagaagagagtgtatttaaaaaacattgtttttaaatctggaaagtaaatttcaaaactatattttaacaaataaaagaaagagaagggaggggtgtactttgcatgctgtgaaagtcccaaagtgacgcctgatcatatctctggctaatgcttttgggcctttattgtggaccagtaacagggactatttagaacaataacaaaataaacccaacatattcataaatataaccaagctatatattagtatatcacttctatctctatttataataaaaatatatactttttataaattattatagaagaattcttaagatatgtataatattaaaaagataatattttttcttcttctttttttttcctaattgagatctaatactagaaaaaaaataggagaaatattgagagatctttaatcttagattaaaatctcaatttaaaatctattattaaagatgctctaagactctatcttaattttattgtgcattaatttttttttactaaaatattctaattcattttattacataattaaatgttgatttgaattgtcttttttctcatttttataaagataggagaagataaatagaatttcaataatattaatattaagaaataaatttaaaaaatgttatatttatataaaaaaaattaacgctaatacctaagtttaacaaactttctttaaatgtataaattaatcaacaaggttttataattagaaacagaggaggtagtataaaacaaaaggcaactgaatagcaaggtaaacatctcgaatagtaacaaatatatatattacaatttatttatatttattattatagtgtatttaacttttttatttcacaagtattgttctttaaattaaatgagaaaggatagaaaaattcagatacgatgaagctatatatgcatttattgtggtcaaacatgatccagaaaagcccttagattcttatccgaagagccgccatcttgcttgacagcttccctggccaaacccttccaacttttcgcattgtttctcaattcttctcctttctttccactccccatcgccacttccaaacgcttgataatttcttccctttctactatcccttcctcgttcacctgtttatccactctcacccccgtcttccacacatcttctgttagcttcgcattagtcttctgttccacccactgaggaaatgcaagcataggaacccccgaagccaagctttccattgtcgaattccaaccacagtgcgtcacaaaacaccccacagaacgatgttgaagaacttccacttgagaacaccaatttactatctttcccttctgttccaactcctctctgcagcttagctcctcttcttttccttcaactagtgacttattttctttttctctaatgacccacaagaaaggacttccacaatctaataacgcacgtgcaagttcttccatttgcttcttgggcaacacgcaaaaactaccaaacgagacataaaccaccgacatctctgccttcgagtccaaccattcgctgcatccatcagagacgcggaagatgtcaccgccaaatgaagtatcagtgggatctttcccgtccaagaaggccgagggaatcaacggcccgatggggatcatgttgaacttatcaacggccctcaaagcctcatgttccaacgcttcaaaggtgttgacaagtattctgggctttgcttgcacgtcaagatcatgaagctgctcttcaaacattgaaaccgcgagagagtcaatagtagggtttgaacccaatagaaatgaaggtaggtcccgtggtgcaagcaataacggcaatcctggcagttcaatggaactcgaggggtctttgattttgcctttgatgtagtcaccgtgttcatgaaagtagaaatagaatatgtcgagtatggtggctggttgagtccacagcaacgccgtcgggaggtgaaacccgcgcgctgcctgagctgcccaaggaaggagcacggtgtggactaaacaagtgaaaggatgaccctcttgcgcgttgaaggcgatgagattggtgacgaattcggagccgcgacgcttgaactcggaggcgtgcagggcgtaatcggtggaggtgtaaccgtcgtcgtagccgtcggagaaagggagaaaggagaggtcagggagggtgggtttgttggtgatgcgacggtgcatgtggacggtggtggaaacagtgacgtgtgcgcccaaactaacgagacgctttgcgaactggaatgcagggtttatgtggccttgtgctgggtacatcacgatgaggaagcggtggcggaacatggtgcgtgatattgtaattgcagcttaatgatttgaaatgattgattttatgttcggaatagacaaaggagaaaactactgcggtgggtggaagaagaagaaaaggtagtgagaactgagaagtgataagaaaaaactgaatgtatatatactgataatcaattaatcatagactacgacttgtcatagtttgtcatttgtgacctttgaggtgacgaatacgtagcggacttcctcaatctatcttcatcccttatcctacattttagtcaataggagtagttgaaaagatagattttctgagaaaaaattcccttcacagccgacacatgtttgttagtggttaaaaattaaaatctttaaactattatatgtaaaattcaataaacaatatatataaaaacatattattgaaaaaataattattaccatatatataattttatgtttgaatttcttttacacaattttttaatgaattcttttacatcagattaagaacaacaataaatatattatttattgaaacaattttattaaaatatttttattattctcaaatgcattactagtaatcattgagtgattaatagtagtggttgaaaaaatggtaagcataatattcaaaattattatatcaatgcaatttatttgacatttattaaatatgtcatttttgatatttatttgttaatttatccgttagttttacagaacattttcaattaaataagtcaacttataaatttttaattaacttttcaacttttaacttataacttacaaatttcagttatcttgtcaatcagtttgtcaaacataatcttacgattttgaaaaaactatgaaattataacattttaatttcaaacatagtcttacagttttaaggaaacctatgaaatcataacatttaaatctcaaaaatggtcttacaattttgaggaaacctataaaatcataacatttaaatttcaaacatggccttgtagttttgaggaaatctattaaatcatagcatttaaatttcaaatatagccttatagtttcgaggaaatctatgaaatcataacatttaaatttcgaacatcctaatcacaaaaaccattgccaatttgtgtcataaaataactatctaggtcagtttttttctttaaaaaaaactcttcatttataatttatatatgaatttatctcaaatagctgcaaatgaggacttttaaaaggtggatattgttcctttgaactcaagcatccttgctcatgcttttttactttataggtgtgacaagtttgttgaattttgaaataaatgaaggagaattaggaagagtgagtagaggaagatgaagatgggataaagtaggggatagacttaatatttttagagagaaaaaaaaaaaaaaaaagagggaaggagagaacgagaggtcaagtcttttacttcttaatttgatcattatatgtttgtcacctttaattataaatcaaactacaatgttttactaaaataatatcataatataattttttattataaatataaaatatattttaaatatgtatttataatataattttatattaatttatttatctattataaattttagttatatgaaaaagtactttcttattgtttattattttcttaactattctgaaaaacaattgataagaaatagggtataataaacaatgaagtcgaaaaaaaaaaaataaagacaaaagattataattctaaaggagactaaaatccccgccaaaaggaatcctttattcccgccatgaaatgcctctcatatccaaccattgcgccaaatttcgcgtatccaactctagcgcgcaaagaccatggacaccgtcccaagctcccgtaagcggaaccacccttctggaacactgacccgcaccagatcacagctctatcatcaccggaaccgctccggtcaactccgcttcgatcctgttcccgcacaggacgaaccctgcgccgaactccttggctttcgccgaatcaattgcaagaaaccgaagcgcgacgacaaggagcttcctcgccctctgaccaaggaccttcgagctaggcgagtttattcccctccgcaatctacaaaccccagtttgatcgaaagcacgtttcccaagggaagcgccgaagcaaccgagagtcccgatttggggcttttttgtgaggctcgggacttcggtggagattgttcggagaaagattgcgagggaaagaacggtggagattgttcggagaaaattgatggtttggatggagcaatgactctacccgactctgagatttgcggtggttcaaattccaaggttaacgaagatgtagggaaactggacgcagaggttcctgtcaaagataccccttctactgggaatgtttcttctctcaagagcaaatctgtaagggtctcacatgttttttaatttattttctttatggttatttatttatgcattttttgggtgaatttcatacacatgtacctggagattgaagccctgaccacacccttaagaggtttctttatgtttattgattaggccttctatccttagttgttagatccaaccttaattatggcgaattatgtaattaggttacatgagttattgtgggtgctctaggttaaaattccagtgaataacacttgtttttaaatattattgtagctttgagaacatggttttattattgtagagttgattgggatctgtttgcaggttctcagaccacgtttccagggaaagttgttcaaggccccgggttcagtcaattacagaaggttgtttccgtttctaaaggataccgtgagagatgattctggtaattattttgtgcggcaaaccccttattttttatttacttcattggttgatgatttagttgggtatgtgtgatgaatgagctaattggtctgataatatcttgtaggtacaccaaaattgggtttttgtcagaaagatgaggagggtagacagggattccaacttcttttgtcatctcaaagtcaagaagagtctaaacaagaacttaagacggatgccaccgcagattatggtgttaaaggtgttgcaagtgatttgcacaatgatgacttgaagcaattgtctagctacgggaataatcttgatcgtgctgaggctagtacggcacaggagtttggtgtcttgaatgaagaatatatacagacaactcctcctgatgctgatatatgtgttaattcagaggtcattgtcaaaccgatagattttaccagagacactcaggaaaatgccggtgaagtgtcttgtctgaaagttgacaaggggaaatattctctcaagagtaaatccgtaagaatctgtccttgtttctaatcttgtttgctaccaatttatgggttagacatttagttactgatctttgctaaactataattataacttagttacataataaaattaggtctcaaaaccataagtgatgaaatattttatgatattatattccaagaaaaaacttttgatgtagtagttagtcggctttctagcatttcatgtgtctgattttttggtaatattaacaatatggttttacatttagttgcaatttaaatatgatttgggatgtccacgcaggtgcctagacaacatttgcaccggaaactttttaaaaccccaggttctatcagctataaaaggttgcttccatttctaatggatcttaccaaagatgactctggtaactatccttgtgtattcaaccactttaataatacaaatttcattagatgttttatgcggatatgaagtagctagttgattttacagatgcatccaaatttgatcatcaagatgaggcaaatatgcatgcaaagagctcccaactccctttgtcatctcaaagtgaagaagcttctatagacgaacataagacaaacagcagtcccatgcatggcacagttgaatctaatggtttggaaaacaatgtattagttaatccttctaatgagctatctcatggcaaccagccaaaattgacaccttcccaagacttgcctgaattgtcaacacaattggacgcaaaagaagtggtttgtggggatttatctgcaccctctgtcagtgaacatacagagaactttgcgattgcttctaaagatgaatgcttgagtgcatcagagcttaatccatgttcagtaatggtggatgattttcactctgctaagaatgttgtgcataatgatggcgtcaaggaagtacagaataagatatccagacaacacaataatgagtcaccacccaaagatcaaaatatgctccatatcaacggtgatgtctctgagcttacatatgtgcatcattcaagtaaagaaaaaggattcactattgcttatgatgaaagcaagcagtttgtgaatctggaggagcatgaatctgtcagcagatttccccctgaatgtcagaccctaagtcaatcggatcccaatgtgctagatgctgaggagaatgtaacaagtttaaatcatgtccgggtttcaaatgatatatttagagctccatctgagaatattacctcagaaaaatctgacatggcaggggatagtggtgacaaagctggaactgtgcagaatggcatagttttatgttcaagaaggccttcaaaaggtagtaataaccaaaatgctagtgaaatcgaaaatggctctgaatccaagatgacgtcggtgaggaccctaaatttatctagtgctaaattatatttccataaaacttgcattaacgaacaacattatgattctacttgccactctcattgatttaactgatacttaatttttttgtccctgtcatgtatttatctgaaatatgtttgattatgtgattttgaaacaggttctcaaacgctgtccgcagcttaaattgttgaaacaggctggatctttaaactacaagagattgcttccatttctattgaataccatgaacgatgattcttgtaagtattggttcttattcttgtggaagatacttgtttagtttagtatctttcaatttttttcttggtcacggcagctgtagttctaaactaaacctttaatacttctaggtgcttcagtaaatgatcattacccaaaacttgcggaatccatggatcaaacacctcttctgccaatttcaacttcaaacttacaactaactcctgtaaatgattcaaatggctgtgttcctatggaacattgtgctggcaattctggtcctcagcaacaaacagggttgcaggcttgtgatttaaacaatgatagttcaagccccaaatctcaaattcctgaataccagtcatctcatgattcatgcaaagtgattctactgcaaaatgaacaggttgtattaaatggactatgcaagccagagagctacactgatacatcaatttctgttcacggaatagacttaccaatcacaaccttggcgcctatgattaacaaagttaccaacagagaagaaaaggcttcacctacctcgtccatgtcattatcagtttactctgaagtaaaaggaaataattctttcctgatgccttctaatgagaagctaccagaaacacacgaatattgtcagagcttgtctcaactgcaagttgtagagcaacctagagtccctgccgttgctttgaaaaaaggaattttaaaaagaaacccaagagggtgcagaggggtttgcacatgtttgaactgtgtttcttttcgccttcacgcagaaagagcatttgaattttctaaaaatcaactgttagatgccgaagaggttgcctataatcttatgaaggaactatttcatctaagaaatatgttagaaagttctgctgataatgtcaacaacaatcctgtttttgatggaagccaggtgagtactaccttgatttgtagttagtctctctaatgtgttaggtagagtttgacatgtgttgcattacctctgttccgttttttttctccatctggtcactggatcattattttatcacctagcaaaacttgttattttgtcaagcttttgatgccctttcagtttgacatgtgaattttatgactgaaaattgtgtctatctcttttaagtcttaatagatattaaattagtgtatcaagatttgttgggaatcgatcaaaagggaaatatatacaagtttttcacatgataaaatcacaggaaactaaaaattgaacatgaaagtattcattcttcacaagtatataatattctgctttgggcttaagaagaaagattgttggtcagttaattttggccatgttctatcttgagggcacattgtattgacagcatcactcagtagctttctttttaaatacatttgagctatgaaaatatatcttcattctcactattatttaattgtttttttccttgtccgtttcataaacttttttggacttaatctagtttaccgttgaacttgtaattccatccttttttcgtgtctgtataggcaaaatcgcaatcaattagcgtaaaaataataggcaaaatgcttaccaaactgaggctttttaccccttgtatgtttcaggtgaaagaagcttgcaggaaagcatgtgcagcagaagaagttgcaaaggaccgtcttagtcagatgcacgatgatcttaatactcattgcagaataacggtatgtgcatggttgttatacaccaataattggttccttcatttgaacaactgttttatttcaagttgttggtgcagagcttgcggccaccaacggttacgtttgcggttcatgttgaagaaaaagtcattcaaccaggcggataattctgtaattgcggtcttaaagcatttatcctctcatcttggaattttttttaggagtgatatcaaatataaattataaatcaggtttagtcttggaaaactaaatatcagagaaatatgttcgtccttttgaaacagcaagaaagtttgagttggagcggacaagaaccttagagattttttttttttttttgtaatttatgttattgtaaatgccttttgttcgcagttatgattcattctaatttgccctatttttttaagttaaataattttttttatttgatctcattttttaaaaagtaatactttttttggtcatgtcattagtatcttcattccactatattaaagattaatttcatctagcttaaaaaattttcacatagtagaaattaaatatgaaattttttgttaaatacgtgtgattaaatactaataatttcttttaaaattaatagaagaataccacaccattgcatgccattacaaaaatatgaataactataaaattgttggaatgattgcagatgtgaaaaaacaaggatttcaagttacttgagttttgaagtaagcttcttagagtgaatattttgatactcataaatttaaggtgtgtttgatttagaaaatagaaatagagattatataaatagaagataaatttttgaattaaaatagaatataaaaaatgtaaatttcacataaaaaagtacaaaaatccttttttattttattttcacccttcaaaataaacacaaccttaaatagagaataaaatgcacaacatatgacactagcttggacaaatgtgaaatttgatgttggattttggtatttttaatattaaccattcataagatctaatgattattcattcttcttacgtaaaaaaaaaagacttaactgtcttttatagattctttaattcctaccaccgtaaataaaagaaaaatataaaaaagtagaaagtgaaaaaagaggagatagaaaactaaataccctaaatttattatatttttcgcatatataatttatcttcgttttgtttttcttatttatattttctcttaaacgcacctaaaataatgaattcctcgtataaccaacaatcacttttattgcatttaagatatttttaggggtctgattctctctctctctctcttcaagaagagggatctctaagtacaatcattggcacaataattgtcgatacaaacaaaattgttagtctgattatgtttggccaaggggataacatttgctcagtcaaggtatgatggatcacttttccggaagataaatgcttctttttttttcagctatgttatttatatactttcttccggttttgaatagtaatcaaaaattaatttacgttaattgagaaaatatgttaatattatttatttttattaattatatttaaaaaataatattttttctaaactgtcctttattgaaatttgatataaaagggtcattagaaatacaatatcaattaaatgaaaaagatgtttgaaggatcatttcattaaatagagtaaaattaattaaaatttatttatattgtggacaatttttttatattcaaaattaggggagtaacatttagataatacagtatattttcaataatattattattttatttcttttaattactttaattattttattttatgcttttccccctttttgtctctttttattgtaaaaatcatatgcagtaattttttttataaaagttatacaagtagaaattttatttttctctttatctttttcgataatattaattaagaagctattcacccctgatttaagtggcttaaataattaaactcctttaatgttgactcgaaagaaagagatttcacataatttctcatgtaatatgtctgcatgcatttgtcttaccctacgattaaggttattttctctctctttatttatttatttgtttgttcttttttgtccaacgatattgggcgctctgcatgttaatataaaatatatgaaaccttttgagcatgcagaatattgatgttttgtttcaatttggattctatcaagtacttctcgccatacaattttaaaattatattcatcaatcttaaatatgtgattgacggatcataaaattatattaaccagcagtaaaaaaatatattatattaaccagtttattactttattaatttaattttatcgtaatcgttaaacgtaaatgtatgtctacattgtctagaaatttttggagaaaaattggaaagagagataccatagaggatcatcaatggtggaaagtgggatagctgatagtagaggatggttcaaaatctcatttgagggaaaaattctctttgggtccatcttattaatacattatttaattgatgaaatgtatacatgcttgggaagagaatatatatatatatatatatatatatatatatatatatatatatatatatatataaccaacaactgtctagttgacaatgatggagttatttaaatatattaagagaaattcaatttctcatatatcttgcatatcaaaaaaaaattatttggaaagacaaaattcaatttaataattttcatatatcaaaattagttttatgactttatgagatatcttactttcaaaaaaaagaatatctatgtatatatatatatatatatatatatatataatgtacgaatgaaattactctaaattattcaggccacccatttaatttccatattctctttagatctcttaccaataatgcacagaataatttttatcccaaatgttaatgtttttatgtgcttaaatttgaatgccccattttgaatcctctcgtttaatcttatttcctgcagccatcttactaattttgaatgcccagggtctacgattttttatgtcaatgtggtatttctgacagttgattattaattattaacattccatacgagcaaagtgacgttgatcagtaccagaactacagtgctattaaacttgactacacctttttattatatgtacagatagaaattgattccaacatgatcaatttcacagggtggacgagctaggatgagactaactgcccatattgacaagaaaattaaagtggtacaaagaatatgatttattattatgaccccttaatatacatatacattagcaactataaaatagaaactaaaaaaaacaaaggaagaaaaaaaagacagaagtcaataaagaatctaagacataataaacatagcatattttacatagacgattcaaatccaataagaaagtggccattctcttcatctcttggaaccttcagcgtctacattcagcaggaagaccttgtgggaatcgcttgagatcactgcagtagttatagatcatgaagtacttctgaacccatctcagtcttcttctgctataagcatcaagctcatttgcctcatattcagcaccagaatttgaaatggaagacctggatgagaactcagtggctttgaaattgcggtagtatgctgtaaagggtgctttggaccaatcagttttcaccaatcctcctctggtggcccagtcatcagcattccagaggctagaatagattctcatgggctggttctttggaaaaggaacaccaagagattcagcattcttgaatacccttattggtgtgttatcaaccaagaatctgcagttaacccaattcatgatttggttaatggattttggtgaaaacttagcatagagataaacaaagttatatttctatgcaatttcagtgaaaacaatttacactttcaaatggtatgacttctagttcaaagataattgatgtcaaagtcaatgaacttaacatatataatgattatggttgattgcaatattagttgatagactatttattaataaacaaaaaattgtattttgaatatttgtttattatcacttacatgatgtgctggggcttccaaatgatagaataagtgtggaagtttctggtggggtcgaaccagagatagaactgttgctccctgttacctttgccttgggtgaagatgtttgtgtggagaatataagggtccccacttaggtttcccaaaaactcgaaatcaatctcatcatgtgttggcccttgggatgacaactgcaccgcagaaaatggaattactatagttattgatatggcctttgtgtgtggtagcagcacaaacaactcgacaaagaaaaggacctcattttggggaattgtgatgtttgttgtttattaacaggaatttaaattgtgtgtatgcataggaatagtatgagtttatcaactaaaaaaagccttagattttttattttttttatcaattcaaaaccagaaagtacattatgataaaagtagttcattaatattacacgagccttttttttttttaatttgtcattagtttatgctatgaaccgaagttttcaatattaaaagttagtaatgttttggactaggtcaaagttagccaccttcccctgtcacgagcgctagttaaattcactgcttaaaaacgaccaagttgattaatgtatacgtcaatgtttgaaacagaaagcagcatggagtgaataaataaagcattagttgttgacaaagtaaaattctgtagtctaacttgtttttgtgggtttgctacaatagcattctcgtgaatgtacagttgagtttgacaaaggttgatgtcttaagtgaagaagcggtcaatagtagtcgtatttgaagacaggattttatcatgttctttcatgaagaatcaattctaaagcaacctaaaagaagaagaagaaaaaacatatacacacatacaaaaaagtctacagtatcactgtattagctcatgaagaaggaaagaaactaataatttgaattagtatatttttcttatggtaaaagcaagggtaaatgagtataccaaaaaaaaagaagataagaaacatgataatagcacaatacaattttttaatttggaaaaaatagaaaatatattgaaatatggacaaaatttaaatacactaaaagtattattctgtgatcagaattagagttttacttcaataatctaatctgtctgttgacatttattacaaacctatattacccaaattatccaggtaaaactgtaattttgattgaaaaataacactaaaagtatcaaaagaaatcatatttaaattgtgtttgaaatttttgtttgtactttgtagtataaaatattgtagtaatgaaattaaataatgtattgcaaatattaatgaacatacgtagtaagcagtgacagtgccagcagagttgccagcaacgagcttgagctgcatatcaatcctcccaaataggtattctttctttgatttgaagccagagccagagactttgtcaagggaaagagatagaagctggccaccattgaatatcttagcacggtcaccaccccatgttagatcaaagtcttggtagaagctaccagcacaggtagcaaccatagtgctaaccattatcccaactagcataagaacatagaatcgaatattgtgagtagaaatagtagccattttggacacaaaaaaaggagagaaattgtgcttcttgtgatgtgagggagtgtgttcaaaagaggggtatatatatatatatatatggaggtggggatttgggtatgagactatggtgggacgcgtgaaggagcaataactggggctggtgggaccaaaagctggtgccagcttagcaagttttgaaagctggtgcctttttgtttggccattggttatacttcaatagattttgagttatggtttttgggtttgtgcacaggatgctagtattattcagtatgggcaatgattgtttccatgatattactcacaaatgaaaaataaataataaaaaaggatttaatcccggaaatataggggtggaccccatttttgtatgatttggaatttcataaaaagagagaaaattaggtgatggatggatgccaactgggtgtgatgtggaagcagaataaagacatgagggtattttaccacttcttagtaccatcaatcatcaattatgcatccacttagatggtgccatgtggcggagttgtactgagttattgcccctaggatattgactaaaccaacacctaaattttcactgttaaataatcttcaagtttgtgacatatagatatacatattctttgatgttggagttaaaattcaaaaaaaatagtcacaagattgccaatgatatggcatggttatccacttcggccatgctgataactctttctgcttgctttgtttcgggttgttgcattgcttgagttttagtttgtcttttccaatgcagacaacaactttggatgtgaatgacaaaacaaataaaaaaataattcaaaccaatatgcatttatttctcacgagtacggtgcatatacaattatattaatatctacttgtatgacaaattatttattagaaaaaatattagtgaatgaacaaacttcctacctgcatccacccttcattgttacaataaccacagatttttttcctgataaatggtccgagcatttaataaggaagttctacagaatcaaccttgaaatgagggtaagggcatccataatggcacagtaacgaagagtatggcaatgaatgatcgcttcattactaaagtactaataagcgttacaaattatagttattattattattcaggaaatgcagaaactagatcaagagttggagactgaaaaaaaaaaaaaagatcaagagttggagtatttggatacttaaaaactattcattagtgccaatcatcattgaagtgtagccttgcatccctctaatgttaattaatcaccactaactagttattggaataaaagtgcaaatttattggttataacttataaggagatatatggtcagtgggaatcaacttatggcaaccagctatcagaatctccaccctttccttgcaaaaagtaactaaaatgatgatgccttatttaaaaagtactccactactattttaatgaatgtgagaatgtatatagcacctcagaatggacctgattttaatgtgaatacatatagttggggaaatttaattagtgtccttcacttctttctaaattctatctaatcgaaacagaaagcatgttttcttttgctaacaaaataataaacatatcagtacaattatacaaatcgactgcataatgcatatgattgatgctttcggcaatttatgttttgcgtccttttaaataaaacctttgtttggttgaatatgagtctacatataaagtagatttgggaaagccaatacatggaatcataggtgctgcaagttacttggaaagttcaaatgaaacaaaagagtaaaacaacgagatgaatgtgactatagaatttatagacagtgaaattgctgaattcaactaaattggttggtcacgatgatattgatggttgagatattgtcacatatatgatatataggtccattaattaattaaaactacttattcctcatcaaatggcagccttcatgaaaagcaaaggaaagatcataaaaaaagtgtgatttcatccccatagctcaatgatgaggttccttctaacaatcttttatggcatatgcttttggtgaagattaaatttggtatacgccactaattagtgacaataattgtggaattaaatatcatggacgtatcataataatatttaattagtaaccacaatattctctttgaagaaggggggacattgattccagataaacaaattgagccatagtttcaacttttatccgtgaatccgtgatctacaaaccaaaccaaaagcaactactgttgctgtatttgaaatttgagctaacagtctcaccataatgaaaaatggtttgaatggtagtttcccgtatgactgcaggttgcgctggcagacagggtcagttgattgtttaaaaaccagaaatgggtggaaatggaatttggaatctctggaagcaggttctatattcattgttttataccaaatgaagcatcagttaatttagaaaaatggtactaaacaagtatacgtacaaaaattgaagatataaaaacttgcatattctttatgcacgaattacttaatttagaacttttttacacacattcctgagttatccatgagtatatctaattaatgaccgagtatctgtatctagctatgtcccgtttttctccccttagttaagttggctcgtcaaattaacccgcattcatattatactaatcaagtatttgcatacaagaatgggatatatatcaaatttgtttcaaataaataaattttggagaaaactaacaaatatttctcgtattgcatgatacacaaaaatacgaaaagaaaactacagatttagaaaaattaaagaaaaattatttaaatgataattaaaaatatatattaagatataaaatatacacattaaaaaatttatagttaaaatattaaaaattaatcaattaataaaatagtacttaaatgatcatttataagaattatatatattatgcttaatgttaattgaataaatttaagtattcttgtaaaaaaattaagtattggaaaaaataactgtgaaaattaaaaggtctcttttaaatagataataatttaaggagacaaatattgatttgatttaaaaccaaagcttataagatgtgtgtaacaaaacgagaaagggcatagatatataagttgttccatgttcagcaacgaagaagatttaaatttataatataagatatagaataaacgtgattcgttttccaactttgattttagaagctataatagtatgtttttgttatttataataatatttttaacaattttatatttcatttcttttttttaatgattaataatatataaactaactagtgtcaacagaagtaaacaagtaataagggcaatttgttgtatatcaaatttagaagagttatttagaaaaacataatttgcatttagacatgatatttttaaattttaattaaaaaatattttgtttagtttgtaaagtggaacaatttttagatagtaaatgcatacttagtaattgaatttaataaataatcatttcttaacatctctctcaagaaatttataaaagtaaatgattatttttttcataataaattaaaccaaacatatactaaatgagatataacttgaaggtccaaggaaaaagctaaaaattgagatgagatgagaccattcatgaaaacaagagaacaaaaaacaagtaaaaagtattttaatttttaatctaaaattaagttatggagaataaattttaaaataataagagaaaaataaacatgcaaacatatttttttatattttagtttaaaaaaaaatattctaaaaggcatacccatattcatttaaataaaccgtgcatgtaaaaaagaaaaggagatattttgaaattcagcttctattctggttaaaagatgaaaaagaaaacaaatctagaattcagcttctgttctcgtgaatctagcaaatcttggtttgataagtttatgttttggtttcaatgcagcggattttgctatgcgaggctatgtgatacttgtttagatatatattgggttgcaggaggctcaaactttgtttcttttcttttatctctttgatttggtgattaataaaactcatttttttttaatttagaagaattaaaacaactccctaaaaaaaaaaacaacaactcatcaagagaaatgtttattggatcttttatttcaacacaaactcttcttttctcaagtagaagttagtagaatctaagacctttgcaacaccgtcttatttagcataaacaaagtttaacgtgtatgtttttttactaatattaggaaaaattataattaccgaatgcatgaatcaattggtataaacttttttctaatttaattttagagcacataactatgttaaatactctatgtcgagtaaaattttctcttgttgacccgtggtcttgtaaaaggaaacaaaaaaaaaaaaaaaacttctattacaagctttttttttctttgtaaaatgaattaatctgaatattaagattctagctcaatgtgtttagattaagtttcaattctactaaagttaagttgaagtccaaagcaacaaacaattacttcaactttttaaatttttcatcatgattttagaggttaaaatcgattctaacttgtaagagatgtacaaacacactataagtgcatgtttgaagaaataattgacattttttttaacttaagaaattgtaggggggaaaatatttaaaataaattaacataagtgtacactgaataggtgttgaaattaatttattttatagtgaatcaaaatcaagcacaaactaaaagacagaaatataaagcaaaataatttcgacagacgtaaaaacatttttaaaaaatgccggtatgtacagcgcatacagtaatattggaaagtacgaaatgagaagttgaatgctcaaataaaaaatcaaaatccatgatccatgcatgcatgttaattgttattattatttctgggtacatgcatgcatgttataattatattagtaattgatgaacaaatttttgtttggtttccaagtctgaatcgatgggcaattgaatagaaagagacctctacacaacacaggagagtgcaccgaaaaccaaatgaaaatccatcaattaaggaagcgcaacgtcacatcgtgcattgttgaggtgggtcctacatatgaaaaaatgctttctaaatataaggattcatatttttggggtttgagaattgagatattcctttgggatgggtactcaccaactcttatcatatcaaacgcgtgatttcaatgatttcgggtaaaatgaatggtttggataattttgagttggattaaaattaatagatttaaaaaattatttaaaatttaaaatgtattaatagtataatgtgtcatttaattataaatcgttgtttgatagttttgttaagctttatactagttatttaaatagtcatatttgagattatttcttgttgattaacagtgttaaaaaatattacatgaataacgtgtggaaagtaaattcaaattaatagttaattcattaaaaatacattaatcatttaaaagaaaacatctaatttatttgccaataattttcacagatggatatctaattatccatttaaaattatttttttatttgtcaacaaaacttctctccttgtgagtactatttgagaacctactatgagcatatgctcttattgtgatcatcattgatccaatagtttaaattattggtttataaaatacgatagatggtttatccatcatccaaaccatcatgttttattcttataattgggcggataaatttgtacatgaatatattagatgattaatgaataaatggaggtaactatcagcctaatactttgtttcaattagaaatgaaatagacaagaaagaaagaaatagaaaagaataaaaataaaagagaaatagaataaaaatgttttttggataaataaaaatagtaaagaaagaagtaaataaatttctcttcacttgtttggaagagtgaaagagaaaaataaataattatataaaaataatttgtaattaaaaactaaatttaatctaaaaattaatttttaactattattttttcttaacataaaattatatattgatattttttaatcttttgttataaaaaaatatttagttttttaagaaaaaacgacaggaaagtgagatccttccttcatgccaatttggggggagggggtgaatttttttttttagatcctacgacaaaaaaaatctccttattcatacgcaccttcttaaacaataagtgagaatttgatatctgttgtctatttctcttttccatttcttttcctcccaaactccagtaaagcaacgagtaaacgagaaagggaacaaatttgtgccatctctttatgaatacaacgtgtcttgaaattgatttttctgtgagccagcaatcatcattcatcaggaaaccaaaaaagaaaaaaattaatatttatcatccataaatggaggaccaaccaatctatgccttttggattggatatcagcctgtttttctttgacttgtacccctcacaacggcactataccccattttgtaaggcaattgtcaatttaaagttgtccatgctatcaaggaagattataatttgctgaaattgtagggtgtgctatctttttcctgcagccaagacaactgtactagatagaggaacttccttgatagttgatgatatgttggttaaaaaattatcgtgtgctaaaggtgctttgttcataagttactctagctaagttcgaagttaaaatgagaccactcgaaaggttaacgaaatagccaaattgaacagaaaaatgaatgagaccacatttaaactacatgttagtgatgaacaatttcgtgaggtaaacaaggtcagagataactaccatttgagatcttaccaccgctccaaatcaatcaatagcaatctcacgatcaagtgaagcacctccaagtggtacacgatatttcagacttcagttagtgtacattagtaataaagattatgaagtctgctaaaatctacttgataatgaaaaccaaattagaaaatgcaaaacccaaactttccaataacgtttcatattgaagacaaccaaaatccattcagaatcaaagtttttttccatttccactgtattacctcattgttgtcaatgtgatgtgatggtttgttatgcccatcgctcgtggaagtgagatgatcaatgtaaggatagaagagtttgcagtcagaagtttgtcctatgcacaaaacctaaataattgtttgacatgtgctatggattaaaagctaatactataagcataaaaggtgtcatgaatttgatcatcatcctgccctactgctcattggagtcgtctgaaacatcaaatccaggaggtataaaaataacatcatcccagttcgatgtagaattttcctgcaaaattattttatttagtctcaatttacaaattagattaaggaatatagataattgcaaaaaatcccttccctcaaaaaagggaagtaacaaacacaaagggttaagtgaattccatcttctactgtaactttgacactcaccttcatttcttttattacatcctctagagtggcaacctggaaaataaatcatggtgattcctctgaaacaacaggtcatacattgaagggaatcattgtggtctgtacctggatatcgccttttctcatagtaggatttaatttgttctgctcaagggctgccgatttaagtgtattttccaagtcctcctgtgaaaaattcgtaaggtgagaattaaaaaaaattcagcttcatttctgactatctaatctcaggtaactcaatgcgagcaaatcaacaatacctttctgaagaaaagtggacgaaatctcttattttggctcttcaatatcagacttctggactgaaacttaccaatataacaactcaaaatactagttaagggattcacatatgaaaaaaattaaggtatcatagcatcaatagaaatgagtgcaatcacaaatgataacaagattataagaattagtgctccaaatatacttgtagaacagtagaacaggtccagttcatagtgtctctaatacagtatcaactcaatcaagtttcttcataacacaaacataacaaatccgttaaaaaaaccggcaaacaaggaagcacaggtacttcaaaatataagttttacctgtgtgttagacacatattcgtgtcaaatagcttctttttttttactttatatttaaattgtttaccaatacatatggaaatgccacaaaaactagaaacatgatagccttttattatgcctacaatgactcgtgctaactgtaaaacaccaattctctcttttgattcaagatttgtgtatttcgttttaattttatacttgatacttaatttgtgttatatgcccataatttttaaagtttgatactcatttcattttgtattgtataggtgcctcgtgtccaatgctgtaaaaaacatgagtttactcgttgactcgtatgagttacaagttttgcaccctccatcgagcaaacttggaggaaagatcggagacactgcggaatggtcatcaagagtgggtttactcacgagaacggtggaatgttaactgttccgttcccgaaggtggctttttgtggcccagtttgaacacgtttaaaaaaacccaaatatgatgggctattcgggtcaggtttgctgacccagttcaaaaatgaaatagaagaccctattttcagaagcaaaatgatcctccaagacccctctcggaaaaattccgtttgctccccctcgctgtcatctccatcgtcgacccactctgccttcgccaatgcttccgtcaaaggtttgaactttgaagaaaggaatgaatttgttaatggggagtggctaatccgaggtttgaaagatacaggaccccaggcatgtgctagctagcagcaatttatgagtagcagtaaagtacaagaattttagatggtctatagttaggaattcatggatagaatagtggtttaggctgtaaacctgtagaggttttcggaccttgaggggcttggggtttgggttcctatcatatgagtattatagatactggttctgaatgtagaaattaacagaatgaaagaaaggcaaatttattgagcagcatcctgcagcctcctactctggatcaatggaacccagaatgaggataatggctttttaaatttaaagtaatctccaaagaatcgaaagcttggtctctcccacccactactaactaaccaactaactccttccacttacattctctcccactatttatatcgtacctcttacagcatcagagtcccaactaacaacaactctctaaatactttaactagcaatatattttcctaattgtgggcctcttgctaccaaagtactccctcctttccattttctttgacgctttagcaaaattaagaaaaaaaaaatagtcccattttgattggcattttaatatatctatgaatccttaaatatttgtttcctattatatccttaaccatttattatggagtgagaaaataaaagagatgtatgaaggagagagaatgcaattcatataaaagacaatctattaggaaataacactattttttatgaaattaaaatattaatggtattttttagttcttgtgccaaaaccttaaacatcacacaaaatgggacagagggagtaaccatgttgttaaatggtcatggccgccatggtggggaggatttgttgccaaccaccataggcaatttgtgaagggaggcccattatggcagtgccataggccacaatgaccatctgccattgacaacattggggagtattatcaatatcatattcacaaaccagaattcccatttatgaactaatattaaattgataactgcatcagaataaaagactatggagtgtatctctcactctcattctttttattgagctggttctttccccttttctcttaaataaaattataaaatcaaacatacaatctatatacacaaaaagcatgcacattgctaatagaacttcacactcaaccactcagtgccacttgtttaatgatgtttcacaagtgaagactatgttacctacacagctatgaaattcaaggactttcattattataatgatgtacttctaagacataagatcactttattttttcttttttttttttttttgttctaaaattgtatatatttatttatgcatatatgtttgtatgcatgtccttgattgttcatccaattttgcaaggtttctgcttctctctataaacagataatcagcataaaaacagactcccctgggtggggataaggttgcatgcatctacctccctgagaccccactgggtgggagcctcaaacattggctcacccttcttttccttaaaatttatgtagtattaaaatgttgcgaaacattccttgaatcccctattttcaaatagctcgcaacataggaattaagacacaaatggaatgtccagacttaaaaagctgggagaagaacctggaaaacgggaacaccagaaaagccactggaagcaaagccagatttttccctctcctgtatagcatgagcatacattatcattactgtacagctcaacgatcaatagcaaggtaaatagataatacagggattacaagcaaattttcaaacttcacatcaactatgcatgacgaattttaaaaatggtatcaaattagctaattagaccaacataatagcaaaatgactagtacaacaccagagcagtcaagctctaattctggtaattggtgagaaccaatccaaaatcatagtaaatttgtgaagaagctatctatccacacagtaatttttcccccaagaaagctttgtcaccataaattgcacacaaagtactaaaaaataatctagctcaaagagaaacttctaccttcctccattagacaacatcacatatcagaaccaatcataattccgagagtaccaaggggcctgggctaaacgaattaatacaaacactgaagagtgaagaataaggcctatttatctgttaaaggtggaaagcaaaaaagaacagtgaaatgattcaagttgtcatgtttgaaaagccagtagcataaattattcattcaattgcttctttgccatatatccgagacactacagaagtggtccatatttaaatcctcattactccaattctaacaatcatatcgtacatcaaccattaacagtggcacatgttctgttcaatcttctccccaaggtaatttcaaatgacacattaaaatcataaaagaatctcaataatcaggtttgatttagatattaggaactaatggtagcatttagggagtgtttggtaggagagaagtttttggttttccatgtttggtatgtattttaaaaaaataacattcctgaaaggatgtttcctgaaaatgtttctcaatcgaaaatttcccatggggaggtagtaatcttactttcccaagtttaatttttcttttacaacagtaaaaacatcgtattattctttattaaattatataatataataaataattaaaatatagataactcttcgattcatccaaaacttatctaaagatttccaatgtcaaccaaactaattttattcattcccagtaaacatgatccccaggattcataattcccggacatgaaaaaactttttccctaccaaacgtccccttagggtttttgaagggtttaggtgtgtgcaaggttttaaatttcggtataacagtacgcagagtcgcagagcatcgtttgagcgtatccaactatacatttggcatacgataatagtaataataaagaaacgactcacttgcagggcattctttacttgagagaactcaggtatcaatctaaacgcaacgccgttcacgttgagctgaaacaccttgttcaaagcaacggggacaactttagagccctggcgcgcgtgggggtcgataagcgtaacctggttgaggagagcctcagcgtcgtccttgttgaagcagaagaggccaaggtttttcccggaggaagagcccgagaccaagagaaactcctcggaagcgttgctgagggcgtaaacgggaattccctctaagcgctcctcgattgcctccaccgtcatggccatgggcctgcctccccagggctgggctatccgagcccatggcggcctcgcgcggttgggctggagacgggtcaggttgcccagcagcgtggagcagcgaccctgaagctccgccagagccttctggaagccgtcaaagttcatcatgtttcttttctttgtagattgcagagaaagaagatgatgagtgagtcactagtgaatcttcaaacgctttgttcgttcgcaaggaaagtatcgtgtttttttttttttttctgaaccttgaaatatctcaaagtatgattttaatttctataacaaaaaatattaattaaaaaatctttgataaacttattttccaaacgtagaaaaaaattaagttctgaaattaactacgaaaataaatatttctagaaattaaattctggattttttaaattttttatacaatttcgaaatttaaaatacgggaaccaatttttttaacactgctttgagatttagatttcgaaataatgaaatcaaatctatgtatgaacacattattgaaatgaaaaataacaaaaagaatattgggtgcgctttaaaaagaagaaaaaaaaaaggattttataatcccctattgttgtatgttgtgaatgtttttgggctagaacagcagcaggctaaggctatattgatgacccaacaacagccataatatgtgtgtgtatagggattctattactatattcctatagaccaaaacgaaaaataggaatggcaattgctattatatctccacaattgctaaatatatttccttctttttttatatttttattgcacaaatactcttttatataaaatcataaactctgtttttgcacctctattttttattgttctttgaacttaaaacttattttctcccctcacccctttttttcaatcagtaagcatttctttccataaaaaaacgtattctataatttactttccagaagcaaaattaggggcaagaggaagaaagatatgaacaccattttgcccaaaaaaagaaagtgtgaattggggatccatcaaattccagtgctacacatattgaaattaaattttcactctccccaaaggaaaaaaaatacagaaaaataaattagcatccttaaacaatataggagggagtagattctggaggtgtatttgcaagcagcgcacgaatgcacacgcaatccaacaccaataaatcaagtatgcttcctcaaatccttgttatgaataaatgtgccatgaaagtgatgaaacccatgaggaactcgagatgaaagcttgatgggaaccccgatttgcaactccaattggcaatttccacttttcttgttatgcacaaatgccatgtgtgtgaccatatgatctctaccgataccacgaaccataaagcatccagacagcccaaactaggcatggccataattaacatgaccatatgtgctcggtaagagtgatacctaatatatggttcaagttttgcgttgttgtaatgtgtgtgaatcgtgacatcaaagtgagtgtgtgtgtgtgtgtgtgtgtgtgttagcgtgggtcttagactgtagatggcttatgtgggaataatcaaatactctccaaaaagttaattttcagaaaaggaatacttttgaaaagaaaaaaaaaacgataagatgttaaaaaaagtgcaattactaaatagggaaggtaaatatatcaattgccaataagaattctatattctagaccaagcttgagcgtcactcgattagagtcggattaaacttaaaaatctaaaaccatagtgaattaaatatttactatttaacataaaatccatccatttatattgtcgattatgtcggataacaagtcaaatgagttttagatgaattagttgggtatgtgtcgacaccaaatgtggttgaaagataaagtagttattatgcgtgcattgaatagagaggaagtgaaggtaaaggaaagtgagatcgtgataacatatttaagttttattattttttgattatacaatttaattatacacaataataaggttgatatattacaataacaggtaaggtcaatgatcttgtttcagatttatatggtcttaatcgggttggggcatgttcaagaaactaaccctaacaatttttggattggataagcaaattaattaagtttaacacttctagttacatatgttctctagtagtagtatgaacaatattttaaaaaatattattataaattttaattatataaataaatatttattttgtattcaatggacgaactaaaatatcacttcaaaaaaagttgatacagtatcttacttaatttcgtgtactaccatctcttatgaattaaaagttttcttttgaatttattttttgttttttattttgaaatattcatctataatctataattacatataaaaaatgcaaagttttggtatacacattttttatccttttttattatcataactgccttcataaatctattttattacatttttcaaataacccataccgatagttatatattgtaatccacccacgattatttaacttttattatttatattttttattttttaaaatttacagagagacaccaagtattaataataaaaacatcccattatagagtattttattttttaaaacacataatttcatcatacttaataataataacaacactagtgtgttctttaaattttcaatgctcatttaactcgttagtaataggacaatggtgaaaggtttctctctcgttatcatttgatcatttaacgcaattaaaataccaatatttgttgttatgtgattataatacttctttattgtcttctaaggcacgctcctccgacactaaccaccttaactaaaatttcttagatctgccagttgggcaaagatgattttatccacaagatctccaacaacacagcacttgctaagggccccaccattgtgccacttaactcaccaaattattgtgaccatctccttctccatttctaataacttggaatctcttcaagtttacactacttttggtgcaccaatattttgcctccttaaagagaataaactatttattactaacattttctatttaggatcagtacacctaagtttgtttgtttttaatgtgttttaagatatattgaactgacctttaaaattaatttaattcatcttaaacttgcaatgacagtttattacgtgatttattatttaatattgttttttttatatattttaaaaaagttctgcagataaaatggcatgataatgatttgtgaactgtgtaatgtgtatgaatccaaactgaactactccatacatatactgttggttcgaaagcgagacgaaaccaaacccagcgtacatcaacaatcatatatatgttggagatggcccaacgtcccagaagtttttatttttaatctgttataattatttttgtacgtttaaaaagcattgaaacttaaagaaaattggttaagaagtactagtcctatcttcgatgattttaacaaactgctacaaagtaaactgaaaaatattataataatctgatatgttcgttgacttttgaataactgttttttactgttttttccatttaagatcaatgtgctctcttgccgaatagtgttattccaatttaaaacagaaattacattgattgtggtgacaactttggttataattggtacttttttttttttaagtggttatatttgatacttcttttttgaggaggttatgtttgatacttaataactggtaaaatgaaataaaattaagaaagattaaataaataaattgtcagacagtcacttagattaatcctatatacttagaagagaaatcatcctaaaaaaaagagaaatgaaataaatgaaacacattagtttatactttataccatgttttattaaattacatctcaatttggacaacctaaataacaacataaattttactattttcgtgaatataatcgtaccatatatagtcttccatgttagtataattttgcacgagctcacaataaaagcctcccatcgcctaattaagaatataaatttttaataaatacaaataagtgagaaatagtaaatgaaatgcaccaaagaccgaaacctaattgcagcgtaaccatcgtttctcagatacaaacaaaaaaatagtaatagaactgttagaagtagttgcaacgtacgcaggggacatactttctcatttggctttggacgcttacatggatagaccgtacacactacactacacatcacaaagattttactccaaccaccaacctcattggccgtcattctccccaccgtcacagccatgtaacccttccactatccgcagcggtggaaaggtcgtcacggggagaggcacgtgcagcgcatgtgcacactaagaagtgttgtacgttaacgacatgtatacccctgagaagaacgtgagaagaccgaaatacccttttggacgtacaaatgtacaagtgtttgaagcggagaatggagatggaaacggaagtttcgtgtttccatgaacagtgagtgacttacgttgtccacatgggtgcgggtccttttgtttttttatgctgttgctccaaaccagtagtgtactactcctccacttccactgtaattaccctcttctttctctgcagcttctctgtttatcttaatctaacacacacacacacacacgccccaagccttcttctgttctgcttccattccagtaaagttttgatttttctagcctccccattcttcttcttcctctgggttttcacttgttggattttcttactctctttcattttcgatggataaccaggatcaaagaagaactcacactgcaggtgctttttcttttgcattttctctttaaagggtcactgccctcatcctcatccccttttttctcccttttcttcttcttctctctcttttcctttccatgtttcattattatattatttctctttctgggttttgttggttcggtgtttttcttatgaaaagtctttgtctttctggggtgtctggttttggaaattgtgtctgtgttctttttgaagtgttttaagtttctccaggtgaagatttttatggtcttattatttttttttttgttgaaaaatttgatgttgaaggacacgagagtcatggagttcatttgtgtcacaaatgtggatggccatttccaaatccacatccgagtgccaagcacaggcgtgctcacaagaagatctgtggaaccattgaaggttacaaactgtctgcctccgagggacaaccccatttgaatggctcagatgatgaacatgtttctgatgatgatcacaaaacaccaggtggatttccttcttatatgtagtgtgttaactttaatactgagaaatactaggagatgaagtaaatcttactaactttgatgctgagaaatactagaaaatgaagtaaatctaactgatcttgacttagtgagattaattttaattacttttcttcatgtatagactttgaaattagtactacattccaaaacaaaaggtttttctgattcgttgctattttattaggtttggttgtgtcaggtccaaaatccttggagacaggcaacaatgagaagggcaatgaaggaaatggagaaaaattaattagatcagaagatgaggtgttttcggatgcagttgcagactttttggaaagtggatcgaatccagaaattaaggaacggttgcaagataatttggactcaggtgctaatgtggaaagggttgacataaaagaaacaaaattttcagggtctactgaggacaaagatttcaatggtgcgaagataggttttagtgttttacatcatatttccttttattaaattgccttgttagttttttcaacgagtatggacttgtgtgcggtaaaacattttggcctggttaattaaaaataatgataattatgtttttgcatgatttacaggtattaagcttgatgattgcaaaaaaatctctaaagcagtttattgacttaatttatatacgttgattggattgctcaactgatgaaagcaaaatttgcatcttttcacatgactgctacatgatgaacatcaataaactaaacgtgcactattcgtcttgctttgttttgttcaatgaaatttaacttgagtattatttgcttgttagaaacttttgaaaaatcagatatgttataaactatacctttttaagttaacttctgttgtaaaattatattaaaaggggggaaaatcagatatgttgttttgatttttattgatgcaaatatccaggatagcacaagtatattgatgcgcacacatgacataacctacataattattttctaagaaattattgaataggcattttttatgacaatatctcccttttactgtgttctttgtttcttctctgtggttctttcatgtctgattatctgtttcacagctgcagatgcacgtcagttaactgacaagtcaactgatgacagccaaattcaaaattctaatatttttcaaaatgaaagtgttgaagtgggaaccgcggtggagtttcaaggtcaattgtcaggccctactgtggacccattgtcaagttccattgcagacttgaggactgaggaatcaactattgtggatagtgatgttttttttggtttgtcaagtgactcacttcttggtgaaactgaagccatgcctgatatattgccagaaaagaaaatccatgctgctgagaatgtgacagattgcagtttgatatctgttgcaaaggaaactaattttaaagaaaaggatgagattaattctgctgtagatgtggttgaaattgtggaatcatctgataatgttgtcggcgaagcatgtgaaggagtgtctaaaatagcagttagtgatgcagtttccttggatcatcaagtgggtgatggagctgttcatctgaaggaaaataatggtgctgagcttaattcctacagagatgtggttgaaattgtggaatcatctgataaagttgtaggtgaaacgagtgaagaagtgtctaaaatagcagttagtggtgtagtttccttggatcatcaagtgggtgatggagctgttcatctgaaggaaaagaatggtgctgagttcctttctttgttgcccccagataaccttcctcttgagttaaactcagttgtaatgacaaatgatgctcagggagactctgcatgtatgatacagtttgctacttccagtgataacaaaaatttgcaggaaaagggagaaggaaatgttaatgttaatcctcttcctacatgtgatgatagatctgatgaagtgcatcctcagagtgagtatggagactttaaagatcttgaaggagtggtataccaaaatcctttcctacaatcatctgagtcattgaaatatgagggagatgacttgaaggacaaaattactgaggaaaataaatttcatttcaacgcaaaccaattgagtgaaaaaagtgacatcctctctccagatatggatgttatagataatagcatgaagatggagctggtcaacagggagcctacgcctaaagaaatgcatgccgaagagtgtaccaaagtttctccagccaagctcacagttgaatgtcatcaaagatcagatgacattgatgcctcaatgaatgctaccaaaactgagacaaatgaaattcgtatggttcacctttctgaagagcatggatctgatgatgtgtgtaaaaattcccagcagataagtttaccagaaggtagtttaatggcctcttctaacgagagtcagagggatgaatcctttagtgaaacaactagggcaattaacatagacagcacaagtcatcatgaggtaaaaataactgaaataaatgatgtagcttcagatggcaaggttgtaggatctaatgtagaaaatgatattgaaattatattgaaagatcttcaacccagtgacatcttgcaatctgaagtcaaacaatcaaatgccttatttaagagtgacagcactggtaagagtgatgctgctggtgaaatgggtaaaaatgaacatgatattcctgatgctcaatgcatggaaaggtccattgtgagcgatacttcattgcccaaatctgctaccagtcattttgaaagccctgctatttcagagtctttagacattgtggatgatgggcctgtgaacaagtcaaatggtacagagtgcagaaatataaatccactaccaggtgcccagaaagacataaaagaagatgaagtctatattaatatcaaactaaatgaagaatataacaagtctgttgatacttctaccaagtcacatcaagcacaagatgctggactattagtgaaggctgcagaagaccttgctagggagtatacatctcctttaactactgaaccttctgctcagcctgacagggaagtgtctggacttactgcagtgcctgttcaagatcaagctggtaataacttgggtaaacttggttcatccagagttgatgcttcagttgactcaggtagccggtgtgacagtttggaaggcaactggggctctttttcaggtatatatacatttgttgtttttaatagaaaacatttgtactgtcttgatacattctatagtagggctattgtaatatgctagggttagtcaatgaaaccaggtaatgtgatgcagtgcttgttaaagagaagttatctgtagatccaggtgctatactgcaatattacccacttttcatagttgattagaatgggtgagatctttttgcataaacttattctcaccaaagacacatacatactggctattatacctgtgtgcaattgtgcatccctgaatcttgcctggggctgaaatttccaaatgaatttcgttggtaatgatttttgcatgcttgcgaagatgcatgcctagatcttgtctcttaatgtttttcaccaattatattcacctgttgctttggcgtgatccatatagttttctctctcatcctttctaggattgtttttccttgtataaaggtggagaggaaagtcgaaagaggatccatctcttttgttgtgtccttgccttgcattatttgtataaagaaattaaactaaaatattttaatggttttttggaagaaaaatttgttttactttttgtttcatgatccgtgaaacagttctgtcaatgcaatccgatgcaacagctgttattgatgctgaaaccttgccatcaactggcttgctggcatcaacagaagcagggaaatcaaacttcaacaactcaaaagctacacctgacacacagcaatctggaaaatcagaaatgtttgaagcaccatctttaatgacattggttgatcctagtcaggttagcccaaaagccactgcttctgaagtccagaagggacagaaaacacgacagccagattccacttcacaggctgcttggtttcccactcttacacaagttgtcaatgagtctcaagggagaaagaagaatgaagaaataatagccaaggtgacaaactggagcactagtaaggagcacactcctcttaagagccacttaggtgaggctgcccatagcagcaagccaagatctccaaaaatggaagaaaactcagtgagtcagaagagtggtaaagttctggaaaagaatggttctgggttgacaactgttaattccattctgggtcctgaatcccctgtggctcaagtggtaaaaggagaggctgcaaaagaatggaactctccagcaagatatcctgctgacatcaagagagaaaaaaggaaagttaagagcagaccatactggatacaattggtatgctgcacatctgtcggtcctcagcgaaggtagaaaattactaggttctgataatgcttccactctgatggattctggtcattgacatgctatttacagtatttttctgtttttagtttgtctttaggtgcatattttgatcatgtgtcttctgttcattttggtagcctcctaggagttttgttgtatatgttgaccatcttcagttattattttatccctgcaatcatacatttttactatatatagtaacgtatcattattttggcctggacccatattttagtccggacttagttcttgaattttttttgtcccaagggtggggaaatatggtctttgtctgagattatgtctcataataactaacttgcggtttctgccttttacattggattcattcttgttaaatcctttgataatagaagccctaaggagagaaatgggtttgagagattctgctttaaggatatctcattaatgcctgtataagtagactcaatcatgcatgtgtgtatgaagaaggaatttactttcagaaatagttgttaaaggcgggagtataaattgactctcaaaaaagttcaatggccataaacatgtggatcaattagtggacgatttgatttatttttagttaatcggtggtctcaaatttttagaacgtagatatgttaaaattcagtagggaggaatctcgtcgcattgtggtattacccgagctttaataagttagacttaaggaagacattcaattgatatatcatattttaagtctttgattttaagtcaagtagattgtgtattttatttctgtcacgggaagtagtataccttttgaaaagagaagaagagatacggattaaggagtagaaaaggagcaaagtgcattgcaagaaatcgaacatgcgctctcagtatattgtaattattctagttttttaaagtatctattatgctaatgaataaggatacgttgtttgcacattaaaatttaatttatgttagtcactaaatatgcaatatatttataattaaatttattcatttttttattttacatatgtgagtgtaggctgaaaaaatatttgtaaataaaaatcttattaatgatgattaattagattttgtcataatatcattacttcgatgatgtgattttaaaataagtaacattgacttggattttgtataatctaatcatgtaacactatgtggattatataatcatatcaattaatcattttctttttgcaatttaaatttgaagacctaatagaaaattttatattttatattttgtttttaatttagtattttattaaaaaaaaatcactttatctttaatctttctaattcaataactaatttgtggtgtccatggtgaaaacattagtgggtgcacgcctagaagcaatatattttcttcgaatttcgaatcgcgttgttgctgctactgtttactttctcctccacttcctgggagagtggtaggaaaaaccaatgttattaaaatggtctagatgagaattgttgtctaggtcagtccgggctggtatttggatcgcttatgtatgctgtccagtatcgctcgcgttgacctgggttgagctcacctttttttttttcctttcttgaaacagttttgtttctcatattctccaaccatgctttccgacaagggtcatgtggctcaatgtaaacactcattttccaataagaaatcaaaagaattcactgtcaattcaaatgaagaaaataaatttgttttgaaaggatattaatcgctacgattcgaagagagaactattactttttatgaatacagcaacgaagattttgggttaggaatataataatccaatttcgaaatcaaataatgccttatttataaaagttgaaatattttgaaaaaaaattcaaaatatttcaaaaggtacacaaataaataaaacaattctgaaacttgttgtataatttaatttctaattaagtccaattctcataaataaaaagtgatacacaaaaaaaatacagataatagactaacattttaaaacatgcatttctttagtattaaaatttgaataaaaaaagacaacttttggcaaagacatggttcaaagacatttttctcaattgcataaacattactataaccactgagctaaagtctttagtcaataattatataacaaatttaacttttatagagtatcaacacataaaatttatgtttttaatatacattgatttattgggttcaactaatgtttatcatgataatgcttttaaatttggaatatagacttgtgttgttaagaactctattgttatttgatatattagataatttatcctaataataattttaaatttagaatatggattaatcaaagaatgttaactataaatttttaatatatataagatcaaaccaaatcaattggtgattactggtttgaccattgatctattaatctagattttcgatcagaccgatgactaatttgattttcacaacattgagaaaaacatcaaaatgttgttaactccttctccgcatggttgactttgacttgctcctcccaagtgagttatcagaaaagtagcttctttgtggttttgtgtggggaagctcaaggtatgaagacattcatatttaggaagttagagattaattaacatttaataaattattaaattaaaaaccaaaatataaaatttgttattatgtccttagatttgaattgcaaaaaaataaaataaactttattggatgatgtgactatatattccacatgacattacatgattagactatacaaaatacacattatgtgacttattttaaagtcacatggaagtaatgaccttgtcaaaaataacaaactaatgaatattcttagtcaatacattgacaacacaaatgttagaagagtactgtcatattttttaacactctttgtaacacattttcttctattaattgaaatccatgtctcattaatttaaaaacgagacttaacgagaaaaatgaaacctatgtattaattgagctctataaatttcatttaataagaaacaatgcatcataaagaaaatgtatattacaaacatttttatgaatgttagtaggttggaggcatactaacaatcaacaatgttttccccctctaaaataacgataatatagtatcaattttatagtagagctgacaaaatgaacgagttagttctatccaatccattggaccaaacgtgaaaaataggttggatgaagcttacccatattttatatggtattcctttttttatagtccaataaggcccaatgacctattagactagcccatattggtgcatttatttatttatttacctaaatttataaaaatctaaaataaaaattttaaaagtataaagttaaaataagtccaattaaaatatgtaacttatatttcttaagttcagcctaatctaatagacccaattatattagtaccaatgggctgatctgtaagtaagtttttgtcttaagttaaaaaatatttttctaaataatttaaaataatgacacatgtactgcgactttcacgttatcaacgtgacactccaaccaactaaactaataggtcaattatgctaaaattcaattaatattgataaatataacattaattttttaatgtatatttaatacacatataagtttatataataaattttgtaacaattaattttgatctaataattaaagtattttttacatataaaaatcatagatttaaataaaaatcataagtttaataaaaatttacaggttcaataaactgtaaatacaaatataatttttaatttaacatgtaaatacaaatataatttttattagacctgcaaattttattaaaattatgatttttatttaaaactgtgatttttatatgtaaaaaaaatactttaatcattagatcaaaattaattattacaaaatttattatgtaaacttatacgtgtattaaatatacattaaaaaatttaatattatatgtatcaacattaattgacttttagcataattgacctattaccttaattggttggagcatgttaataacgtgaagatagcaggtttgaaacttacatgtgctcttattttaaattatttgaaaaaatattttttaacttaaaaaaaaaccttaaaaccttaaggattagcaaatccttatatttgaagcctgtaataaagcggtgtataaagtttttcccttcattaagttggccctttttgaataggtagtaggtacccagcgggccaggcccagccgtggcgcgtagggctgagtcaaagtctagaaacccaaaccctatcacccaactccgcaaccattgaccgaaccacttccaccagcagcgaagtgagtgagtctcctcaactcaacaatggtagctgcaaaaccaaagtagacaactttagaagctgcaaaaccataatagacaacccaagaaccccttctttagtgtttgatgtcttgtttgttaacttaatgcaatccctcaagtcacaccctgctcttttattttccctttccaatcacttctcttcttactctgtcagatcctttctctcttctttgtcaacccaatgtcaacactcaaggaaagcacttccattgttgattatctaaatgccaagttcgaattctcgagaactcaatccttctacatctctagacatgtttcaatcagcagattcccacaaaatccattgtttgtgctcagttttttttttttcaaacaaattggattttctgaagcccagattctgtttttgatccgtcacaaaccccagatattgttcattgatgttgacaaatcttgaggcccaaaattgagctctttcagctgttgggtgtgagccttcggagttgtgcaagttcatttccaagaattcctccattttgacttttagtttgaagaaaacattggtcccttctgtggaagctattaggaaaattctctgcagtgagaaagattttattcatgttttgctcagatgtggcatgaaaggtatcaggctcagatagaaaagcagcaaggaagacgcaagtatacaaggatgaaagaaaagaatgaagagaaaatattataagtggagaattatacatggtagatgagtgaaaatgaggtaattggtgtattttgcctaaaacaacaagcttcacaaacagaggaagctgaagattgtttttgaactatagaaggaagattacatttgtttaatacatttctaacaacattagggtcagcatggcctaatcttttgtgccatagatcaaaggaattacatgcagaaaacagggcaatgggtgagttttgaactgaagattgtgaatttagatggacattggtgaactgatagaggtcatctttaagagtgcccttgagaacaattttcttgctgacctgagattttacaaaacaatgattaggatgaaattcaaagaaaacattgttatccttggcaaattgggagacacttattaaattcttggtaatggaaggcacatgtaaaagattagcaagtttaaaaatagtaggtgagtgagaagttgtgaaagaagaatgaccaacatgttgtataggcatacatgcaccattgccaacatgaacctgatcaaaaccattgtattcagaaccagatgagagattaccaaagtcatgcgtgagatgatgagtatttccagagtcaggataccaagctatgtcaatgagagatgtgggacctgctagatagaatgtgggatggtgaaaagaaggaggtggaggtggaggtggagttctctgattctgattttgaggatactgttgctgaggtccttgaggggtgtttagatatgtggtgtcatagtggtagaagcatcttaatgcaggatgaccatgtttaccacaaatttgacattgtaatcgagtttgattccaaaaagaacctttgtttctattacctctgaaggtacgatcccctctacctctgcgtccacctgagaaacgacctccaggataatcttgtgcagtgtttcgttggctgaagttggcttgaacaggggtaatctctgttttcttgaaacggtcaagcatattttcttgagccaataggaatgcttccaattcaattatagagaaaggaggagatctggacatggcagatgtgattagaggagcatactcttcacttaatccatcaaggatagcctcagagtgttctgcatcagtgagaggagctccaacagctcctaaggagtcaactattttcttgatttggagaagatattctgaagctgagcctttctttttgatagactttagttgatttttgagttgcttgacctttgcctgtgtgtgtgaagaaaaataagtctagagctttgtccaggtttcatgagcaaaattgcatcctcccattctgtttttgaatgccatgttcattgatgagaggagccaagaacaagaaggttatcttgttgatgccagtgggtgtatgctgtattttccattatgctttcttggttttctaatgtctgtgcagggactttgtctttatcaagatggtcttgaagattgtgaccatgaatggaggctaaggcaagttgctgccatggcagaaagctctcttcatccagtttgtctgcaattgggattgaaaaagatttcatgatgatttttgttgctggtgtgctcatgttgcttgtctcagaccgaggagaatcaaggatggagtccatggatcgtagatgtgctctgataacatgaaaggtatcaggctcacatagaaaagcagcaaggaagacgcaagtatacaaggatgaaagaaaagaatgaagagaaaatattattgatcaataataatctttgtacatgagaaagatatatatatatatatatatatatatatatatatactcccaaagtacaaaaaaattatggccaatgttgtcttcttggagagctgtggcattgttgggtctcatcttgcaatgctactcaaacaacagccaagtattctcatcacacagcagtctactataggaaactatgtttcgcgcactgtaggcatgggtttccatgaaaattcaagaatgcttgtccatgtaatccattcaataagtagtttgagctataaaacatttaggagaaagctggagctaattatttgtttcgatttttccaatgaggaaggcctgcaatgtttagaagatcccccaactttgcttagaacatcagggaagaagttgaaggttggaatggaattcttcttgcatacacttatgatgcccaagtcagtcctggttcatcagccaagggttttaatgtatagcatgaaggatcgcgtgcttcctcgatatagagtcttccagctctcgataaaaaaaaaaaaaaaaaaaactttgcaggaaggttcccaggtatatttatttgttgtgcttgtctgaggaggtgttcttggacaagtatatatcacagtccagagaaaaggcagaggaattattagtagcatacaaggttcattatctggaagcatagtcatatcttcaaattctgtttctgaatattctttacaggaagccttgggcaatttcgggaccacaaaccatgttggtgcttatggttttcacctccttcagttatcccctcacccttccaattgcaatgagatatatgttctgatggcaacagattcttctccctagttttcttctgtttctccaatttgctctacacttctgagtctgcaatccattgtcaattatcacagtgacaaaacggtggcaaatatgcatttaatatttaaatagaagtgtacctgttttagcaacaaaaagtgtttacttacattaccattttgtaattgctcattttcacaaaacgctacaataaatatttatgagaattactcataatgtgtctttctgttaatttgtacctttttcatatatgctcgtagtcaaggttttaaaaaacagtccatgaccacaatttcagtcacaacttcaaagttttcgggggtgtctgtgactgtaattgctattgcaatgactgtatttctccacaatttccagcaatatcaagaaacgtgatgaaatcacaacctgtatttaaaacttcaatctagtcagaggctacagcagggtagtagtgatggctttcaccaacagacattttaccctgttgatgtttcctccattttgattttaatcattttttaagtcggttcgatatagtcttccctgcaccatttgttacttctctctctccctcttctttttttccttggggagaacattttactacttctattatgttggatggagacatggagttgtaagagccgaacttcttttcaggtcaaacaatgatagttatgacttatgaatatttttgcagacggctttagtcctatcattatcaacagggaagttgtctgaattttcagcatattttaaccattgcaatcaaacgttgacctttgcaaactgagcttatatttcaattcagtacgaaaatgtttcaattttaataagaaacctttactggggttcaaatcttgatgagtttatgggaatttttttgcctaatcaatacgacctatatgaggatttgtaagcctttgacatttagtcaacaaatttctaagtgatttttgtcatacgcgtaaaatcaccagatctatatagagattttataggaaagttcgattaatgtttttgatacggaattaaaatcaacatgtataagtataacatagaaaagtgttcgtaatattttaactaggcatcagcttgagctcgaaaatacatgtatgaatcgccttacaatgattgaatcgaacaaccaaaaaaataaacaaatatggatctgtcaaacagaataaagaattacgtcaacgctcctcgccgccacaacctcttggactctgcttgtggtggcaccaccatggtagtggtggtcgtgcttgtcggagaaggatggagggtggtagtacttacggcctgtttgggggcaattagagtgaaaccttgcagcaatccggaccccttggtcaagaatctcaaccagcttccccatgcagctattcttcaaaactcaaaaaaccattcaccctcttttctattcttctctcagaatttcttagaggggagaaaagagaaagggtgtgttacatgaagacaagagacatgaaaatggaaaaagagagattcttgattgttgattgttgtgttatgggaaaaaccagagtggattgacgtatatatagctggtgccttgccatttccactttctgcctttctgaggcagtgccgtttcttagtattttctttttttaatattattgtcgacttgttcggtcagaaccgcgtttcacatcatgcatatgtttgtgcatcctatatttgactaattatttgtcttttgatttttcttttcttttaaaacattgtatactttttaattttttttattgctttgttttatcgtaattaaggggggagaaattgaaaaaatagattgggtcaccgccaagctgacttaattttgaaaataaaaatggttaaatataatctgttactctataggtcatcttgaagattttttaacgtttagcacgacttttttgaaaatttggtcaatctgaattctaatttaaatgcttatttaatagttttataattccttctaaattaaaaatagtatttgaatttttttttcctaaacgcacgtgtcttctgacctattgagtttagaaattaatataactagttaatctaattcaaaagaatttttcacgtatcaaataaattgttttatcaataatatggatattgtgaaaccttacattattgtattagtcttatgtgttaaattatttgagctgaagtagatttatttagattacgtattatttatagttttagaataattattcctaattatttattaaaactataatatttgagtttataatggttaaaatcaaaagtattttcaaaattaaaaagagaagaagagagaaacagtaatagtgtgcattgatttcaaaagatatatctaatgtaatatacaaccttatatagtattgcttctaatatttaattaagaattgaatacgaaattatgaactaactaatcataaaaaaggactacaatcataaaataaaataaaaaatgaacgaagtcagttaattagcttgacttttaatgaaagagtactataaatttacgtgtttatttgttattattagtatataatgtaatatgtgtggaaaaatataaaaaagaaaaggttttctttagtggtgtattatttggagtccataaaattaacatgacaagaacttatgttaaaatatggatgttagtctttttcgtcaactctaatataaaagcacaaattttatctatgttatttatcaaattgtatatacttatttatctattagaaataaattatttataagtaatgaattatgtagaagagttattatgttattataataatatttacaatcaagtatccgaaatttttgttttttattttgcatgtccctccttatattcttttcgtaaagggtagatgtaatccaatgcaaaagattataaaatctatctttattatgtcgattttgatttcaatcaactctaaattttgataagtgcatatgattttttattcaaaaacataatactatgattatatatattttttgtgaagtaaatatattagcataagccacaaaatatgttataaaaagaagaaaaaaaaataagaactgaaaacctaaaaaagaaaatgaagaaatacaagctgattctgccataaggcgttaacaggaaagttatgaacaacatcaccacgcttggcaaaaatatcagcaatttgatttgcttttctataaacatgatttcacaacttgacatattgatgaatattatgaatagacatcaccaaattatagcaagaatagaaatcaccgcaacctttagaaagaaattaatggcattgtagtcaaagtaagcaactagcttttgaaattttacactctaagccagctttaacccatgtcaaatattccatagctgtgactctaaaatagaacaagaacctaaattaattgcgtaacaaaacaagaagacacgtctctgttaatatactcttccgttccaaaataataatttctttatagctttttgttcttattccaaaataatagtttcttaaaattaattttctaaaaatatgcctggatagtgtaattaagaagatccattaatatttgcattaaaaagagatatatatcataaaaataagtaataagtagtagaatgtattttttattggtggataatgagataatttatgataaaaaatagttgaaaaattaagcgtattttatctaaatttctatcaattcaatattttttaatcagtatgtcgtaaccttaaaagactataattttggaatggaaagagtatgtcgtaatcttaaaagactataattttggaatggaaagaggatatgtgttattttttgtataagtaggttaaagaatataataaaatgaaaactaataaaatattcttacgcggtttctagaaagttacatgcatcagtataaaataaaaataaaaattatatgcaccaacctatttaaaagtaaataaataataggaggatactttagtggcttccggtaagccacacaccaaaccactaaaaaaaggagagagaagaaagtcaggaacacgaaccttatataatacacaaagcacgtcaaaatgtgcctttcctttcccttcataacccaaaccctaacgccgttggttcttcccgccggcaaccatttcagtggcttcttccgccgtcgccgctcattgccattcctccattttctgatcaggtccttattctttcgatttcttctatttcgttatctgcggtattctctatacactgtctcgcctttgctttctagttcctactgcgactgtgagtctgtcttcccaatttcccgttcccgggttttgtactactctcgaacgggaaattcaacggagttgtgtttgggaatcgcgttttatcatctcatttctctcgccattcacacacttcttcatttttgcgtttctcttttcttacgctattttgctttcattttcatttaacctaaccgcgtttatttttcttttcgttttcctcagttaattctcgtgtttcttcagagcgagcagaaggatttcagcattggagaccgaatcggggtgagttttaatttcaatgcttctttgttaggtcaaatttgttactcaatttgttttctgttgaaataaacaagtaacgtaatatattgcttttattttgaagtattttttattttgaaagagtaaataatcaaattagtgccaaaatgatacatcagtaatatagaattgtgaaatttacattcacggtccccaaatatgtatttaaagctttttgtttaacttacattggcctcaaagcaactctgttattgctttcttgcttaattgctttggaaagtgcaccagcagggaaccaaacatgctactattcgttgttgaattgatctctcgatatgtgttctgtcagagtcaaattagtctctgagatttgtgatatgaggactgatttgacccaagaaatacacattcaagaacctttaagcataatttctatcattcaggaactgatatgacctacgctatatcattgaaggactaatttgactatttacttaattctttatatggaaaagaaaaatagattttggcacaaaaaaaaaaaaaacccaagcctctccaaatggccattatgtttgaatggataaaacaaaattgaagcaaaaattgcattccgtttcctttagtatatctgtaaatgacctcacgatggtttgattttctgtagtttaatattatggtttgcattttttggtttgaccaggaagaatgaggcctacaatgatgcttagggctctaaccaagcagtttcttggaattgtaggcgatgcagcaaacactgtcgctaagaagccacccccgtctcctcctctgctgtcacgcaaaccagcgttcattgatgcattcttgtacaagatgaagaagaacccaaatcttttgtcgaacaagaccatttggtcacggagatccactgtcttgccagaatttgttgatacaactgtcaagatttacaatgggaaaaccactattcgttgtaggatcactgaggggaaagtgggtcataagtttggagagtttgctctcaccaggaaacgcaagaccagagaacaagccaatgccaaaaatgttaaacaacttaagaaaaagaagtgattctttttccttttgtatttttggacaaaaataattttgcggatattttaatttctgcaattatttacatcaatctgttctttcttaggttctctagattgtatttgaagacctaacaattttccctgtgagaatattggcaacaaggattttgatgaaatttgaccgcgattgtagttgaattgcttctttgactatctgaactattcatttcatgttataatttaacttgtggatgatagatcattgattgatcaatttatgctcatcacttgtgaggacctgaattttatcgtagtttgcttatatgctgaatgcccctgcaattgcatagggatgtcatcattatgtgatgtgcctttgtgaccaggaacatgattctggaatgctccactacaagtaatatgaaagttatgccagtaattttttcatgtagaaacctgaggcagggattgaatgcccggaacacagcataatcattaaatggccaaatataatatgaatctgagaaaaactccacactcaaggttgcttcactaaagttttgcacttgacttataatgcattacttcttaattggtacagaaactggtgtccatacttttagtaaaagtttatcactttccttaccaaataggttctacaatgtcatcatggtaaatccaaaggccattaaatgttatctgtacaatttgacaacaaaatttaaaatagggaatgaaattatgaaaaaatgagatgtaactaataataatttaatagaaattgatagagaaaaataagttataaattattgtgaataagacaactcttaaaagttaaaaaattgaattaattataacgtgttgttatagaacatcattgaatttcaccacatgcatttgacaaccaaaagctaaaaaagaacgttttataaaagagtaatacgctaatcgaagggggttttgtcagcttaaagatcccctaaaccacttaaaaacttttggtttttcaccattgaatgatttaatccaaaaatgacttattgcacagcaatcagtaagcaatccttcatataaaggagatcacattttgagaccggctgttcactgtgggaaaaaaaagtatttacttcaccaggatgtgtcctgtaacgctaacttcatatacagaattgcaaatattgttgtaattctatcaaattccacaacatcacaaaatgactttaattactctgcaacctagtgtgatcaaactaccctcatttgctttgttgctgtcacagacgtagctctcaacttacatttcattatcctttctttctgcaacacccgaggtacgtttggttggagagaaaatagaaggaaagaaatcagaagaaaataaaacatgattaccgaaacattttcttccgtttgtttggagagaaaatgagaataaaagttattttttagttacaaaaatttaaatttttccttcatttcattttcctttcgattcaaattttaaaattttccttccattttccttccttctatttttttccttcctaaccaaacatagggccaaactctatactttcgatgcctttatttctccacgaacaaaatccgaccatagccctaaagaataacatttcacaactttctttattcctcaataggcatgggctacgaccagctctcctttaagaacaaagaaaagaaaacaactgaatggaacagcaaaacgtagaatacgtcattggtgcattgtccaaaccaaagtccaaaacccgtaactgtcagtcactactatcaggattggacagccagtctctgcagatgctcgagcctcaaagacaacttgaaggctcacgttgtcagtgaagattacatctgaaccagcagccatctcatgtgcgttattgtatgttgctgagggattcagctttgctaataaaaaatctagccttttcaacttcagtgaaacccaactaaggttctcatcaagaaaaatctaaacctaccaagcaaaatggattaatgaaacaattttctgctcatacattatgaaagtggtatttcatacatcagcaacactcacaatactagtaaatttcaggaaaaggaaacaatgtaatacatgtacttacttgagaaccatgttgatcacatactaccaatctaggaacagggaaacgctctccaaatatgatttgagatatacccctgtctccattttaagagatgcaagtctggccattactactgcagcagtctggtcatatccttggaccaattcctaaagataaaatatatattctcttttctaataactgcattcttcttaaatgatgaaaatgcattaatggactgaaatacagcagcatgctaaatgacaatatagaaaagcataaccctaaaactattattttttcacatatattcaacaatttttgtggaaggagaaggctgcatacaattaccctccaccatacatccacgatgtgaggagcctctggcatcaggatacattagtttttttttttttttttatatatatatatatatatatatatatatattcatcaattttcggcttgtccttccttgtttgttgtgggcaatgcagacattgtgtgcaatgcacgcacacttgcttggagacaccattttagttatatattatgccaggcatcctaagtttaagctgtatttgagaaaggaaagagaggcaactttaatttaatcccacacctaggtagtgtgacaggtatgacctcatgtaactacccactgaacaggtggcaaacatggaaagctatggtgggcttcagctaagagggaaaacaaaaagtggtgagaaaggagtaaggacagtatgggagaaccaggcctctcaaactgcctagatatattgtattttcttttctgttctctgaagaggaagtgaggaaaagagtttctacaagtttctctgcaaccgtagtcctctgacatcagcagtagaatttcagtgacaatgcagcactattcagctatttctgctccagttctatcacattacaatatgaccttgccaactatagttatttctatgccaattttgttatacaggaatttttatccaatacttacaaaatgcagtaactgaaacaggtctgtttctattaaatggatataaaaaattggtcattatttattaatcaatttaacaattaaattgtcacaaaaaaatggtcccaaattccatataatataaggtattagccataaaaattcagtttatattatagatgcatgtagaggtaaatcattagataactatgccaaagtttagaatcagaagtgacagcaaggaaagagtcaagagaatattatgataaatgtagaagctacaactatacttttgacaatgagaaataaactaacatttagccacaaatataaaaacaaacaactgaaactacctcagagcaaacagcaacatctacccatcttctagttactatggtgactcgaagcactgattgaccgtttgggctctggtaactgcaatacaacatgatcaatatattcaagtatcagcaaggagggggaaagaggcatgtcaaaaatagttatttaagacaactatataataaagatttaacacaaaaatatttatcaaactaaaataatatcgtgtgacttacaacttcccggtgaaaaatagaatttaaatataaatagattctgatatccaaatcaaattaataaaaataaaataaagaaaaaacttgctcaacttttagttagattcaacgtcaacagtatttttaatctgaaattaactaaaattagtaatagatgaatccaattatagataaaaataggataaagaaagagaaaaaaaagtaaataagataaaagagatgaaaaaatttgtttataaatattagaacataaattatattttttataatttataactatattaataataaaaattatttcatttaatatacatatttttagtaattctatttttcaataattattttttaatgattaatccattatttttagttaattaattttttttcttattttatttagcttttaaccctttttttttatttatttaaaatatataaagaggcaccccctggtcatcataaccacaataatagtaaaaaataaatggaacgaacatgataattctggaaccatcttgacaaccttggattatagaactctctagacacactctcctcttccactcctacctatataaacatgataaccgtaaaccatttcttgtgatcgtgtgagaaatataaaaaaattattttctgtgatcgtgtggttttctgagttctaagaactcacctctttcgtactcatttattcgcttgttgtgggaagccatggacgaagacttcgagttcccaagtgctggcaacatggaaatgcctgaggaggaagagtttgagagtccgatcctgaaggtcggggaggagaaggagattgggaaaatggggctgaagaagaaattgctccaggaaggtgaaggttgggacacccctgacagtggagaccaagttgaagtgcattatactggaaccttgcttgatggaaccaaatttgattccagccgcgataggggcacccccttcaagttcaagctgggccaaggtacgcattcttttttcttgcttttgttttgtagaggcggattattgattttatatagagaggatttcaattgatcgactatataaaattctttgctgagtgatattattctttgcttaaaagtgaaaaattgattaggatcaatttatttatgggaggtttgagtaattgatgaagtattaagttgaaattttgttactggtattgtctgtactctgtatgtagatgaataatcattcattgattaaaaaaaatagttgttaatgttatatttacatacataataaatcacaaatgtaatcaggatgaaagtcttttaatttatccttatgctggacatgaaaattaaactaaagtgattaatgatgaatgaatgagtaactatagtatttaatgttttgtgacttggttaatgcagggcaagtgataaagggatgggatgaaggcatcaaaaccatgaagaaaggtgagaatgccctttttacaatacccccagaattggcttatggagagtctgggtctcctcctactattcccccaaatgcaactctgcagtttgatgtggagttgctatcttggacaagtgtgaaggacatatgcaaggatggaggaatcttgaagaacattattactgaaggggagaaatgggacaatcctaaggacctggatgaagtatttggtacgaaactctatcctgtattgtctttgagattcatctgtttagcaacactttcagtattgtttaaagtttccttctttctctcttttctgcagttaagtttgaagctaggcttgaagatgggacagtcatttcaaaatctgatggggtggagttcactgtggaagagggtcagtctcatgcttcaaaagtttgaattttgtccttaccgtgtaacttgattctcgttgcaagtaacaataatatgacttttttcttttcttttatcatgcagggtatttttgtcctgctatggccaaggctgtaaaaacaatgaagaagggagaaaaagttctcttgaatgtgaaaccacaatgtgagtaagactgttgttatcagcaatacttatgtctacacgttttgcttgtgcaagtttattgacattcaaagtttttgcagatgcatttggtgagagtggaaggccagcctcaggagatgaaggtgccgtacctccaaatgcttctcttcaagtggatcttgagttggtctcgtggaagaccgtgtctgacattaccaaggatagaaaggttctcaagaagactttgaaggaaggggagggatatgaacgaccaaatgatggagctgtagttcaaggtacagttttattacaatattttcaatcccttctcttcctttcttcatttaaaggttttgtatatactggatgggatgctgaagagtttcattatttcttttgtttcagtgaaactgattggcaagctgcaagatggaactgttttcgttaagaagggctacgatgatgaacagccatttgagttcaaaattgatgaaggtacctctaacaatcatttaaacttcatcataagtcttgctttttctattactagttactaagttgtatgtttgatcgaccatgtagagcaagtaattgatggacttgaccaagctgtgaagaacatgaagaaaggggaaattgcattgctgatcatacagcctgattatgcttttggcccatctgggtcctctcaggaattggctaatgttcctcctagttccactgtgtactatgaagttgagctgctttcctttgtaaaggtgagaagtgagagaattatcatgttttcttcgtcttaaactttgaactaatttgaaatgtaaaaccatttactgaaaatggggatgcaggaaaaggaatcgtgggatctgaatacacaagagaagattgaggcagctgggaagaaaaaggaagaagggaatgttttgtttaaggttggcaaatatgaaagagcttcaaagagatatgaaaaggtatacctataaattccaaaagatcttatttatgtaacttggttgctgacggttatgttgtggtaaaaatgaactaacaataggtgttctttttctcttgttgacaggccatgaagtttgtcgagtatgattcctccttcagtgatgaggagaaactgcagactaagatattgaagatcacatgcaacctcaacaatgcagcctgtaagttgaagctaaaggactacaagcaggcagagaagatgtgcacaaaggttctttgtctgattcagcctaaatttgttctttttccttggctgaaggctaaatatattttcagaacctaaaagatgactgagtctagggtgcgtgagcgaaacaagtttagtgtgatgtgaggtaataatttttttgtcagttgtcaaatgcgtatcgcctacatgctacagtaacagagtcaaggactgcatttttttcgggaaagttagaaattatttgaatcacctgataaagcaaaagcaaaaaaaaaatgtgaaaaacactgaaaatttaaatagattaattataaaaacacaaatagttttattttgtcaaattttatattttttttttgaatttgaatattcacacaaattaattattactaaaaaattgaaagttcttttacttttttcaaaaagttaattagtttaattaatagaattttgattatgatgatcattttattatttttttattttattggtaagtctaagatacgtcgagattatatactaaaataaaataaaggagacaaataaaagttagatatgaaaacatgagttctgataaaggaaaagtcaagtacatattattctatttttactaattgctcagtctcttatgttgatggtatactttcttgtttgttaagcttaaaataggaatttgtgtcaattgagttgaatgtagggtcatataggttttcgattatgtcaaaagtttagaatatatatgaccttgcgttcaacttaattgatccaaattcctattttaagtctaattaacataaaaagagatgaaataattagtaaaatttgtacataatgagagagtgagccaaagtggaacattgtgtgcttggtttttccttcctcctaactcatgtcttcatatttagtttttatttgtctccttgattttattttgttatatgatatggcagtgtcaatgtaagttagacttatcaatagaataagaaaagataataatatgatgatcataacaaaattctactaattaactttttttaaagtaaaataactttcaaacttttagtaacaattaatttgtgtgaatatttaaatttgaaaaaaaaaagtatacaaatttgacaaaataaaactgtttgtgtttttataatcaacttacttaaattttagtatttttcaatttttttgttgattttgctttgtccggtgattcaaataaaatttctacctttcccgaaaaattgtagcctgtaggcgatgtccagttatgcgcatttgacaactgaataaaaattactacctttcccaacatatccgataaccacttcatcatctcatcttgatattgatgagatatttaaatccaacggtctaaattatttttgcatcatacgaaacttttcatttacgcaccctatactccgtcctaagagatttactttctttcctacgatatttatgttgtgttttttgtcctcgtattttatgaatggctttttttattttttgcttgaagttggattcgattaactccaagcctacatgtgaactaactttgcaagtaagctgacttattagacaatgaaatatagacacgtgttaaaaactcttctacccgtttctctctcctaaagcctcttcttctccctcccgccacctcacttaccctcttcctaaaccatagcctcgccggaccaccaacaccaccgacgagtgcggcaaagtcctggtgttgtcatgattggagatttctgatttgggggctaggatttcaaattgggggtggggatttctgatttgggagggatttggcttggaggtggtacgtatttggttcaggtgtggtggtaatggtggtttaggtgtggtggtgatggttcaggtggtgacttgtttttttttattattattaatttataatttatagcaattaaaaatatcacaaattatgttattgtattttattttttatataatttgtaatgattggaaacatattttagccttagcgttagcgggattcaaaaagggaatagagtgaaaatagttgacatctgacttttgctttatcaagcaggttttagagcttgatagtagaaatgtaaaagcactgtatcggagggcacaagcgtatcttcatcttgtggatttggatctagctgagatggatattaagaaagcccttgagattgagccagacaataggtatgcttttgttctcaagtgttatcaacttgaatatatacagttcatatactttagttctaagtaggtaacactgatacatggaatttctttttgtattaaccactgttcgatggatattatcagggatgtcaagatggagtacaaaattttgaagcagaaggtgagagaacataacaagaaggacgcgcagttttacggcagcatatttgcaaaaatgaataaactagaacaagcaagaacagcaacagcaaagcaggagcctgtgccaatgactattgacagcaaagcttaaatttggaagatacctctgtctgcggtcgtctctgcatacaagtaccataatagtacgtattccaattgttgtgtcgtctgaagtcttggtcacataaatagctttctcatatcttgtgtgattttcatatgaagaaatgcatatggtctaggttgtcagttgtctactgatggctaataagcatattttcatatgaagtacgtattcaagctatgtatactgatggctaataagaaatgaagtgaagcaagttttggcaattctaaatgtctccttgttcccttaatcaccgagattttcaattatagtttagtttatgttattgtttattaaacaaaggatttggtgtcaagaattttctaaaattgcaatgcaatcaactacgctggcacggcaagccctcgtagctacgtatcatatatttttctccaggacttgataataggtattcaaaaatttaggaggcagcttgagtaacatactataggctcttttcgctactctaagcctagtttttgtaaacaaattattagctcctccttcttctaccgctacaaaatgagaatgcaaccgtcttgtctaccacagaagtcatatacagggcttttgcgatcacatcacgagacgaagtggttttatgtgaaacttttcgaagaccaaggtgtgaggaaatttaggtcatcttcaatgggtgattttggagagaattttaaggggaagattttgttctttcaaacattctcaaaatcttcatatattagaggtttgattcttataaaataacttcgaaaatctctatgcttttaagaaaatcaattattatcattctctttccctaaatgattctggcaaaaagatgggaagaaatagatcaacaaaaaggaagaagggaatagatcaacaacaaccatgaacagtccagaaaaaagttgagtacataataatttaattttaaaataaaatacataacaataaaataatcacaaccgtgacaacttcgggagaaaaaaggacattgggtgggtgtggatcaacaaccacaaggaatattgaatagtccagaagaaagtacataataatataattttaaaacaaaatacataataaaataattcaacagtgcatagagacatggtggttgacgcgtgatggccgaagacgattccatggcctgatcggaagtttcagagcaccgcgagaaatgtggattgaaggggacatagcgaagtgtgtgggaaagaaaatagaaataaaaaaagaaaaagaaattatattgataaataaatattttaattaaaaataaattttgtattttagttataaatttttaaaaataaaaaattatataattaattgtttttaattatcttaaaataattataaataaatattaagagtttttttagattttcaaaaaagtttaagatcttaaaataatagttaccattaaagtaaaaaatttaaaagatgacaccataagatccaaaaaaagattattaaaatctcaaaattaaattgataaaagactaaacagtattttttttttatataatagaaaaagactgaacaatttattagcttcaagtcttccattttgagtcaagtgttaatctacgtagaatttgagtaaacaatttaataacacgtagcctcaacaaacataataaatttggccgtttagcaaagcaataaacaagttctcctggatttctagcgacaatgctgttgtgctcaaattcttgcggaacatttctatgatcttcgaccatgggatttgactttcctcacattttcaagctcctttcttgtacccgatagtctctgcaatgcatttctttcttcaacctcaacccgttccttcgaaactgctttctactgttgagcttcatccataaaatgctctgccgctgaaattttggaagtaggggccaccttattccgatgagcttcgagaactgtcttctcatcatttatagcaaaggtttgctggatggaatatataatgcatttctttcttcaacctcatctttaaaggaaggtcggacaaaagttaaaagcagccaaaaggcaaaagctgcatatgaaacgtggatcaggtcctccttataacaggcaaagtccttctgaactaagagcccaatcataatcgcaagcaaatatacatgtagtatccactgtcgccattaccaggttgattagatttatatgttctctagtcacaaattcctttgtccattattataatgccattcaaataccctagtatttctgaagcaggttagatctcatggagtttctactctctgcttatccaacttcaaatttcttgaggaacgggatccccatgttgttcattaaacttaatatttagctttgttttccttcccaacggatttgtaaaaatgcacagctgcactcatgatgaacctgtcgccttttgttgattcacaaatactttaaaaaaagttgattccttcttccacatatccacatttcaggtaaccattcggcattgttcggtaacatacaagatcaggaactaaaccaaaagtttatatatagatcctcataaaccctcttggcttaatcaatcaatccagcttttatgaaggcgtggagtaaaatattaaaatggacacaagacagtggaatgcctttgctttgcatagcatgtatggtttcctcggctttagaataattcaggctccttgtatatgcttggagaagggagagatatgtgaaagaatcaggcaaataaccttgcctctgcatggcctggaaaagtttctccatttgatgaagaactccagcattagcatatacattgatcatgatattataggactttggttaaatgaaaaactatttttctttaaaggaaatacatgtttatcaaaaatctcaacagatgtaaaggtaacattaattttttttaaaatatcaaaatgagtattttgaaaataaaaattaaattgaataatttaaataaagaatatacaaaaaaaaatatttaacctgtaacatatttttttacgcaaaaggtaattatgtcatttcatccatggtaaaagtgttaatacaaataggaataaattcaaaaacatggtggtggttaaaatacagtcgtgatagccttgcgagagaatgaggaacccgatttgcttgtgttcggattaaacgcacctcaaggttatgaaactcaagaagcttttgtctgcatctgtgaataatctgcacgtcttagctttgaattatcgggtgataaggataaataggagtcaacaacttgtttgcaatgaagctctataatatgagtatatgacgttttgcaaattcaattcattctaattttaatcaaacttaattttagtcccgataattttaaaatcaatcaatttaatcttataataaatttaatccttatgcatcgatttgttgaggaattaaacaaaagttaaattcacctattttttaaaaatatagaaatcaaattgattgatttaaatgacacgaactaaaatcaaatttttaatgattaaaaacctattttaaatcttgtaatccatatctatatattaatacattttattgcatgatttttactttcttttttatctccacgagatataaacatttaccaaatgtaatcacttatgttcatacactttcacatatctttgtgatacatttaatttatataaaacttatgtaccaagaaagaagaaaatacatctttgtaataaaagcaattgaggtaattttacctaattagaaaattatggtagtaattgccttttgtcattcttcctcatcagtcatcccctttactggctcaggaatggggctcgtgtaacccttggaattggctgagtattgttgaacatagccatgcacgtctctatagcctttttcagttagaattaacaatcgtgataataaattaatcattagtagtattaatgattggtttgtttttacagaaagtattaataattaggctagaattacaagttacaagtagcaaaaactacaaatattactcctttttccacctgatttatctctttcgtattaaaattcacctaatttatttctttcgtattaatacgaactttgttataaagtaatcattcatcacaagagtgaggcagaatacaaatgacatgcaaaattttactctaactttatatttgatagtttataggtcaaccattggatgaaacacaaaagatacgagaaaagatacgaaaaataccaccacaacaaaaagcttgagcggagtctatatatacacgaaaaaagtcatctacttattttattatttactctatctcataattatttttaaaatctgtaccatcctaatcaccgattgacctaataaggacagcaacggtcaacgctttagtcttatctcaaagtcatgtttatggtactggtacaaacctacttaggtggtagccgtcgagatctaaggtaacgactagatgataatgtgtggatagtcacgcatgggaatatcagaattaatgaccctagacacgataagggatataatgtggaattgaactcagacgaaagtaggttacacatgtacacttaaatgctctaactagttcgttcaattctagttctacgaacgatttatattggaataaaattaaacatgaaataagtattatacattattaatatttctctctcaacaacaaatctaatgcatgcttttctctcaaatgtatttattgttgtgaaagtatgaactcatatcaatttttaaaactttgatctcaattgtatgcaaactgcatgtggagtatacgtggaagcctctcagattagtgcgagcctatgtgtcagtttgtcgaaaccacaccaagccaactattttacgcttggcacactcgatcatgactagattcgttattgctcctgtgcactgtgctgactctctctctcgcattgccctatatcaatcatatcaccaacacaactcgattacgatgtgatctgctcccaaacctaacctaacaacaaaagcgcacacacacacacaccacaccaacaactcgaatacggcaacaacattgaacaaactaaaaagaaaaaagcaatctcatttccgtccaaaactcgcatccgaatcgcgacacgcacgcggttttcgtttccccatgccattcaccttctctcggttagtttttcatgcgtatccaaacacctatttctccctttatataaacgacaccgtatatgcaactccatcatcgttctaaattaattctaacagtttcggcataattgagcgatcgatgacggcgttgataaggtcaccggcggtgacactggcgatcctgacgatctcggcatgcatcgcgtgtacggcgtcgtacgggggattggtcgggggaaggtcgaagatccctgacgtgaaggcgaacaaggaggtgcaggatttagggcggttctcggtggaggagcataaccggatgctgaggcaggcgcagaaggaggaggaggaagtcacgttcgtggaagtggtggaggcgcaacaacaagtggtgtctgggatcaagtactacatgaagatattgaccacgcagggtggcgacgttggagattccagaatattcgaatccgttgtggtggtgaagccgtggcttggttccaagcagcttctcaacttcgctccttccactcagtgaaatatgatcaatttcggttccctttcaactactattatttaactcataataacatgcttaatttgtttattatgctttaatccttctaatcgtagtaataccaatacatcttgtgaagagagaaataaatgtttgtagtttctgtttcagatatgaataaactagtttgacatatttccattgttttgaatatagagtttctctattttttttttttttaatttactatggacatattttattttagtgaagtcatacttttacaaatatcatttctctaacttttattatcatttataaacgttaaacaacattaacatgaagtaatagtaagaaaatgcatttgtctcaagaaattagaatgtttgagaatcttaggcgtgtattcaattaagacgtttattttatggacaatctttttgtctcgggaatttatttaatttttcctcataatataacgtgacaatgacaatgttatttttgggttccttatatatgtggtcaaaatttttttttagttaattattaaaattgactgtaaatgttttttatattctcataaataaaacacgtctgtttgattgagttattttttcttgagaattatattataattattaaaataaatctcacaatttctaactttgcataaatgttaattaagtttcctatctaacaaccaataaaaaaaaactggaatttccgacgtcggtaattttcaatttcttgaaaagttaatcggtcggaaatttttgacaaatatatctgtcggtaaagtcttgggaaattttcagtaaaaaaatttcaacggaaaatacacttgtggatcagtaaaggataccatgaaaattttttacggttatatcggtcagaaatatacttgtgggtcattactgacacatttttcgtgtcagtaacttattttcattaatttctgtgctgaatacatcacagacttttctttcctctcaaaaacagaataaaataaaatagatataagtataataaggatatttatggatagtttattcgttcagattcagagaaatgctgaaatagaaacatatcaatgtatactatgaatatttattttattaaaagtatattaatatgttatttcatttcagcccattacatacacataacacctttcagtatgtaattgagtatctttcacgagtatatataaagagagagattccaatatatgcctattttgcgtgaatgtaattgggcacataggaatgaaagattgtagtaaagaatgaaatttgtggaaagagaaaattatagtatgtaacatgaaggagcattgagagggtaggaaggagaatttgcttggatttttattcataaagagattcctatcacaagaaaatgaattttcatagttttacattcaataatgaacggaataacttttatagatataataatggtattattaggagctgttttagttattgctcaacaaagaaaaatttggtaagacaatgtctcaattggattatggtattattaggaactgttttagttattgctcaacaagatattaagaaaaatttgatctattccaaaatgtctcaattggattatatgaaaatagctttagaatattggatcttatcaagtccgaaattaaatattagttacatgtgaattataacttaacattgaaatgaaatatgtttgaaattaattattttatcacttcataataaataacaaatatgagataaaaaaattatatttttttttaccctatatttgtgggattacaaaaattatccgtaaaacaaatgttttcttagcttaggattattttttatgacaactaaattttggttgtattgcattaagatttttattgagtaagaccgcttctccatctgtcattattgaattgctgagaagatatatacaatatcttttggtaaaaaactacaggggatcaaaaaattgtacaaggtataatacttttaatgaaagatataagaagatattttattatttagtcattgagtaaaaactttttttaagaaataaaacttttaatgaaagatataataaggacctcttacaatagtgcaaatagcatttcacatttgagtataaaaagtatttcgtcaacttttcctcttcttcaaatcaaatcgtcctctagccaagtagccatacttttttttttatctaaaaaaaattcaaaataagagatctacaataatttattaattatattttaattttatttaaaaatttaaaactaagagagagacacgttgcgtcttcttttttctcccaatagaaataagaataataaacactaaaaacaaaataatattagaaaaaataagaattattttgaataaatatcattttggttattgaaaatgtgagatcacaataaattggtcattaaaaaataaaaaatttaaatttaatattttatgatagattaatcttataaataatttaataataatttaatattaaattaatttttaaaaatataatttatttttaaattattctttaaatattacaagataaaataatttcacaaattcaataataacaatgtgttatactttttatacattcactaaatttaaattttttattttttaagaaccaattttggtctcatccaattttatattattttacagtgacaataactttttttctcaatatagaaactagaaaataaatttattttctcagggacacacaagaaccgtacaggcgctgacattcaaatccctcccatttcccaacccccctaacggctactttcttcattctccgttcccttctcaacccaaaccctactttctcttctcttctccgttctgttctctgcaattgcaaccatgcttccaaaaaatccaatctttcagtgtcgggacactccttccgcacacgctttcagaaaacccagacccacgcgaaagcaaaaatccaagaacaaagagaaccatcctcctcctttcaattcccccttgcccccaaaacctcccaaccctaaccctcttaagcgcaagctttccgaccattccgttccccccacctctggttccgccgtcaaggtcaacaaccattccaaattctactttcttcttcttcttttttaactagttaatttataattttatattctaatttctaggttattgtgagaatgaggcctgcatgcgatgacggggaccagggagattccatagttcagaggatttccagtgattccttgtccatcaacggtcagagcttcacatttgattccgttgctcacactaatgctactcaggcatgatacaagtttataattactttattattacatttaactcgttctccatgtctctctcgtgattttgtgatagtaactgggttgctgttttatcctccagttggatatttttgagcttgttggggcgcctcttgtagagaattgcttggctggatttaatagttctgtattcgcatatgggcaggtttctactttcttcccattttgcgttgcattgtgccgttatgttctcttgttactcgtgattgattatgtttatttttgaaaattttggatagactgggagtgggaaaacttataccatgtggggtcctgccaatgctttgtcagatgacaattcagcaagtgatgaacaaggccttgcacctcgtgtttttgaaagactctttgcttgcataaatgaggtagtgttgagttctattctatttgtgattgaatcctttgatggttatatgaactttgttgtgattttcattgttgtgtttcatgcacaggagcaaattaggcattctgacaagcaactcaagtatcagtgccactgctcttttctcgaggttgaattgaatgactgttgataatttctttctatgtccctgtcctgcttgaccttgttatctagtccttttgatgtgtgaacttgttttgcagatatacaacgagcaaatagcagatctattagatccaaatcaaagaaacctacaggtaaaatctattccattatagttttccctcgatcatgcttaaccaggttatactagaactggtcttttgatgcttattcagattagagaagatgtcaaatctggtgtctatgttgaaaatcttacagaggagcaagtgtgtacgaagaaagatgtgactcagcttttgataaaggtgtgcttcatcacacttgtataaacagttgtggtttccatttccctcttctatcactgttggctgttgcagtgttgcctattgcctatttaactattcaaccatttcattatgagtaaactatagaagtcaataaaaatataaaatagattttcttaaaggattaaaataagatccaaaaactatttatcaaggactagtttgtctttatttcttccctcacgctaaatggcaacaaaagtattagaaaaagattagaattatatattactactgcattagagaatcaggttcttaaatatgtggaagttgaagaggttatggcagcatataacatcagcaacaatgcttcatgaacacctagcatgtgttgttttcttaacatttagagtttcacgtgtcagttgtcaaacatccatcaatcaacaggttgaaacatttattttttaatgttctttcaccatagaatgaaaagtaaaaacaacatttaagggtcatatgttgtacatgcctcacttgagtaccccatgtttaaactaaatttgtcatctttgaaattacactgaatgagtacttcattactttttttaacaagtatttttgtaacaaatgtggcagagcttcattttgagcatatatgactcattacataaaaacaaaaatttccattaaggtagaaccagttgatttaatcagtagtaggagaaatgaaatgctgaatttctctcagtctgacttgaatagctctctctcttttcgttttttagacaattgaccattcttatatgcttgtaattatcaagtttttcctttccattctgttagggccatctcttctgtaaatgaatacagcccaatgtaactatctattctagacgaagaagagtaggtagttagtgggtattatttggtctgttagtcagttagaagaaataaacagagagctgtaattgagaaataaattatatatttgtcgagttgcacctgaggcagtgttgctctgtggaggaagaggatttcctttgaggagagtcatcccctgatttcaatttttcaatacagaagagctatattttgtttcctattctctatctccattctttataattttgtttctaaagatctcaagagcctaacacattctaaagatctccaaatttcataattgccatggttttcctttgtccttttctcttgtgtttttactattatatacctttcattatacagggtttgttaaacagaagaattggtgcaaccagtataaattctgaaagttcacgttctcatactgtttttacttgtgtggttgaatctcgatgcaaggtgatgcactcttctcttgtggcttggagatagtttttaataatattagataggaagggcagacattttacaatctttaactagataaattttaggagaaactacatatgcaatattgaaatgtggaatctagcaatgaacttttgcttttcagttcttctgtttttcaaaagaacttctgttggcaagatatttttcagcttcacaatagaattgtaaaaagagaaaagaggtattgaagcgagtccatattttcactttgcagagtactgcagatggtgtaagcagatttagaacaagtaaaataaatcttgttgatctagctgggtcagaacgacaaaaattaacgggtgcagcaggagaccgtttaaaggaagctggcaatattaatagatccctttcacagcttgggtatggtttaaaatgtgtgtatacattgatgtttgatattggaattgaaatacaaattactagcaatcacaaacgaaaaatagcttaaatacaaatacaagttgattttagcttataaagaagctcaatgcattttactttcttatttttttcctataaatacctatggagaattttatccaaacatggcccattttgtggtgatcaaagaagaaaaatttggtggcaaattccaaagctgattatagaagcttggcccaaacttcagctgagattctatggattcggtcattgctcaccaaattgcattgcatttttcagactcctaaaaatcctgtgacaatttgagttcagtggttctctcacaatctgctgcttcactcttgcattaaacaaatggagttagataccttttttgtttgggaaaggttctaagcaagagcctactactccatcatgtcccaactcatgattactgggggtggatgctttcaacgtgcctctctcttcactgcattttcatgttttcagaggcaagatcagagtgtgtgacaagtttatgtaatgtaaccttgagcttaggagagagagagggtgggggggggggggggatgttagttggtgggatacagtgtgttaggtcaatctagctcattgggaatggacagggaccagttttcctttaggtagttaacccagctggaagctacgcgcagcggtttggattcggtaaatgaatgttcgctatcacattagttgcaattgcattgtaatcatataagtacctgtaatctagccattttaaatcagaataaaatattactgaagtttactcgttctaaaaaattctctctctttgcatcttcaatccaaacaatctcccatagatttgtgattcccattcaacattccccctcaagctggtgaatagatactagtcattcccccatgatagatgaaatatgaaatgggcataaaacctagatgtgaaggaaagggaaaaagggaagttgttaggtggcatttattccatggtctgaaaattcctgactgccaaattctaatcatccatgatccaattacttactgaggttgaattgtactgcaggaatttgataaaaattctagctgaagtttctcagacaggaaagctgcgacatataccatatagagactccaggttgacatttttattgcaggagtctcttggcggaaatgcaaaattagctttggtttgtgctatttccccagcacaaaggtagatatcaaccattagtgatttgaacttctggctcttaatgtatgctggattatttctcatggcttaacattgcagttgtaagagagaaacttttagtacattgagatttgcacaatgtgtaaaggctatcaagaataaagcagttgtcaatgaagtaatgcacggtgatgtgaatcaattacgagacgtgatatgccaactcagggtaatatctcttcgaccatgatcaatcatttctttatacctggccagtacatttttttttcaaataacttataactgtaagcaatcaaacaggatgaacttcatcgaatgaaagcaaatggttacagtccaagtgatggaagtcgaggtcattcagcagcgttgatcagaagaagtttgaatttgctgaagcctaccctcaatcacccattatcactacctcatgttgatgaggatggtgatgaggagatggagattgatgaggaaggtgttgaggatcatgctgtagttctccacaactcaaatggaggttttgctggtttttcagcccctactggatctattggttctcctagtgctgcaatgaatggtgacagccctgctggcggcatggttaaatgcaaaacatcccccatcctcaaaccccctcctcccagcctttcaccaacaatcagcagcagcaggaaaagtttgaggacctcattaaagcagtctccttctgagaataattttcatggtgaaagtgatttaggcacaaacaccgttaaccagaaatgcttgtctactgctctctccagccagacagctccaaatttcctaactaaaactgaaaatttagcagtaagcatccaccatggtcttgaaattattgatagccaccatcatggtgcatcgttatcgagtctctcattgagacccaaagattccaggctcattattcctgtggaaaaagttgatgtcggagtccagactattcttgatgataatgccgaaaaggaagattatgctatgcttacctgtaataactgtaaaagccgaatgcagcttgatgtcaatgagattgacaatagctcaaatgtgcagctggtacccattgattgcccggagtcaactgataaaccaaagaagcaaattctgaaagtaagtgcaaggatctcagcttcattttctggtatagcttaaattcaatctattacttttcatttctttctattataatgtaggcagtagagaaggttttggcaggatcaataaggagagaaatggcattagaagagttctgtgcgaagcagacttctcatataatgcagctcaattgcttggtaagattctgtttactgacaatcatctgtggtcattgttttgtcttgtattgtgactattttcaatcatatttgtagttgcaaaagtacaggcaagagagggaatgcaatgccacaataacacatacaagagaagataaaatcctacaccttcagagccttattgatggtgttttatccaccaaggagttcatggatgaagagctggtgtccctcacacatgaaaacaaggtagaaataaattattttaaggttttatttttatgattactatctttgatgcttatatttaggacttgcctgctatcaaaattcaacagcatttaaaggagaaccatgagcatcatttagaagttctgaagatgaagatagagttaaaaagagtacaagatgagttacaagagtatcagaatttttaccaatttggggagagggaagtgttgatggaagagatatgtagtttaagaaatcagcttcacttttatgttgactcttcatccacatccgcaacaaagcaatatactccattgcaattgacttattcatctgaacctagtttggcagcaaacctaactgccattcctgatttaacagaggctagcactaaggcaaatgcaaatccagaatcaactgaagacagtgccaaagtaaaacttgaacaggaaaaaagtcaatggactgaggcagaaagcaggtggatttctctaactgaaaaactgagagctgaacttgaagctagcaggtcactagctgaaaagaggaagcaggaactagatactgagaggaagtgtgctgaggaactgaatgaaacaatgcaaatggctatagaaggccatgcacgaattttagaacagtatgctgatttagaagagaaacatatccaattgcttgaaaggcatagaaagatccaggatagcattgatgatgtcaaggaagcagcttccagaggaggagtaagaggtgcagactctaaattcataaatgcccttgctgcagaaatttcagcattaaaagcagaaaaagaaaaagaattggaaatcctaagagatgaaaatagaggacttcgagctcaactgaaggatactgctgaagcagtgcaagctgcaggtgaacttcttgtgcgacttaatgaagcagaagaaggtgtcattaccgcacaggtatataaagaatcaatgtgtatattcaaatttcaactgagcaagaatcaatgtgtatttacacataccattttaatccctatacataacatttttaatctcttttagtctctatcgtctaaactcataaggactaaaacagattaaaaaaagtatgtatattcaaatgtgtatttacacataccattttaatcccttttagtccctatacataacatttttaatctcttttagtctctatcatctaaactccataggaactagaagagattaaaaggtatgtataaggactaaaagagatgatttttaagtatagagattaaaaggtaaagtttgtacaactatagggaccaaatgaataaacctttattcttttatgctgaagtctttcactctcacaaatgaatttctagcaaattttatgtaagagaagcaggtcaattttattttgctacagctgatgcatacatatagtttaacctggtagtggagatgtttttgaaagagctgggtcagctcagttctacttgagctaattctataagatgtattaacttgcagaagcgggccatggatgcagagcatgaagctgcaaaggcctacaaacaaattgataaattgaagaagaaatatgacaaggagattagcacacttaataagctacttgccaaaacacatttgcctaatgaagaaatacgacctactttggatgaccttgtcatgcctacttgtgatgacaccaaggtgccgaacaatgttaatggtcaatttgagttattttgtaacgaagaggatagtgaacttgcaaatttggcagaccaatcatggttctcttcttatgacacatgcaacatatagattaatcttccagtttgtgttcattgttcatatgatttgttcaagaagaaaagccttattccactaggtgttcatatgatgatttgcgtcacaattgtctcttctttacatcaaagcctattttgatttagcctaccggggaacttttgcatttatctgttgcggggaatcaatatccttcagactttgggttgttgacattaacgaatcattttaagagcttgggttctaaaatgaactatgtgaggtatcaataccatttaggacttcgggttataaagaggtacacaaatgaactaagatgataacaattttagtagaaatgtcaaatattgtcagaaatttcaataatttgagctaacgcccacgatatatcttggttatgtttacgaacatttgttttgactcattgtagctcaattttattatgattttattgttaattcattttcttttaacctttcatttgtcaagaaaccacatttccccacatttaaaacgcaaccgagatttgctaatctatgaaagtaaaatgccaatcctcaaaatttgatttacattaagttatacaattgcgtgttcccgagaactttgaagtataaagtgaatcaaccatatatatggtaaaactgaaatacaactccgaccttgacaattttcaaaatttccagatcttcatgaaatctctccatcatccatctcagaatcatccccaactaaaagatcctcgtaatccaaagtaccccgaggctcaatctgcacatgcaagtcccccacttcagaatccctctgatccaaaaccaaaccatcatgatcctccacatcagactcatcatcactgcatacctcaagcttctcttcttcctccctctataacccacaagccccaaaaccttctccttccacagcagcaaggggcatttctcaatgagctcagaaccctcataagcctcagtcataacctcttccccctctcggacacatagaagatcccacagtgcttgagcagaagcctcatcggcttctgaggcatcacaagctcccaacgaaagtgtctgaggtgatcggtgaccaacctcttctcaatagtgaaactaagcagttcatgcataacagcaacagcccttttatatcaaactccaatgatccagccttaagtccacgagcatcagcatagggagacaaataagacatctcctgaaaattctgaatcttttcaccatagtaacgatacaccctctaagagttcgcagggaacttcaaaggaaatggaattgaaagcattcctggggtattggtagtttcactttcggtagtttcagttgtttctgtcaccacctttttctctaactcagtgattgcccaatcagggttccaagatacaagctccaaaaactcaaccccttaaaaagctgaggatacttatgcgcccaatggactctataatccacggcaacccaaaatctcttctgaaatgcgcaatcttctccaagggaagccttttgtccagcgacatcatgagaaacctcgtgacgtgttcggcagctttgtcggcgtgttcttcgatgaccctttgttgttccatcaagttctcggcttttggggtcatgccgcaccagagcacccccttctggtccttgtagagttcgaagaggttgggagttttgcggaggaaatcggagacatgatggggcttggggaggttgatctggcggcggtggtggtcgagggagcgaacgggaatcaccatttcgggatcttgcttgagaagctccattaggtagatgattttggaggctatttaccatttctcggttgtgacttcgaggtcttgaaccctcttcttcttgctccttctgtcttggaccctcttgctgctcactgtggtaacaataacaaacccttgttctccccaatcaccaattagtacccatcaccattaccatcaccatcaccaatccaatctagttctcattctcaatctcatttgccaaggtttgaacaagaaggccatatgttactgacggttgttgcttcctgcattcccagtgttccttactgcacttcccataccattatatttcctaatgtaattagttttacccgttgctgacaagtgaaatgagcccagcactaacattgttgggcctcggcaggtccggagtatgagctttactattcacacctcaatagttacttttggaatgatggagatgctcgtggttggcataccactacatgggaggtggacggtggtatggggttcaagaagttgcatctttacaataagacttttatcatgaagatggcttgggagcttattgcccagccggaggagttgtgggtgtaggtattaagggccaaatataagtgctgatcaaccattatctcggttgttaattgtgggatgcatgattcctaaacttggaaagctattacgtggattgtgggtaatggttcccgggtcaatttctggctagacaattggtttccatcgagtatgttaatagctctggtgggtggaaagttttggagttgtaggacttccttccttactggcctatccaggagattcttgcttatcctacccctctccctgctcatggaaggtttgggggagctactactaatggaagttttactgtgaaatcaacttattcaatctcaaccaattatcacagtattcatggctctaacaggttgcagacgatttggcagtggaaagatcctcatagaatttggactctcatttggttgattgctaataaaggccttaaagactaatgtcagaaggcaacattgtggtatattgatgatcctctgtgccctttatgcaaatctattgttgagactgaattgcacattctgagagattgttctgatgtcaaacctatttgggaagagcttggcagggatttttttcccttctatgcacagcttcttctctatgtctcttgtcgactggttgttggggaacacggcaaaggggcttcacagatggagattaatgtttggtattacggtggcttctctctagtatgccaagaactctcttatttttaagaatcaacagtggaatatgcagggagttactaatagagtgatgttacagaccctgtgtagccattggttggaccacgtacaccaactttataagtggaattccaaagatatgtgagtgaacgtctccctccaaaatttcctgagtttcccatgctcttcatcatagctttcttgttgggtgcggtttccttttctaaaaggagaaagactcaaatattgtaagccaactatgtgtctcatttatcgagttgagaaggtcaaattaaggcatatgaggaagggttaatcaagtaactatgcagcagctttaaggagagagaagagaagagtgaaggtttattattgtttagttgtttgatttactattagcatactttgtgcttttgattaagaacattttattcacagttaaccataatggaactcttagtttagtttatattagtcttaaaccgtacgaactcccgaagtttttatcctttattttgattttcaggttctttttttcccctagtctttcattatacaattctttttaatcatatatttatgggtttatacttacgagtatctttaaaatattgattaagaaatttttaaaaatattcattatgtaaaacataaaaaaattatgaaaaacacaatttcacacattcaaatattttttttcttttaattttttaatcaatactctaaaaacatttgttaatatttacctatatttatttagttacacgtcacatttcttgcttgagacaagaaatttatccacaatgattatcattattcccatgatgctgaatacttttctcacctgtaataattatcttcacaatatcatcattttctttcacacttgagtccacaaaacttcctcgtcacattttgaaattgagaaatctcctcaatttttattcacttcaaaattatcgaataaatcttataaaaggagagagagaaaaagagaatcatcgaataaagcgatatgacaggaataaaaatgtgtcactgcccctactcaattatttattcagatactgtggacagcctgagaatcacgttggagtatttctagatattttatttttcacggccataatgattaagaagcacatatagatacagaaaaatgcagttaactaaatattatatcttggtgctttcatggcgtgcaacacagtaggatgtttctctttgtttttccaactcattcttttaatccctctagtcactttgggattctcaattgaagaggcaactgtatatgatctccaacttgctttccgtagaaaccaattaacctctaggcaactcgttgagttctaccacaaacaaatacaaacccaaaacccagttctgagaggggtgttggagttaaacccagatgcactagaacaagctgacaaagctgaccatgagagaaaggctaatgcaccagggactcttccagcactgcatggaatacccattttggttaaggacattattgcaaccaaggataagatgaacaccaccgcaggctcttttgcacttcttggctctgtggtgcctagagatgcaggtgtagttaccaggttaagagaagctggggctatcattttaggcaaggccaccctgagtgaatggtcacattataggtcgaatgatgcacccagtggttggaatggcagaggtggacaaggaaaggtgattgatttacttgctttttctgactttaatctgaccttgttcttgcttttcaactcaaatctatctgtctattcttgatgatttgcaaaagtccatagtaaagtaatctattatattattatttgtgttgtgcagaatccatacacaatgggtgatccctgtggatctagtagcggatcagcaatatcagtggccgcaaatttggtggcagtgtcacttggtagtgagactgatgggtccattttatgcccttcaggttctaattcagtagtgggcattaaaccaacagttggcctcactagtagagcaggggtagttccaatctccccattacaggacacagttgggtaagtctatggactatggtaatttcaccattttcttttgaacaaattacactggaatcttttgagctttttccgaaatacatacaatatcatttttttttttctcttattaaactaactcctttaatgtttaaaagcattatactcatattctccttatatattacaccaactcccttaatgatttaaatttgaaaacaacactcctataatgaaagttgttataaacattaaacaaagaatagtattttgtgtaattcgaaaaattcttaagaagtattaatgtaatttgctatttctttatatcaaaactatatgcactttgcaagcattattacttttcccgtcaaaatacattttgttgcattaaatgtgtgacttcttgtgggctggtacagaccgatttgcaggactgtatcagatgctgctcttgttcttgaaaccattgcaggaatcgacatcaatgataaggcaacaatcaaagcatcaaagtatctcccaagaggtggctatgctcaatttctaaagaaagatggactgagaggaaagagattaggtgtcgtaagaatattctacggttttggaaatgacacttttatgcatgatactttcgaactgcacctgaaaacattaaggtaatgaaaattactatttgtgtctagtattaattattgattgcattattcagtatcatacttatatttttcaaactcaggcaaaaaggagcagtgttggttgacaatttggagataaacaacattcaggaaatctttaatgatcaaagtgaaggcattgctctggcatatgaattcaaattatccttgaacgcatacctcagagacttagttacttccccagtgagaagcttggccgatgtgatagccttcaacaagaaacacccaaaattggttagtatgtaacaaagcccctcctatttacttgttgatgattaaaatagatatggtaaaaaaatttgctcaaaatacatcttgttgatgaatttcgtccatcattcaaatatattaaattctataaaggaaggcgaaattcatcaattatcaaatagaaataccaacattatgttctttttaacacgttctctactattatccgaattttatcggactaagactaattttaactgaaaattgatcacttaaatctcatttctgttggatatggctcatctttcgcagtcagatgacaacccttcttgttggcgggatcagcagaaagccaactggtcttttaatcctatttatattccccttgtaaaccgagtgacttgtaacgagtgacggtgaggagattatagtacagacaagctggacgtagtctacattgggtaaaccagggtaaaatactgtgtcatatttctcttccctattctcttttctgttttttagatttgtgtgtgattgtcgatttccaacaatttcactggaatagatataataacattggtatggaaattgcaggagaaacttaaggagtatggccaagatctcatgttgatagctcaaaagacaaatggagttagggaactgaaggaagcagtgttaaacatggcaagattgtcacatattggatttgagaaattaatgataacaaataaacttgacgcggtggtagtacccttttcattctttgttagtatacttgcaaggggaggttatcctggaataactgttccagcgggatatgaaaagggtgcgccatttggaattatctttggaggtttgaaaggctcagaaccaaagctcatcgaaattgcttattcctttgagcaagctactttgatcaggaagcccccaccacttctaaagttaaaggtttaaccgttaaaaaaaaaaattgtcagaattatgatggaattgaatagccaattaagtgtttgtttaatgatggccgagactagttatgagttatatccatctaagaataaatttaagtattgtcatgtccttctatcagaaactctgacaaaaactataatgtggcaataagattcgaagtgtgtctatttagctatctgagttcattgcagtggggatttttggacttgtattatgcttttaccatgaaataaaataaatcaaaatcctgaagtgctatcaaggctcggtttaataaggaaaaatggtctcttagattccttaaaagtatatacgagaaagagaaaaagaaaaatgtgaccaaaaagaagagaaaaatctctaaaaaaaaagagagagaaaaagagaaatataaagatgaaagtaaaaattaaagtatgaaaaaaaaatagttttaaacattgaaattgaattgtttaaatatatgagcatataattttttaaattttgttcacgaaagtttatattcaattaaccttcttcaaatatatttatgattaaattatactaattacttttgagtttttgtaaaattattcaaattctttttttaaaacatatacatcattcttccctattttttaaacaattagaagaggttagttaatatataaagaatattggtgtaattttgttaaaaaaattaagagaattattacagtgattgaaaaaacagtaagaatttatataatttcacaaaattttgtcattttcattcatataaatttatattgaaggtttgatacaaccttcataaaacttatttaaatttctatttacaataagatatgaaaataagatacaaaattatctttcaataaatctatacgaatgactttttatgtatattaacattttaacatttaaaatattaataaatatattattttattttaatatggtatgaaaaaactatattgttataatgcaagtttgagtcatattcaattttataaaactaacttataagaaattattttttagtgattaaaaatgggttgaaaatatttttatacgtataggaataattaaaacatgtgtttgtttaacattttcttatcctaggaatgtataataattactaaaaatatctttattgtgttaaagtttgtttaaaaaatatataattgtgtccaaataggtataaatataaacaacgcacaggaaagttccaacaaataatgccaaaaaaaacgtcactacaactcatcacggtccctttaatttgcatcctcacgctttaaaactccagcctcgttgttgccacaaaagtacatgtacacttgatgcaaatcaaatagtaaaataaaaaaaaacgtaacttcaagagaatagtcaatttagagttacggtgttaataatataaaaagttagaatacctttttaaaaattattgtgaataacacgcatgaaattgacacaggaaaaaatgggtgaaaatgagaaaaattaaaacacatatataaatggagttgagtagtggatactaaagagaatatatgtatatttttattcactaatggggattttatgttttatgggaataaatattttttatcattaggattaaatattgatggaatgtgagattattatttacccatatacaaaatataggtttaattactttgtggtaccttatacaaaatttttaattaggtccctcaacttatttttcttttaatttggtccttcaacatttttttttcaactggatccctaaacttttatttatttttcaattgaattgtttcatctaattatcgttatgaaaaactaaccacaaatacttaattataggtactgatagtggactaatgcttttagaatgtgttgtaagtacaattaagtcaattgtgtgagttttttttataaagtttcaaccttttgcaaaaccaaataaatataaagaaatatctaggttgaattgacattaaaagatagaaactttgcaaaaaagtctcatagactcaattgtgaatataacacacccaagaagaattgttttcctgtctggagttctaattgagtctttgcggttaatttttcataacaacagtgaaatgagggatccaattgaaaaactaataacccaattaaaagaaaaaaattaggaacctaattaaaaaattggtaaaaatatagccacttataggttaatttaacctaaaatatatctaagattaattattttattatttcgtaacaaaggggagataattttttccactccaatattctcacgactaaaaaatttagccatgaaacaaacataccctaagtgcttatccatattatatttgggccagttttaagtttaaataagtattttaataaatatttttcaataaacaaattagatttattttttaaaataagtagaaaaattatttttttaagaagaagtagtttagacaaacacaaaaaaaaaataaagatttttactttctaaacttttgtttgactagttaagatctctaaaattttagaaatttcagtttatagtttctcaacaaaagtttaaattcattatttttatttatttattgggattttaaggagtaaagactgaatttttaaaagttatgggactaaaaaaaatagaaaaaagttgaaaaatcttcaccaatcaaactaaattttagagattaaaatcttaataaaaaagattaaagaaccttaaccaaatcaaataaaaatttaaaaataaaaaacgtagttaatccttaaaatatagttactcttatcataatacaaattatgccaaaaaaaacatcaccaaaactcatcatggtccctttaatttgctgcctcatgctttaaaactccagtcttattgttgccgcaaaactacatgtatacttgatgcaaatcaaatagtcaaccaaaaaaccaaaagtaacttcaagaaaatagccaattcagaggttacagtgttaataatataaaaatttagaatacctttttaaaaattattgtgaataatataaatgaaattgaagcacatatatacatgaatgtagcattaagagaatagttggattgtggataataagaaaaataatatttattcctttcgttggaattaaatattaattaaaagtgagattattgtttatcaaaatataaaatatcaacatcaacaacactttaaatctaagttaattgagatcggtgatagatgaacccaataataaataataaaagagacagaaagagaaagagagaggggaaaaaaagttaaaataagaaaaaagagaaaaaagaggtgaaaaaaagaaggaaaataactaaaataagggaataactggaacataaaactactaatggtttaaccctctactaaacttataattttttttcactccgtcctaagacataccgtccaccaatctatatctaactccattaggttttatttaactacctttccccaggtaagtttcggttgatctctaccttttttgtatcaaactcttggtaacaaactcttgttcttacgggagcatccagtgccagtctcataacgtactcaaaccacttcaatatatgttctctcatcttttcacatatcggtacactgatacatttttttgaatattctcatttattattttatccatcttcatatatccacacatccaccttaacatcctcatttttgctatccctatttttgttcatgttgccgatgtgttggtcagcattatgctccatacagcattgccggtctcataacgtactcaaaccacttcaatatatgttctctcatcttttcacataccagtaccactgatacctttttttcgaatattctcatttcttattttatccaccttcatatatccacacatccaccttaacatcctcatttttgatatccctattttttgctcatgttgcctatgtgttgaccggcattatgctccatacaacattgccgatcttacaattgttttatagaattttcctttcaacttaaggagaattttgcagtcatacaaaaactccgatacattccaccatttcatccatcatgctctaattctataatttacatgttcatcaatgttaccacctttttttaacattaatccatgtatcatttatattttgatatattttctaccaaaatataaaatatattcaagataaattgtgttattacttcataacaaatacaagataatttttccccttctatatttccaaaagtaaaaaattgacccataaacaaacatttattaattatttatccatattatatttgggtcaattttaaacttaaaataagtgttttaaaaaaattaataagcaaattggatctacttattaaaatcagcagaaaaatacttttttcaaacataaatatttaatttagacaaacacattaaaaaaacaaagaaaaatacttattttattaaaataaacttgattgtgatattgtttttaattattttagtaaagtgtcttatgtgatccgttagatatgatctatggctgatattactgcagtagggagctcgccgtagagtattatttgccgtagagaatccgaacgccaccgtgaatgtaaaaaaaaaaaaaaaaaagtcataataagatgaaaaaaaaattattatagaaaaaaaaaatagttactcctccaatgaccttcatctacatattccataatttgacagatacttattgaattatagatagtagacacgcatcgtactcgaacccagtttcttatgacaattgtcataagataattactgtttaaataaaatataacaactctattgtataataatgggtgaaattaaaattttataaattaaagtcgagttaagatcaactaagatagtattaaattataactataatcccaagttaaaataaaaaatattactaaatctaaaatcgtagatatatatatatatatatataaaagactgtagaaattatttaaataaaaaaaaaaccctattgtataataatgtgtgaaattaaggggggctaaatatgtgattttataagatgggaataaattatggcattttatagacatttaagaattaaattagattatttttttagagattaaattattatcaatttatatattcagaaatcaaaataattatttatcctaattttatattcaatttgttgtcacatatatttggtaaatttaacttataatttagctgaaaaaaaaattataagttaggaagtcaaaagttataaattaactgatttaatcattaaaagtgtttgataaaattaacgtataaatatcaaataatgtagagaacctatttaatatgtttaaatatatttttaatttcttacaatttaacttttttggttttttgttattataaattatatttattttatttttcatccttataacatttcagatagtattttattgtccttatatttattttatttttagtcgttacaaattgttttttaaattattaaattttattatataaatagttataaactttaaccatttaaaaaatacatttaagaatgattgtactaaatgattatgtgattaatgtgtggttatgttaagatgacttaagaataaatttttaattcagttgtaataattttaattaattatgttactaatgtatttttttattgacttgataatgttttttaaccgtgacaaaaattaatatttttttttattgcttttgcacttaataagtgcggaagtgatcgtgagtatgaatatatatgtatgtatgcagtgggtaagataatgaggtttaaagcttctacatgtacgaatttgggaataaatattataattattaaaattttctttcaaagacacttttatgattggttaaaatttttaattttggtaaattttagttctcaatttaatataaattaggagaaataatcagaagaaaaatctaacaaaattataattttcaataaattatagcaaaacatagaaagtcttagaaaaaaagtattagagaaaaacattaacatttatcatactataatctcatactggttatcatccttacaaagatttaatgcaaaagggtattataataaatccctttttggatacaattaaatttcttaatatgattttcattctcacaatgaagtgtatcattaatttagagaataatggagtaatttcttaattctctctaggtataacataagcaaagaagttatttgaatataaagataagtttttttatgtgttggtgtgtcttattatctcttttgtttgtgattattaaaacaaattgatttttgttttagatccttaaactttttatattaaatttatgatatattaaaatttttattttaaattttttttgtccattaatgacgtgtaataaatgaacttttatttatttcctttcatttttttttcatgaaataaagagagggttaaaatttgctttcctaaaaaaagagggttaaaatttatttccattaaaattttaatttaaagtaattaacattttgaaattttaaaagttttctaatatagtatattttttaaatacatttatattcttctgtaaaaaaaaacatttatattctgttttgtttcaaagttatttccgccgtcacttttctctaataatatatattggttccccattttgccgttgttcactcctctcttccaagttctgtctctgtatattcaaatccatactatcactttcgcttcggtacttctcttttcattgtcgcacagacacaaatcagcaccaaacgaagcccgacactacgtgaattaagcatggtaagattcagcaaaacccaatcacatcttcaattttcaaaactatttcatctctctgtcttcttttagggttttcctccctttttcatttacgttttgttctgaatgctctttatgatatgtaaatctttttttttttttttgtgcattttataattgacacagtcgggcagaaaagaaacggttttggaccttgcaaagtttgtagacaaaggcgttcaagttaagcttactggaggcagacaaggttaggttacccaattcccttctcttgtgattttttattttttaaaatggttaatgatttatgtattgattttttaaaatgatggcggaagtatgaaattcgtttcgttttgaattgcaagaactcaattgagagttagctttcataattaaaatgcaaataaactcttctacatgtatattttttgttatgttttgttttgtttgattgcagtgacagggactctgaaagggtatgatcagttgcttaaccttgtcctagatgaagctgtagagtttttaagaggtaactaaacaacgcagagatctagtttttctgtttatcattttaatggtatatgtactgcagtagctctatttgttactttcttattatgttcgtgacttcatgatactgcttttccagccttttcagcgaattttgctacaatctgctaaaatgcaaaaaatttctttcagggctagggggcaaaatatttgagttttcatctatacttttggttgattccttggattatttgctcattatgggtgaagtttttttggtgtgatgatttacgccatgaagctgcttgattatactttaactttacagaattaaatcactatttgggtatttagcaaattagtgaaaactacataaagggacttataccgactgagagtgaaatattgaatgaataacaactaaggagctaaataatgccatttttatcatcatttccactgcttctataattaagggagcgttctgaagggcttgtttaagcttatgaaagtagcttatttatctatctatatgttttttgtatttgtagtttattcaataagcttaactatgatccttatcaaaataagcactttttagcttatttcattaagctctgtaaccaagcctatatgggaattctcattttataagagtttagtgaataaatgcttaatcaagttgtttaccctaatatgccccaagtgcagatttagcactgaacttttagttccaaataacataagcattggagtggaagatcctatgatatttaaatttttttctcactttgattaagcccttgatttactcattttcttaattttctgaatgaattcagcatcattttacttatttttgtttcagcaccgaattcaaaatggaatttccattcagaatttgttcagtatagtgcagaaccgaattattgaacactcttagatgaacttggcatgtcaatacaactatgcatattattgtaccttctatgtgtcaaaagaacggatttaatttcatagttcaaatgtttgtgtgactctacttactatcagcattatgcttgtttataaactccaccaacaaaatttaacatattagcttattcttaaaaattatctaatatttcatttctgttgtttgaaagaagattttatttgtcccttgtgctgcagatcctgatgatcccctcaaaactaccgatcagaccaggaatcttggcttaattgtaagctctcctcttcaacatcatataaaaactaaaaataattacgtacctcattgctcagaggttcctcgctatgcgaaggtaagagggagagatattgtacgcaaccttacccttgcatatgcaaagagactgtttccgtattcgaacccatgaccaataagtcaccaagacacaactttatcgctatgtcaagactcgctttcagaaaaactacatatcccattgtccagaggctcatcgctatgcgaaagtaagggggaggaatattgtacgccgccttacccttgcatatgcaaagaggctatttccggattcaaacccatgaccgacaagtcaccaaggcacaactttatcactgtgtcagggtttttcctcttcttcaacatcatatgagtgtcataattgcaccttctggctcataaaaagcttgctttgctgatgtcgtgcttcattgaaattttgcatctttgcttctttggatactagggaagtttaataaatcaacaacatcaacatcaacaacacctttaacccaagttaattggggtcggtggtagatgaacctaatgataaatcgaaaataggacaaaagagagaaacaaagttaaaataaaagaatggtgaaaggagaaaagaagaggaaaagaactaaacaaggaaatgactggaacatagaactactaatggatttaaccctccaccaagcttaatatttattttgtatttgtaagaaaaatatcaagttaattaattagaattacagtccaagtacataggagagatcaattatatactcttgcaaaacattaagaacatgtcatctccttctaaaaaacattaagaacatgtcatctaagtgcattaggagagctacaagaaaaggaatttaaaatatgtttctgtaattttctattaagaattcttatataataaagcaattgactgattctggccatgttaaattgttcatcgagggtgaaaagttgtactttaactctattatcagtttttttgttttggtttatagatgtgtatgctgattgtttaaattttatagaatttaaaatatgcagtgcctctagtaaatgtacttatgataggcccttaacacatgtacaagagcataggaaaatatgatttgcccaatggtagcaaaggcctgctggtttatgagaggaacaagaataataaccgaaaggggaaatttcagttaggagagagagagagagagaggagggagagggagagggagaggggaaattataactgaatggtgactggcagcatgagtgtgtgggagtgaggagattcaggaatcagtattaaataaggggaaacagaggtgagaggataaatgttggtgagggtctttgagggttggttgcactacaacagtgtcagtcatatttctttccttttcttgagtattctattaccagaggatttttcattttttcctcagctgtagcctgtacggagctttgctccctgatttctcagttgatagtattcagtatattttaatttctacaacctatcactacataaaagcatttcctgcaagaaaagaaaaagttgataattcacatgactataagcacttcatccactagcttttttgaattattttatcattatctttcaacaggaactattttggcttagcaatgaatatttcattatcctgggaacttattttattgcaatgcaggtttgtagaggaactgctgtcatgcttgtgtccccaactgatggtacagatgagatcgccaacccctttatacagccagatgggtcctaagtgtgaagtatttctatcttaaaatctgtatgctagctgatcaatacgtcgtcgcttagctgctgagacattaatgtggagcttctgattaacgttttgtctattgtgtgtaagcttggagattctgacccatttcatgttcttgttctgatgaagtttatttctctgtgatgtgtcttcagctacactttgaggacttaatatttatcatggattacaattgcacataaattagaagctaattctaacttgaccagaatgaaagttcttcatggcactttatatgacacttcccttcctcaccattcttgttaatcaatcttaccacacatacacgcaatctagtctagctgttacaggttagaagagacctagtaatggagaatttggatagcttccacaaagttttagattctaaccttatactgtgtttaaaaaaaaagttgagcgaacactaattccaaaggacgggctactctattgcaacttgtacattttcagttctttatctgcttgaagtgtggaaatgtctattactattaggtttggccagaggagaaaatgaataattgagcaaggatgggtttgaaagaaattttctaacttttatccgtaaagatttttttaagtaattataaagatagtgtataaaatacgcatttttaaaaaaaattcaaaatgtctagttgaaagaacaagagaatgaaaattttaatctctaaattatatattttaatttgtaatatttagttataggtaatatactaattaaaaagatgaggattgagatttctttacctatatactctttttggttgggttgaaataccatgaaaatgtagaagtgaggaaatagagtggatagttaaaacttaaaactcatcctggtttggcaccaatgaaataataaggaaagaattgtaggtctcatgtacaaaaatttcatccatgaagtaaggaaaaatagcttcgaaactgggagaagtgaggagaaatggcataaattagtaatcatgaaatatatcaagcaaattttttttatctttttcttttatcttttttatttcttctttatttttattaaactaaacaactttaaaatttactttatttctgtttttcctattaattctatccgttgtatttcttttcttcctaccagttaaatcctacatgcatttataaaaaatttcttaatttaattacaattcttagatcttagttaggaaagtccactttgctccctactcctaaacacttattaagcaaggagtttggaagcctggtgactggtgcgaattgaaaacggtgaaaccacacggtaccagagaacagaacaacaacagctgcagcagcaggacatcatgtgttggggatgttgactttgttgttagtcatatgtggttggttagattccattaagttgcaacctgtgattattttttcaggtcgttttacttacgtgcatgcatgcgtttgttggcgttggaactaatggtattcatgagataaaacttatcaaaagagtataaaactaagctacaatgatccgtttccaacctcttgactattcaatatcttgacaatatataatgtttaggttcaggcttgaagtctcttatagtttgatggagcaacaaaagaaaggaggtgatggagctggagaagcgcaactctgaacttatatattaagatgaaatttttatgcaaaagagttagtacttaacttcataataagggattaaatagaaaaatgtttttaaacccatcttaacccgaaatcatatttgtatgaaaagtatttagtagacaaaaacttaccttgtcagaagtaacatatacctctgcgttccattttccccttggtcaattctttcttcagaaagaaacacgtctttcttcgtttggacattcttatttacaagcgaaaatgacgtatggacagtctcacaaacaccaatgacggccattgattgaggagagtaaaagaattgcatatcatacttgcgtgaaacttgaatgtcaatcgatcagaagctaagctgtttatgacaattataaaaattctaatcttaccactccctagtcttattttattttagaggttttagaattaaaatttgagcaatactattcacgaatcagtacgataagtacttaagagaaactaaagtgactatatttactcatacaaaatacatgaataaaactttaatgcttaacactattttttaaaataaatattacttaaaaatttacaaaattgttaaacaggtttgaatagaaatcagctttggtacatatttgacaaaaactattcctactaaatatcatttttcttaagatttttacactctcaatcaacatcctctaaaatatatagtgaaatttaaattaatttattaagtatatacatatatatatatatataataaagtacacattaaaaaattattactttaatgtttactttattatttatatatgagatataagaattaaattttgtaataattacactatttaatagtgttatttatatatatggtttcatttaaaaaatttatacttgatgtatattagcattatatttattaaattcaattcaataccatatattatatttagtaaatataataattaatactccctatgtcccattaaaattatcgtcctaaatttttttacacacaaaaaaattaataaatatatgtatgagatataagattaatttttgtaataattacactatttaataatgttatttatatatatagtttcatttaaaaatttatacttgatatatattagcattatatttattaaattcaattcaataccatatattgtatttagtaaatataataattaatactctctatgtcccattaaaattaccgtcctaaatttttttatacacaaaaaaaactaataaatatatgagagagttacaattttactatattaacatgctattaatcttctttgttggaaatgatgcaagtcaatgatagttattagaggtataaatgaaaagaataattaatactgttatggttatcgtgttcagattacgtagacgttatagtttgggtctgggcccaattgttatgaataatcatgcaaataacttacccatagaatgtggaggctgacttggtccatactgaactttgagaacgtgctggatgaggccgggaatccaggaagcagttctaatgcccgttacgaggtattttgtttataaatacacagtaattcctggtgaaaggtacacacacacattctatctctctctttcaattacacagagcacacaccccacgtcaattggtgtatctctgtgatctcctgccccaaggtatcaccttccattgatatccttgaagctgcagagttagagtgatcaaacagcaactccatagcacttcggtgttatacatttgtgttctggaaagaaccagaacattggcgccgtctgtggggaacgataaacttcgagtcccacgcttgtcaataatggtaaacacaagaaacagccactccgtaccacattcagagatgccgaacagagagatttgcctaccggagaatcagaatgtggcacggagggaagaaatacatgtgacggaagccgtttccgacgaagcttcctctcccgctcagacagaccaacggaggaccccaccggtgcgaaggatgggccaggaaggggagctcgaaggacagcttgtcagcaatgttctcaattcaatcctaacccgaattgagaacatggagaaaagacaaaatctacagagacaggaagacatccgtggcattacacgccaaatagaagaacgtaatgaggagtggagacgtgccgaaatgcaacgaacgacacaattggagcagcagctgcggatgatagcagaccgggtacaactttcaaatcctgagagggagacgcaggatttgaggacccacttgaaccaaagaagaagtaccgacccggaagaccaaaggtggatagaggagccgcaagatctaaggacacacctaaatcaaagaagagataccgaccccggagatcaaaggaggatagacgagccacatcggggtcaaaaccgggcacagaaggaggcacgcgatggagtcgacacaaaccagagccgcgacgaaaatccgaacattcgagcaaaacatgacgacaatcccactggtagggcaaacaacgagaggaacctgacgggagaacaaaattttcgcgagaaggcaggaccagtgtatcgtcggaaatatagcaggggacagcaaaacaacagtccattcgtggacgacatcgtaaatgctcgatatttggatgactttgatgggtcattcctatcaaagtatgacggaacacaagacccacaagtgcatatcgacgaattcgatctgcagatgtgtgtccggggcattgaggagcccataatatcaaggattttcattacaacattgacgggcccggcgcagatgtggttccatactctgccgcctagatcaataaagaatttcgaagactttggtcagaaatttttattgaacttcgcgactagtaaaaagcagccgaagtccgagttcaccctgggcaaaatcagacaggcacccggggaaacactgcagagttatttggatagattcaaagaagccgccctgcaggttgatgggctagaagaaagagtccacgtatacttgatatcggccggacttaatggttcgtcaagatttgccaagtccatttacaaagacccggtgaaatctttgatggaatttcgtgcacgcgcaaagaaatacttggagttggaacagatggaggtcgtcaacaactcgggacgaggaaaggagcgtcatgaaaggagaagcccacccccaaaaaataggggatacccggagagtcgagctcggaataatgatccaaaatcccgaccaggaagatacgaaaacaaatatgagaaatacactccattgaacgtatcccgttcacaaatctggaaggaggtcgcactcacagagatgaagaaggttgaacgaccccgcccagttttcaacaagggtggattggataaatcacgattttgtgaattccacaacggacctgggcacaccacagaccaatgttgggatctgcgggatgcaattgagaagttcatccgagaagaaagaacaaatggaaaggagacgaaaatcaacatatcaacgaaggaaagagacctcgggaagataatgacgagttcccggaacccgagtttgaatgtaacgtgatttccgggggaatgggcggtggcggggatactgccactcaaaggaaaaaatatctgaaggaagtgctatcggtccaggcacaacctaaattcaaagctcggacaggagagccagaacctccactcttgtatttcacaaagcaagacatggagggggtagtacccagacatgaagacggactggtgatctcagcgacggtgggcaattgccaggtaagaaggatgtatgtagacaatggaagttccgccgacataattctattgaacgcatttcggaagatgaagttggacgttaaggaattaagaccgtgcaaaacgatgttgatcggcttcaacggcggaaacacgaatgtaatggggtctatccgcttgcggttaaccttgggaacgagagaagcttacaagtctgaggaagtggaattcgtcgtggcagattttccatcccaatataatatgatattgggaagaccaaccatacataagtgggacatcttaatgtccacaaagcaccaaaaactcaagtttgtgggcagcaacaggcaggtggtaaccatatgtggcgatcaaaaagaatctcgacaatgttattatgatacggttcgaaaaagtgaacgagaagctaacgacgacattcataattgtgtacgttcagtaaatgtggtggaattggatatgcgagaagccacggatgagtggaggccggaaccagtggagaaagttgagcagattctgattggagaccaggttggtcaggtgactaatattggtggaacattagaacccgaacagagggaggaattgatccaatgtttaaagaaaaatcgtgatgtatttgcatggaaggcgtcagaaataccaggcgtcgatcccgaattctgcagccacagactggcaatgtacccggggtcgaaaccggtggaacagaagaaacgaaaattgggaccagagagagcctaagctttgcaggaccacattaatgagttgctgcaggccggcttcatacgcgaagtacaatacaccacttggctgtcgaatgtcgtaatggttcgcaagccgaatgggaaatggagagtgtgcacggattacacggatttgaacaaaatgtgccccaaggatgcataccttatgccaaacatagaccagctggtagacaattcatccgggtacagaattttgtcgttcatggatgcattttccgggtacaatcagatacccaatgcacccggacgatcaggagaaaacgacgttcataggtgacaaagccaactattgctataacgtcatgccatttgggctcaagaatgcgggggccacataccaaaggatgatgaatagagtattcgagtcacagctcggacgaaatattgaggtctatatagatgacatgatagtcaaaactgcaaaggtggataagcatgtcgaagatcttgaagaaacctttggccgactacgcaagtttaacatccggctcaacccattaaaatgtacctttggggtcggggccggaaagttcttgggtttcatgttaacacacagaggaatagaagctaatccggataagtgtcgcgctgtcctggatatgcaattcccgaccagcaagaaagaagttcaacaactaacgggtagaatagccgccctcacgcgctttatgccaaagtcagcagagaaggcattgccgttcttcaagatgttgaagaaacaagctgtcatagaatggaactcggaatgtgagaccgcctttactgacatgaagaaatctctggcgtcgcccccagtattgtcaaggccggaagcaggagaaattttagtcatgtacttatcagtaggtgaagaagccgtaagtgcagtactaataagagaggtggagtccacacagaagtcggtatactttgtaagccgagcattgcgcgactccgagtcgcggtatcaaaagttggaaaagctggtcttcgccctgattgtcgccgccaaaaaattgcgtccatattttcagagccataccatagtcatacggacagaccagccaattcgacaaatcttacataagccagatttggcaggaagattgaccaattgggcagtccagttgtcggaaatttgatttgaaattcgaggctcgccacgcgattaaatctcaagcattggcagatttcatccgagaactcaccccccacgcctcgacaattggagaatggtggaccctatacgtggacggatcctccaacaggaaagggagcggagccggaattataattgagaatccggaaggagtggcaacgaaaatttcactgcaattaggttttccaacgtcaaataaccaagccgaatacaaggcattgatcgtcgggcttgtacaggcaaaggagcaggaagctaagaacgtgaaagtctacacagactcgcagttagtcgcatctcaaattgaaggccgatatcaagtgaaagggcccttgctggcaaaatacttgagccgaataaaagaattgatgtccgaattcggcgaggttgtggttaatcacatccctagagaagaaaatgcccgggccgatattttgtcaaaactggcaagcactaaaaaacctaggaacaatcgaaccgtaattcagcaacagacgttacagccgtcgtgcataatgatgatcaccaccgacaatgattggcggcgtccaatagtaagttatttggagaaggggtgatgtgttgcaaacacatcttagttttaggatagttttaggttatgttttgattaaataattaggatttagattaattttagctagtttattaatattatttcattttatctaatgtcaataccaattatgcatttcagggcttaaaagaggagaataaaggcaagcaaaagaagaaaacaaaatctggagttccacgccactcgcgcggtgttccacgctagtcgcgccagtacctcaaggattaagggtattctcttctgccaagccgcgcgacaagcgccatgtcccacgcgacaagcgccattctttcggtcattccacgcgactagcgcgagatcgcgcgcgggtcgcgtgaggttgaaattgtttccttatttaaattatatattttcagatttggtactatattaggattagttgccttaattaaaggattctataaatatatttagtttccttaattaagaagatttgattcagatttggaacaagaaaataggccttgttaccctaattagatttatctataaataaaggcctctaggaagcatccaaatcacaatctctctaccatctatcaaccccttccatcactctctctttctcatattttcaccattggaagtcaagaatcaaggcaaggtcaccaagaatgtattatttgacagcctttggtttcttgaagcctatggcaggctgaacttgtattgtgggaaggccatgaactgatgtaactcctctgtaacttgaattggtattgattctaatgctgttttgattattttattctactctgtgttattcaatgttttattcttatttggaattggctattctatttaagtattgagggttaggattcgcaatggacacgttggggttctaatttctgacctgtttagaataatagttgttcttcgcttagacatagggatgcatggctacggattttataatatgttctttttcatgcttaacttaatagaattcaccaaggaattgggtttttgaattgggttaaagggttaattcactaaggaattagggattaactaacttaggaaaggcttattctccgaataatcttaacaagatcacatgagatatattctttgaatacttagtttgacagattcactaagggtttaggtttctcgatcgaattaaagggttaaatcgctggttatgactctagtagttctaggatttacgaatttaggaaagatttatcatgtgtgtgacttacaataataaaccaatcaagtgaaggaggtaggaacaaaggggattgtacctgaccacaattgtttcttccattggtaacttcttttatatttttactgcatttattttctatttctattcaaacaacaaatcaattcaacaattatctcttattttctgttttattttccaatcatttagaattaatattattgtaaaaattaccccaatccctgtggagacgataactcacttacctactttattacttgttaacgatcggtgcacttgccgtaagtacacaacaagtttttggcgccgttgccggggattggttaacggatttttacagtaattttttaattttagtgattggaatttttgttattaattgcttctccaagttttatgcgaggtttagtcaattctaaggacttgcagttcgatcccgaaatagaaagaaccatccgaagaagactagccatacaaagaagaagaagagaagctgagaattttgactttgattcaattcccgaattagagttggaatcagaaatagagatggctgaagaagaaagaaatcatcggcccccaccaaggccaagacctgaggatgaacttatggaggatattctggctcctatgttcacaaggcctaactccagtattgtgaggccaccaattcaagctaatcattttgacattaatccttctttgatagtattggtggaacgcagtcaatttggaggaaaagattcggaagacccacatgactttatagacagatttcttagaatctgtaataccattagacatcaaggagtctccgacgatgcggtaagattgagtttatttccctttgatgtcaagggaaatgcattgagatggctaaactgtcaaacaccaaatagcatctcaacatgggaagatctggttacaaggttcttcgctgaatatttttccatggaaaaatacaaccgcttggtgaatgaaatcaccaacttcacacaaaacgaaagagagtccttatgcgctgcatggaatagatttcaagagttgataaggagatgtccacagtatgatatgcctgtaggtaagcaggtaaggatattctttaatggtataactcctaaaactcgaatgattgttaatgttgcagcgggaggcacaattagatcaaagacagcagctcaaacttatgagctaattaaatctttggcttgcactgaaaacgtaagcagcaccattccgccaaagagagaaccaatacaattggacagcagtgatgccatgcttgcagaacagaaaattttagcccaacaattggctaaattaaatgaaaagatagatagaatgcaagtctctgcagcccaagtttcagccagtaaaccacaagtcagttgtgaatactgccaaggtgagcattattctaatgtttgtcctattcttgttggagctgaccctgtgcaggttaatggcatttggaatgaccaaagacagcagcagccacaacagaagaactacaattatactgctggaaacaattatcaaaggaactttcaaggaggaggactggactacaagtccaataattatttgcaacctcctcccattcccaacactagcatttatgaactttgagaagatagtaatgcagctgtcacaaacaacatctgacttcatccaagagactagagcccaccacagaaatcaagatgcctccatcaagaatcttgaaatacaaattggtcaattggcaaagcaaatttcagaaaggccacaaggacaattcccaagtgccacagagacaaacccaagggaacaggtcaatgttgtcacaactagaagtggaaaagtgctaaatgaaccaacaaagcatgaggcaagcaacaaggaagctgaaaaatctgcagcagctgatacaaatgaagaaaaagctacagaaaattttgaggagccaaattctgcacatcaacaaaagcaatgggatttctctcgctttgagaaacccccatatccggtgctaaccaaacagcaaattcaacaacagcagtttgccaggttcttagacatgtttaaaaagttgcatgtaaatattccatttgctgaggcattggctaagatgcctcattatgcaaaattcatgaaagaaattatgtctaagaaagagaagctagtaaaaggaggaaccataccactcactgaggagtgtagtgccattatcttaaggaagcttcccaagaaattaaaagaccctggaagttttaatattcctgtatcaataggaaatataaatataggaagggcactttgtgacttaggggctagtataaatttaatgccattatctatgtgtaagtccttaggcataactgaattaaaatccaccggagtttccttgcaattagcagatagatcattaaggaaaccatcaggaataattgaagatgtgttagtgaaagtggataaattcatcttccctgcagattttgtggttttagatatggagggtgaaagtgagatccctctacttttaggaagatcatttttagcaactactagggctttgattgatgtagaacaaggtaaattagaattgagattggatgatgaatatgtgatttttaatgtttttaattctaagactaatccatctaaaagttataactgttctatgataaatgtgctggatgacatgagttgtgcaggtgtagtaacatccttagatgcagaaaatactgcagctgaagcaaatggtgcagcagaaattgctgaagaaaattggacagcagcagctatatcatcaacctcagagcttgcagtaaataacactgcagtaagtgcagcaaggacagcaatggaaacactaggaattgctgtagaatgcaacactacatataaagaaaaaccagcagaacatatgcaaattaaaaagcaagataatcatccaattggagcacaaaaaggtaagctagaaataagttcaaccaaagctggaacattgcaatctgcaattaaggtctttggctgcaattgagaaagctacaaccaagaaaaagaagactagaaagaagcaacttgagccgggacaaaaggtaatgctagcaacatatcgcatgatatttccaggtaagaaatcattttgttggtctggtcccttcatcattcaaaagatttgctcatttggattcatagaaatcatgcctgtagacagaggtaaaccttttaaagttgctaaatgccggctgaaacctcacattgaaaaccaagtggataatgttaaaactcctaatccacttaattccactaatgattaaaaagcatgatgcgtctagctaagacgttaaacaagctttggtaatgtacataactattgattaagttttgaagttgttagcctagtctttattattatacatatgcatctatctatataatcattatatttaattaagtatttccattaatattagatttttaatttgttttagaagtaaataaattaattttcatttttatgctttagaataagttaaattagatagcagtaggtccataaaatccaaaaatcaaaatataggacttagtgaaaaaactgtgcagggcatctggcgcgacccgcgccgcccaccgcgctacccgcgccaaagatactgtccacccacgctattagcgtgaaatccgcgccggtcgcgcggtaaggcagaaccaaaaaggacttgcactggaatctggcgcgacccgcgcgagatcgcagacttagttttatttttaaaggctccagtttgtacctcatttcttcctactcccaatttcattctcagacttaccctcaccccaaatcttaagacccaaagcttgaactccataagggttagaaataaggtaagaattctgaaccttatatgttttgaaactcaataatgggatgattatgcactgcactatatcaaactctcatcttctcattcaattctaatgaaatttctggaaaaaccttagggtagagaaccaaatatgaatagtactaatgaatgatgatcaattggttgtgtgttggctgttttcttttgataaaattttgggttttgacatactccaaatgcacacactatgttgatttgttttaatgcataccacctgtttgctaaaatgcctatatgaaaaattagcttgtaataagatcaaggttagtttgatatgcataaagcttcaattaattaaaattgcatgatgggaatggctagggtaagcatgaattgagtgatgatgaaatactattaaggcatgcattgataatgttttgaaccaaataccttgaacatatcaaaagctcaaatctgggaatgggagattcatcttttataggtgcttaagttgttgaatcaaatggagtatgcttgcatgaaataagtaaattctgaaaattttgatacatgcaaggacttaaatctgggaattgttgctaggcatattcatggtatatgtgaattctcgtgtggttcctagttctaattataatatgtttgcatttaaatatgggaatccacatttgtaagctttgctatatgctaaattgttctatgatatttgtagcttggcttatgtgtttgatgttaaaatttcaggtgtctgagacctgtttggggttgttataaactgattattaccattacaaatcgtaaccccaataataaacagctgattatgtgaaactatggaatgaaataaatctgggaattgtgagcactgcgaaattctgagcagtttaaattcccaaccacttacatacataattgttgtttttaacaactgtgctagtatttgtttgattattattcactaatgcacagtttcatgatttggtggttattttgagctacaaataatggaataaatctgggaattcacccactgcaccaggtataaattggaatttttctgcactgtaggatgaagagagtaaggaattattgttacatactgcagcaaaaggacaacactggaacctcttatttgttttaactgttttaattttaattttcagtatgcttttagtttaactgttttgttagttagcggttttaaataagttatgtttggactaatactcagtgctagttgagtttatcaaataatgcatacatgatttgaatgttttaatcctcttcacttgttgctgaggacaacaattttctaaatctggaaatggtcgtatatgcattatttgttaaatcacaaaggatgcccaacagaaaatttgtgttttaattgttttagtcattattttaaattcttagttaattatttcaataaaagttgcagcacattaaaaattttcagactaaaaagtgaatgaacacagtaatggataggaattctctgataaaagcttgtgtgaaatgaaatatagcatgaattgcatgatacatgattggattttgattgttggtatatgatatgcatgttgaagttgaaatgttgcttgaaatgaagtcaatagtgattgacttgagtgaaatacctgtgagacttttgagccaaacggtaattatttttcttcttgagagactccattttcttagtactctagaacttgaattgtttctctggatgcaggtataaattgacatgattaaggcactttcttcttcttaaaaccagggccaaattgacttaccttcaattattattccatttgcacctaattttgagctttagcctttcaattctgttacctaaatcagagctatgtccattaaccaacctccctgaggctagagaaggtaatttaagttcatgacagcagagaacagggaagtgttcatcaaggcatcaaggaaaacaaagtgaattcaattggtatgaaggaaaaagaagaaataagcagcaggccagttgagaaatattatgcctaaaactataagctgaaaagtttgaaagttgctgtatagtgaaaagaaaagaaaaatcaaaaagaaagttattgtttgttttgttttatttattataaggaataaatgttgaataaagtaccagattgtgaagaagatgaacaaggaaaatggaagactacaggattggacttaaaggactggatctagcctcatattagctactatccaaagattttcctaccgttagcccagccaagttacaagcctcaaagaccttctgatctaattatgcttgcatctgttgagaatattttcaagcctatggtagtgctttgattatgtttgagtgagagattgattaacctaatacacttgagtgcatgagtgcatacacacatttctgtgaggaatactcaagtcatctcattcattgatgaatttgaaagtaccatagaagctttaatataacttgattatactcagcatgataattctaggattgtaaattatggttcaggtttgattgttgatccttgtttttatcttagagttttgtctgttgctgaggacagcaactaataaatctgggaattatttgattgttgcaaacacatcttagttttaggatagttttaggttatgttttgattaaataattaggatttagattaattttagctagtttattaatattatttcattttatctaatgttaataccaattatgcatttcagggcttaaaagaggagaataaaggcaagcaaaagaagaaaacaaaatctggagttccacgccactcgcgcggtgttccacgctagtcgcgccagtacctcaaggattaagggtattctcttctgccaagccgcgcgacaagcgccatgtcccacgcgacaagtgccattctttcggtcattccacgcgactagcgcgagatcgcgcgcgggtcgcgtgaggttgaaattgtttccttatttaaattatatattttcagatttggtactatattaggattagttgccttaattaaaggattctataaatatatttagtttccttaattaagaagatttgattcagatttggaataagaaaataggccttgttaccctaattagatttatctataaataaaggcctctaggaagcatccaaatcacaatctctctaccatctatcaaccccttccatcactctctctttctcatattttcaccattggaagtcaagaatcaaggcaaggtcaccaagaatgtattatttgacagcctttggtttcttgaagcctatggcaggctgaacttgtattgtgggaaggccatgaactgatgtaactcctctgtaacttgaattggtattgattctaatgctgttttgattattttattctactctgtgctattcaatgttttattcttatttggaattggctattctatttaagtattgagggttaggattcgcaatggacacgttggggttctaatttctgacctgtttagaataatagttgttcttcgcctagacatagggatgcatggctacggattttataatatgttctttttcatgcttaacttaatagaattcaccaaggaattgggtttttgaattgggttaaagggttaattcactaaggaattagggattaactaacttaggaaaggcttattctccgaataatcttaacaagatcacatgagatatattctttgaatacttagtttgacagattcactaagggtttaggtttctcgatcgaattaaagggttaaatcgctggttatgactctagtagttctaggatttacgaatttaggaaagatttatcatgtgtgtgacttacgataataaaccaatcaagtgaaagaggtaggaacaaaggggattgtgcctgaccacaattgtttcttccattggtaacttcttttatatttttactgcatttattttctatttctattcaaacaacaaatcaattcaacaattatctcttattttctgttttattttccaaacatttagaattaatattattgtaaaaattaccccaatccctgtggagacgataactcacttacctactttattacttgttaacgatcggtgcacttgccgtaagtacacaacaaggggacattaccagacgacgagctagaagctcggcgtttgatacgaacatcgaccatgttcacgatcatcgacggggagctgtacagaaaaggactgcacaaccctttgttggtatgtgtggccccggatcgagtaggatatatcctgtctgaaatacatgaaggtattaacgggcaacacatggggggaagagcactgacaaggaaagcacttcgagctggatattactggccgacgatgggtacggatgctgccaagcatgtgaggtcatgtgaaaattgtcagatgcacgcttcaagggtattatccccgccggaagaattgcaatccatttcggctccatggccgttttataaatggggtatggaccttttgggtccattcaagccggcggaaggacagatgaagtggctgatagtcgccatagattattataccaaatggattgaggcagcccccttggctacaatcacttcggcccgagtgcaaaattttttcgagaggaatataatctctcgatttggaatccccggagaagtagttactgacaacggcactcagttcacggacaaacaatttcaagagatgatggctagtttccagatatgacaccgttttgcgtcagtagaacaccctcaatccaacggtcaagcggaggccgcaaacaaggcaatcctaaaggctttacggaagcgaatgtacgacgtcgggtcgacctggacggaacagctatattatgtcttatgggggatccgaacctctgtccagtcgtcaaccggggaaactccattccggatgacttatggaaatgaagctatgatcccagtcgaagtcggacaacagtcatggcgacggagtcaaatgctacgagacggagaggaagcaaacaacgaagttttggcattggagtcggaacttattgaagaggtccggataacggcccatgcccgggaattaaaaatgaaacaacagatggcgcacgcttacaataagaaggtggtcccgcgacagtttgaagagaccgatttggtactccgacgtgctgacatcggaaataaaaacgctcgggacggaaagttagcagccaactgggagggcccataccgggtcattaaaaaattaggcaaaggggcatatatgttggaaacgctacaaggcaaaccagtcaagcgaacatggaatgccgacaaattgaagaaatactacagttaaagtctcgaccttccttttaataggggtatggattcggaaaatgttgcatccgagtccgtatggtccctgttcatcgaaggtacatgaggcagtagaagaaggcaacctcgttattaagggtatgggtccggaatacacatatccgagcccatatggtcctctttcacgatgaagacgttgttaataaatgcgaactcggaagcctaccttctgagcatgtcatcgtatcaaataaattatatcgttgtaatttctaagtgttagtctgatcatattcggacacacatattgttattgtaacaacgaatataaatgcaagtactatgaattaccacgatattgaatcattttatgcggttttgtagtacgatgactatgaatgatacgctaaacggccccgatcagaccggataatggaagcctcctttagcgtagttgttcacggtcagacaaacgacaagcaataaataaaataaataaatggtcgttggaaccaaaagatgcgcgcacaagatattttatgaatcaagtaaaaagcttgaataatcactaaataaatatttgttccgggcaccaggcccaacaaagaaaagaaatacaaagataaaacaataatgtctgcctccctaatcctttgaaggaacggaatcgggagtcggctgagatggatcgggaatggatgtggggtcggcaacagaagtgacgacaggagcaacggaggttggttcttcggttgtcaaaggttccgacgccactaccgaaggatcttcagctgcaggaggaggaaacagttgaccgtcctcgacataagccaagaaatgcatcccggcagtagtcatccctacccgggggttcaagaaagtaatctgctcaagggcgttattgaagccatcctcggcagcatcacgaagggttgctttcatagcagctagccgaccttcgtaatcctggacgcaggcttctttgtcggccttggcagaatcaagggaagaagtcaggagggccaccttctggtcggcagcttcaagggagccttgacaccgcgccaaatctacccgcagggaggcagaaacggcttgggacttaagtaattcctcccgcaaaagcttaagctccgccgccgactgcgtttggagggtagcaagttgagccttaaaggaaacaagttcctcacaggctttgtccttctcctccaaagctttgtccttttccgccaccgcaaacccgtacctgcgacattaacacttagaaatatatacaaagtataagtagagttaaaaatgtcacaaggaagatgcatacttctcccgaacagtggtaagtgctcgaacaagagaagcacagcgaacgacattctcctcgatccggaccagctcggccagttcttcatccaccggggcacccggcttgagcatatatgaagggggtttggtcaaacgaaccaactcttcagtaaccccttttttccatacattatccgacgaacccgcacctcaaggtgctcggagccagcagcgggggtagtacgtgggcggccatccgccacggtaagatccacagtttcgaccatcgaaaccggggtcaaggttgccgaggaggaaggcagtggagcagccggagtagctgacgccgccttttgagcaccttcgtcaaaaaacgccctgtaaggaggcgcaccacgttttttggacggagcgctaagtttgtcagtcgccggcctcttgcctttgcccttcacttcagttggtttggaaatatgggtgacgtcggccttggctttaggaggaggtcgggatcccattccggttacaatcagaaaacatcataattaatacaaatgcagtgataaaccatgagataatgtagtcaccaaagcagaccatttcgacgaccaacgccaatgtagtcagaagttttaggctgaccatgagcgcttataaactcagaaatcacgaagacagaagaggcatccgagtcggaaagatcctcttcgataaatcgatagttggaatgatcctgcttgtaatgatcatctgaccagtacaagggaaaaacccattctacatcggacgactcaggaccggacaagaaaaagggtcgccgatgaggttcggtggcaactttgaagtatttgtccttgaagccacggaaggagtccgaaaagggatcgaagagtttccgtttactctgactacgaaaggaaatccacccttttcggtcagaaggttctttgcctgttctaggggtatgtggagagaaataataaaagaagagaggaacggtgcaggggatccctaaatccgtacaaaataattcaaaagtacgaataaacccccagctatttggatggagctgggaaggagctacccgtagatgatttaaaacttcgatttcaaaagaggaaaaaggaaaggtaatacctatttgtgttatgacatcttgaaaaaagaagaagaagttggggttattaccctcccgttgagcgcaaatgggctcaccgggcaggggagcttgaagggcgaacccatcttgcttccctactgaagtcgacactatactaggaaggtcgaggacagaagaagttcgaagaatttcataagtgacccaagggaacttagacgctaatgctgggggcacatctgaataggattctacagaggcagattcgtccacggtttccgaagtaacacccattatacctacgaaaatgaagaggggaaataaaagttagtaaacatacctggaggcaacgcatcaaattcacaagacactaaggccgaaaccccgtcgacgacagaatgagtatgcgatcctggttgcaaacccttgaaagcaggacgcaaaatagggttatgacgacatgaactaagaatcgaatcggcaatatcgtcggagcctatttgaacataatgaatggcctcggacacacaatccatacaggcatcataatcaacctccattgcttcaaccgaggatgaagatgattcctcatcataagatggagaaaggccaactggagggatagggtgatggcaagagaatcctagagagagacctcgtggactaccagtatcaattttgggcccaagaatcgaagagtccaaagaagataaagttctagaagaggctggacctaaggatgggcccaatgtccttggtttaaggtttacaagaatcggaggaggcgggggaaataaaggggctaaaccgccaaggtcggcggcagtcttttgttttccggaggaggaagaacctccagtatgacggcgaagggggtcactttcgttttcccccgccgaaagtggaaggccaaacaataaccaagcggccctagggccaaactttttccttatctctgcctcctcttcaggggtcattcttagggcaagttaaggaaaatcaaaggagaatcgaagaaaaggagaatgatatgattacaaaacgcgaaggaaaacccataaaccaagaaaaagtcagaaagaaactatgatgcaaccctaaaaatcctgatgctgacagagtcacggtaatgcaaaaacaccaaatgatacagaaagaaaggagaaagaaggtacctgcggtaatgaggaattaaaggatgattgggagaagaacgaagggggaacttgcagaaaatacgagaggatgcttgaaaggttaatggaagagaagagaggaagtaatatgaggaaataagcagaagtggcaagcacggaaaaaagtaggcacgattacggggttttgaaaataaaatttgaaatgtgatgataacttgcagtaaccaccaggcgcagggaaacggttcagtcaccacaatgaaacgacacataggggtatcatggtaaaagcacgtccaattatgagggcaagagagtaaagttacgacaatggtaatcattaccaggcaaatgaagtgacagatcctttaaagacatttattgccattaagggcaggaaaagtaactgattcgaatcaggaaggtcaatagccgtttcaaatatgttataaacaatctgggtacattactcgtccagggcaaatccgaccacaattattgggatgtggtcaaatgcagttacattcagcagaatccggatacgtgtatccataaaagtctagtcggagatgtttttctatccggacagtcatatgcctccaagagtggacagaacaaagcatagtcatgggaatacgtctccaaaacgatcgaagaattgtatccggatgaacgtagccggataagttactcggagtattgcggacggaggattatccgaatagtattctacccggaagaagccgactaattgtagtcggattaatggttaccctgaaggtagcaaatcacctgatgcatcccggctaccaagtatacttgataaccgggctggggggcaactgttatggttgtcgtgttcagattacgtagacgttatagtttgggcctgggtccaattgttatgaataatcgtgcaaataacttacccatagaacgtggaggctgacttggtccatactgaactttgagaacatgctggatgaggccgggaatccaggaagcagttctaatgcccgttacgaggtattctgtttataaatacacagtaattcctggtgaaaggtagacacacacattctatctctctctttcaattacacagagcacacaccccacgtcaattggtgtatctctgtgatctcctgtcccaagatatcaccttccattgatatccttgaagctgcagagttagagtgatcaaacagcaactccatagcacttcggtgttatacatttgtgttctggaaagaaccagaacaaatactatattaaaaattaaaatgataattattttggaaccgaaagaatattatttaagaaaactatagtttcatttataaatttatataataccattgaatgcttaaattaattaatgcaaaattgttccaatttagatggtactagtatttattatctctggttatatatataaaaaataaaagatattttcttggttctaattataaaaatatagatatattttattgctaaattttctttttactcctaatttgttaggtctattaatgatatgaacgaatctctttataaaagctatcacaaaataaaacatatttatttgttgaatttgaaaaataaccatctaatttataaaatttcatgattatttttatcataaaattaaaacttgataaaattaattaattaaattacttttatttatcttgacaaactacgtaattgtttcttatagtatttagcatcagagatagtactattcttttttatcaattttggtagtaggaaaaattgaatttgtaacttttttttcttcttgtcttctatttttctctctcttaattttgttaattttatgatactatttatatttgatgggaggaagatattagtagtactgataaagttataaacatataagtaatgtaaatcatagttaagaaaacgtggctgttgcgttgggaacatcatatagatttgtataaaactcattttccggattggcacagaaaaaagggtccggtgtccttgaccagacagacgaagaaactagaaaaatgtgagacgggccccttttcccttacgttgcatcagcatcttgttgttatgggagagcaactgatgtagtaggtaaagtccattgagagagaagagagtaaagtaacggccaaaataataaaaaaaaaaaacatcataatcttcagtttttttttttaacccgaaattatatacttaaatacaagattatcttaattgacagagcgatgcccattcttttctaacactgatccacacacgcagatagatataaaaattattctttccccatccaattacctttttcacaataatatcactgacacagtcaaactccaacaattacattcaacccgttacacttgcattacataggagcaatagctattttagctattgcctctcttctcttccaaacaaccaaaccaaagtactcttttttatcttccctcattaaaagctgcgtaacgttcactgatcccatcttcttccccgaaccttcaatccacatctaacaatacccatttccgcaaaaccaccaaagccaacttcttttctgttttggcccacaccccacatgacatagctaacccatttcaattggggttggttggcaccgtcctaaccttaaccaaagccaacaccttttctctttctccctctctctttctctctctggggtttcttttttggaatccctgaactgaatttgcgttgtgaagatggcggcggaaaaggttgttgagatggtggcattggagtctttaggaaaagggttcgatttggccagcgattttcggttgcggttcgcaaagggaattcgtggagagaggttggtggtgcttgatgaacagaacaagagggatattttgattcctggaactggaggtgttaccattgaaggggtttctgagaatattcgttgtgataaaggggatagaatacgcttcaagtctgatgtacttgaattcaaccaggtcccttttctcctcctccttctttatctgttactgtagatgagttaggaggatttcgtttttgaattaagatctgtttgtttgtgttgcatttttggtaaactctgcgtttttctccttgctgcagatgtctgagttgcttaatcagaaatcagcagtgcaagggaaagttccttctggctattttaatgcgctctttgatttgagtggggattggtttcgtgatgctgctgacaccaagtaccttgcttttgatgggtatttcatttcactctactatttgcacctcactgcttctccactcatactgcaagaggaggttaagaagtctgttccggctcagtgggatccggcttcgttgtctaggtaaacactaagctgatacaacaatctggtagatagacagattatggtatctttgttttcctcatgttaaaatagcttcttttagctttataacttcaatttgttggtgtaaaaatagtttcgtttcctggtagatagacagattataatgggattgaatttgatagattcaatttgttgctagctttttgtgcacttatggttatgaccatccctgcaaaatctagtatgtttggtagccatgaactggttgattaaaggatttaatatcttcttaccttcgcatgaagcttgaattaacttttattagttgatgttagtttgtgtgttcatgtttgaatgttttgtgggtgaactgtttgatgcagtaacttattttgacagtttgaatggtgcataattttgggttgataagtatatgatgctaatcaattttgttaggcaggttcatccagacatatggtacacacataatagtgggtatggctgtaggaggtcaagatgtaatctgtgtcaaacaaaaacattcttcaaagattcctcctggtgatctcagaagacatttagaggatcttggagattttttattctcagatgtcagaagcccttctttactacagaggaagacagtagatggaaaacagaaggtatagtgctatcttttgtaactttaaggtatttattatttttctgctgacgcaatggctctattcatgtaggtccctgaggtctttaaccgtgtgatgcaatcaaacacaatgcaattcactagtatttcagaaacatcaagcaaggatgtaagccctgaaagggaaataattttcatttgaaataaataatttttctaggttgtgaatatattgctttatcttggaacagggcctcactattatttgctcaaaaagaggaggagatatgttcaagcacagtcactcaaattggcttcagacagtgccgtctaaccctgaagcaatcctcttcaagtttgttcctatttcctcacttctgactggaattcctggaagtggatatcttagtcatgcaatcaatctgtatctacgctgtatgttctaatctgattaaacaatgatactataatctactacatttatcctaatccattttatgtctattactatttatatattttcaccatggtgtagataaactccgaaataaaaattagggaagaggaagagttcaagttacacccttcaactttatgtccacagtttattccttaaacataaacaagcaagatggtcaattggcttcccaatgtgtgcataatgctcctcttgatggatgcatccatccaaaatttaacaaagatgtcatatgcctgtcatgcaaccataaaatccagaccaaagatgtttcacatgtgttaggaaacctggggaatcttgtatgtcttttgaactttaaggcataagccgtatgtagtgtgaagttgaagggtgtccactgaattccactcccccccccaaaaaaaaaaaaaaaaaaacaaaaccaatatgttttgggcttttggctcttagattgttcttgtatgttttgcttttctttacatgaagtttccaagccatcgcttcttgcacagaccactgtttaatttctttactgttgaggtgcacaacactccattgatttacttactctctgcagataagccttctcccggagatttacaatactttctggagtttcaaattccaaggcaatgggcacccatgttttgtgagctgcctctcaggcatcagaatagaaagactgcttccccttccctgcaatttagtttcatgggtccaaagcttcatataatctctacacaggtactgttaaccaaactctttgtgtttgagcaagtattgtatgtgttagaccttactcttacatttgagtttaatattttccttgagaaagtttttgcttaattagtgtcaggattttcccgttactcacttctgttatgttacaaatttagctggggtaaaaaatttgttattctttaacctgcctaattctttaatcagttactttacctgttagtctgctacccttgagttttcttgtacaccttatttcatatgtattgtcagagaataggaaggagtctgaaataaatggcatcaagttaggattaggattcaggggttgaacaaggtgtgggatgttttcagaccgaaagataactcgttgtgagaaacactgttttattgtccccccccccccccccccccccaaaagagaaatttcattatagattatgaaagaaatactagagacgaggataagatatcctcctaaaagaaatcacaaaataataacaaatgaaaggaattaacaagaaaacccaaatacattgagcaaagaaaagatataatctctttatatgcaataaagaaacccttctaaaattgcacaataaagaaacccttctaaaattgcaccacaaaacaaaaatgaaataggtgacatctaaaagtatccttgaaaatactggcattcttccaatcatagacaccaaactcaaacaaaatctagtattactttaacttaataatcctatctgaatagctaattaggtcaagtactagtcctactagtattagcccaagcctacaagacttgcattcttccaatcatagacaccaaactcaaacaaaatctggtattactttaacttaataatcctatctgaatagctaattaggtaaggtactagtcctactagtattagcccaagcctacaaataataacactagaactatagaacctataggaacatatcaagaaagatattctaagataatctaaatatatcttacatattttcgaacaaattgtcgtgagaaatatgtaaggaaattcttgaaaacactacgaagttttaagcccctaggttatttttgcatgccaattgtgttggatttaactatctatagcattttgtctgcagttatgctatacttacaattttattggttttttttttggtagtaagctgtagtttagggtaaaagaaacattaaagaggatggacaattgtaaagtagttggaccaaaaaatttccctgttatgaactgagtcaactgactattctcaaagctcaagctactagggaaggcacatgaatagtttggttgctgtttgggggagaaaaggattataacctggttcacaaagttgtttagcaagataatgaggtctaagaagatgctacatttaaggaggaacagtattactatttataagaacaagcgagatattactaaatttttctaactaaagagcaattaagcttgtgagtcatactatgaaaccatacataagggtaattgaacaagggtcatagaaagaattctcccagctatagaggtattaagcttatgagcattattatgaaactgtagcaaagggtaattggacaaagattaagacgagatcattttttagtgtatgtttggttaagagataacatagttaactatgcattttctttatttggttaaaagaggaaatggagagaaaaaagagaaaaattgactttaagaaacaatttcaaaattttctcgcgttttgtttagtaaaggagaaaacacatgtaacaatgcttatagtggatcagcagcttcaggaccttgtgtaagcttctgctcacctctaataattttgggatgtgattcttttggacagaactcggaaatacactcaattcgaacaggtcataaaatgtgagcagtgagctcatgtgaccttatgcgagctcctggccacctatgagttatttatctgttttcttcattctatgtgctgcatagctttttagggattttcactgattttattttctcctctcaacgatcttgaattattgatcccttattcttaagttcacacaatattctcttgttaattatggtattttgtacaaaatgtcaggtggtaagtgaacaaaaacctgtggttggcatgcgcatgtacttggagggcaggaaatgtgacagacttgctttacatataaatcatctttcaagcctcccaaataaaatgatcctctcttcaggaacctcaacctcaagtacaccatcgatgtggcgaggatctgatgataatgaatccagtgatcaatttctggaacgaatcagatggaagagattctcaaatgtgtgcacagcagtggttaagcatgaccctaactggttgaataattctggaggtgtttatattgtaacaggtgcacaactccttagcaaagggagctggccaaggaatgtgcttcatctgcggcttctctttgctcatattcccaattgcagtatccggaagtcagagtggactgctgcaccagaggcttcaagaaaatcatcttttctcacaaatttgagcacaacattttcattcacacagcacggtaacactggtcctccaaaacagactccaactgcacttaactctggagtttatccagatggtccacctgtgccagttcgtgccggtaaactacttaaatatgtggagacagctgaggttgtgcgaggcccacatgatgctcctggccattggttggtaacagctgctaagctagtgactgatggtggtaagattggattacaagtgaagtttgcattgttagattattggtgatttcaggttaccgttcattctattcatggtatattggttgtcatgtgttgcttaaaatggtttcgaaaccattgatcacttgtatatattctttctacaggctgtgtacaggacagtatacaaaatgagtggctgttcacatcgggcaatagaaaattaaaatttgacaattctgttaattctggatacatttaaatgttgagtatttaaatcatcatcgtgaataagttatggggaaaatggaaaaaagaaaacacaaattaaaccatatatttgcaaatatataaatggggcgcttgcaaatcttttgtatcaagacactaggatgtgtgtagggaacatatttagtggcttagaaaaattaacgttgactgtataattatacatatatatggtcaagattatgttatactttttttaaatttaatatgggtgatgccaagtcctaggacaactggaaagttgtgtctaggtaattgataggtttgaattctaaaacggttgatgtacatatgcaagcattaaagttgcatataatgatactttctcatttctctaaatttcccatacttttgcatagtgaggagtgtaatactctagataaatcacacaagaatgagatctagatgatgtgtaggtataatattgtgcaattgaaaatgatttaaagatattaattgatattatctataaaaacaagatgtatttactttttgataatttatcacctaagaatgtcataactaagtgtacttgatttgaattagttatgatatgaatgatcttttaaaaaaaaatcaaaaagtgtctgagtaaggataaaactcgctaaaaagtcttgtgtttgtaatctatcttgagaccagttaagtgatgtcagagctggttgttgaggtctgaaaaatgattacttattgaagagtctgatgaacaaaaatgttaagtgaagtgtcaccgtgtgaaacgttatattatgagagtcgttgataagttgataataagagatgttaagtcttttgatattaagatactttaggtgacacttgatttgagtgaatataatttttttaatattttttgaaaataattttcattttcaaattttaaagatttagaaaacttgaagaaagtattttaaggtaccactgtgttttcactttttcaaaaaatgcgaaaaatgctaatttgttgtttcaattttggacttattttttaaaatattttcaaattttttttaacttttaaataaaggtattgccacttttgttttctattttctttgaaaatgaaaaaaaaaactatcaaaccaaacattatcttaattatttagttaactaaaatactaaattgaccttccattttaattatatggtcaatgttagttcttctcaggcactgatccttcatgtaatatgctaacataagagatgagagcagttaatattagatatccaaacatatatgaatagtgaagattattttcctaaatttgatcttggtcattcattttgattgtatgatatttggttgtatgatcaaaattagtttctttcgtgctctcatctcttaatacaatgcctatgtgtatagtctgtcaggcttatcacttacgatgaaagggagctaaacactatattacgtgacttgagcagtaaatttatatcggtgcttttacgtttagtcaattgggacaggtttgcatgcattggctgcgggttgcactagatcaaaagacacagataactgacttgtgtttaaaccataaaatattatcaaaccaactttctttgtgcacaggaatagtgtatctgtagggttaggagtttaggacagtttctgtatatctttaacttgacatttgccacctgaaaatcaatgcattggcaatcattttaaggaaaagaaagaggaggtaaaggatacagtggaaagatggaaaatggtgaccatatctattacatgctcttgctaatgtatagctttcttcatattgttatttttttcaagtaaaaaaaaaaaagtgaaaaatagtactaggagtaatataagtgatgctacctacacaattatatataattatacttgattttacatgcccctaattgattattataattaaatttggatagataattgtgtaatgttacggatcattgtgatattagtagataaaatcaatgaaaaaaaagttataaattgatactgtcattcaataataattttatcataaatgataaatttattaatttttatgataattattttaaaaattatattaacgatcaatgttttacctatctaaacgatcactaacctcaaaatgtattccaatctcctatatttcgtgtattgataagtagcaactgtaattcctgcaagggttgtttcctattgtgataattataatagtaaattatgcaactttacttggaaagaaaggaatctttgatgggatgtccactaattgcgttgggtctaaactttaatgaccaacaagactagtgtacagcaaatgagcagaaaaagttaacaacggaaacaccattggaggactcaattgacaacaaaatggtcaaaaccattgcttttattattttttaaataatttttcgctaaaaatggctacctgtaccataatgaccattgaccaaattgtgatctacaagagaggagcaagtggagacggaataaaaaataaagaggcgggctttcacactttgcaggatagaaaaaaatggcacatgtagaaggtaggacacattggtgtttgttaggacgagtttttaaacttgattttgaatggttttgattatgttaaaattagttttagttaaaattatgttttaaagtaaggtaatacatgtttgaaaatttaatctcaataagaagtctacattaatataaaattctctccgaaaagttgtacttttttttactcctaaccaaacatgttttaaagaacataatttaactacaactaaacataattttcaagtcaagtttggagagaatccaaacatgcctatataggcatgatgcatgcacggtttcacactaaacatttctgtaataggagtgctatgcgaagaggggtatcaacgcatcgtgtaacacttcaagtgctaactaaccttaacgtatgtctcgtttggtcagcgagaatatactcgagttacttgcacctgaattaaagtattttcactattttttttttttgtcttttgaccaaactcgggtgtgaccactggtaagtaatattaccatcttgcatattaatattataagtgtaaattttgatttccatctatcacctgagattaaaattttgaggataaattatatttttaatttttcaatttttaacatttatgattttaatccttaaatttttataatcaatcaaagtcttcaaactttatttacatccaatgattttgatgggacgtttaattttattatcaatttattatgtttttaatttttaaagatttttagtggctacaaattaattgattttggtataaaactaaagatgtaaatattgattgaacaacgtagccgtgaatcatcatgcctcttttacattccaatttgtgatccacattcaaacaaatcaattgcaaccacattatgcatacaaaggagtaaaaatcttatcaaactaaatttatgtcctcattttttctgggtttcattttccagatatgcttcacccctttgtgccctcctctaccccctcaacccagccgcaactcccaccaacaccacgcccacaaactagacggtgaatctctatcttcacaacatttgcttgtaaaccccttctcaccaatccctacatttgcaacactgttttccctttgaattgcgaaaaccacccacgaaatcttactccaaaaagatataatttttgcacttcttatagctacccaattcgcaatatgtcaaacccatcgaatccctggatctccttcgcttggtgtcgctgccaccataggcgcacctgttgcctcgtacaaccgctcgaagcttcagggaccctaacctctattattctttatgttttgggattctgttgtgcttaatttgggcactgaaataaaattgattaaaattggattcaacgtgttgttcagtgaaatgaaagaggaaaggttgcaaaaaagaaaaagaaaaattaagttagggtcgctggattgttcttctcggtgatggagaagaagataggttttgaaaaatatattcgaatttgggatattgtaatttttttcttcaaaattttgactaataatcaaaaaatttaaggaccaaaactataaacattcaaaaatttggaaactaaaaatataattttgtcaaattattattcaagaatttaagacaaatgtgctaagagtgaaaatcttggtgccggcaaaactgaaataaattgactttcgatgatcctttcagaataaccttctgcagtatgtttcatagaaagaaaatgaaaacagagagaaaaattcaattgaaagataaatgaaaggatatatatttttaaaatatttgttcttttcttttcaattaataaaagaaaataaattattactatatatttttcctaattttttcttctcatctaaatttattgttctttgcacctcacttataacttaaaattaagatattttatttggatgaaagaaaataatactacaagaaaaaagaatatgaattgaaaattgaatttttgagtttcaaaatttttctctcctttatattatcaattaaactcttaagaggcttagcttggttagctaaataatatatacgaggagaatttgttgtaaatattatgatatttaaggttaatttttttctgtaaataaatagataaacaaaaaaagctcttaactctcatcaggctgagaattgatatatgatataaattgtacacaacaaaagtgaaaagtgaaacaaactaacatcaactaccaagaatagagaatgaaaattgaaaagttgattgttcaatcctcgatcttgggttcagtacttttttttttagttgaagtcataatctgcagaaactttaacaatacgttttagtccaaagaaggaaaaagagaggggggattttaataaaggtaaggaaactgctttgtttggttcataacgagagacgaaaggaaaaatacgaataatatattgctttagctttatcattaaaaaaaatgatatcagagataaaataatatcacaggacaatttaatatgtactgtttaaaaattataaattccttttcttctcctttaaatctctaatgtaacagaggagacaaaataagggaggttttagtttcttcatttcttctttctttctctacaattttttttaaccaaatacaataaaattttctccttgatttcctaactagcaaacacaatgtaaacaatgctaacaaaatgcgtacaatatttgatttcagaatatagaggtcaatatttttttttttgagttagaaataacttacggctttagttctagaattagagttggtggagaataaaatactattaaaactattacttgacaccaaaacaactcaagtaacagatacacgatagtcgacaattttttttggtttacttaaattttaaaataaatgttttaaacaagagttatattgaaatcacacatataatttggacaaatcaaagattaacaaattactgaagaactcagaatatcaaatttaagcccaaaggcagcttcaaaatgtttataaatgataccttttacagtatattaaaattttggttcatggcctcaatcttcttaataaattattttaatggaaattttgcttttcccttcttttatatttttcggatttccaccgttagcaaacagcatgtggtcgtcatatgacaaaagcttctggaccatcaaagaattgatggaccttttggctatttgcttgagaaagcacaaacagtagttgaggatatttgttgatttctgttcctttatccacatggggtccatttccacccccatcccttcacacctcacacccttaacagataataacaattaactctttgaagcatcataggtggaatgagtgcgattttcacgagctagcgtttccttttatgtgaattatagttattagattggagaaaaggaaccatagaatagaaggagaggattaacaccatcatgtagcatgcatgtcaacaattgactatctagattaataaacaaaaagttggattgcaatctcccccagaaagatacatgacaaaggaagaaaatccaccaataaattagttaagattgaatcttagatgggtgtaggccaattcttctgaatttcaaagtggtaactagtatccaaatagcatttgcgatcatcatctacaaactgaaacaaaaaaaaaatagttagttcttcctactaaaaaatgcaacaatactaacattttatccgttccaaaataaatatcacgtttgactttttaacgtaatattaattatttttccattaatactcctaataagtatcagattagtttttcaatgtaatgttatattaagataagttttgtaaaattgttatgctcttttatttgtttattaatttttttggatctgtataaaataacctagaaaacaattattttagaacggagggtattacaaacagtgaataaatattgtatgatgtaaattaatattcttaccttggttcttgctgaataggttcccctagcaaacaaccccgaaggggtagtttcttcttccaattcatatgtatatggttcctggcttgggctataagttcccaacatcttttttgtgttgtctactatttcaataaattcatgaaagccacatgtaactaagacaattcaagatacggatgtttaactaatctaaaacataaaaggggttttatgtctcacctctaagcccagttttccaaacaacattggtgtatttgaggccagaaacaatgttgttggagacagtgaaggagaatttcaagcggtatcgacttccttccttaagggtgaagatactcttcttagattcagaagtaaatggaattggcagaatgaggtcaggcctccctggacatattatggtgaggctcactatcttcacttctggctccttgttttctgaagtacaatacaagggcttttgcctttaggttatttaggactcaaaaataataaggagctgaaatcaaacttaatgattcaaatatgcttaaaacaagaggtaggattaaaatcatcctagaccaacatttttcatcaaaatttgtcatctccaaaaaaaggtgattcaagtgagtgaaaaaaagggatatcttgtaaacgaaaaccaggagaatgctgctttatatgaacaaagaaattaaattggatgaagaggacaatcttcaagaagagttttcaatactgatgcactatttatgtcacgtcatctccacttaattaataatcattgatactttgatagagttgttccagaagaaaaacaaaatggaaggaaaacaagtacctccaacagcagacatatcaatacctcccagaagttgctccttccattttctcaaactctcatcatcctttgagaaacaaaagaaaaattgttaaattgttgaatccctttcatcatagaacagttggaaacataacaaacaaatacaaagaatggcagggcagtgaagaaacatttgaaaaaacgaatgttactttatctttctcaagctgttccttgagggaaaactgaggaccaagatccaattccaacttggggtcttcctctgcctctgaatcagttccttcagcatcatcattgtaaggaagctggtctgcttccccaacaaccttgttgcttcctttgtttttgatatcttcctccaaatgagcattgaagggaaaatccttggttgcagacacagcagcagacattgtcaacctcaaaatcacagacacagtggtgtctcaaactctattggtagcacttccaagtggtgccaaaataagacctcttggctattctttgaggataattctatatgcctcttgccaatgaaattgagccttacaagttacaattcagaggtttattatgtgtaagcaattactagtagttgaatttaagataagggaacagtgtgacacggtgaatgtgggcctgaaaacgaaggtaacgaaaaacggttggaataaagttggtagggaaccacaactaaaggtggagaaggtcaatacaacaaataaactcagatctccattatttttatacatcatctacattgtttagtacgacagttttaacttttaaatgttacaagtctttgaccagaaaaagaaagttataagtcaacaaatcaaaattactaattaataattagtgtccacaataagttcattcagttgatttaaattcacttgcgcgttgacaaaggtaaaaataaaaatttactacgattaatgcctcttttaacttgttaagaaagttgattaatttagttaataatattaaatttataaataatttgtattatttttcaaaattactcttataacatttattgtttattgactacaaaaattataaagtaattaaggatatttttgtcaaaaaataattaatgcaataaataatttaaaaggagtcttataaaaaaaataaacaatataaggacaacaatggtatatgaaactaaaaagaatttttatattgtcaaacgattataaattaacatattatatttgtattgatttttagaatagttatcataaaaatcagtaaatcataattttttattgattattagtacaaaaaaatttacaataaaaatacataaaaattaaattcacctatctctatatattttataaaatttcatttatggtaattcacgtgacacttattcaaaattttaaatttttaaatccttctaatttaacatttccttttttattaatattctgattttgcaattatgcctttgttgaattataatattttcaaccttttagttttttaatcttttgaaattaacttttggcttaaatatgatttaaattcctattagtaaattttgtttggagtctctaatatatttttttgacaattttataataaaataataattttattttaacccttctaatatatctatttataattgaattttattgacaatatcaaagacattatacaatgataaaaaaaaaaaaaaaaaacaacggctacatattacctgtctaaaggtacaaagtatgtaatattacgcagtacccaccaaacaagtatagtgatttcccctttttttatgacaatttttcatacatccttatcctagtatactagtatacatgtgctgaatcattccaattgcctcaagcagattgagcttgtagaaaatgtttcactagcaattttgaggaggaaatggtgcccatgacccaagaagaaacccacatgtgatgacagagaggtttaggacaaagagaggccaaaatatttgaccccaacaaatctttatgtagaaagcacatgggaaaatcaaacaaattgcaacacttagtagagaaacagtgaggctgaatacatgctcaaaactgaaagagcaagggatagtataaccaaagcaaaaatgaacccacactgcccctaattatcatttttgtcctgtcactgttaaacttgggaagccttttctccaactgaatagcgaaaggtgcaaattccagggcatatttggttataggcgtcaccacggttgcccacagagcaatctttgttacaaaaagctttggtggcatgctgagggttacctcagaattgacatccggcccaaacatattgccacccatgaaacccaaggtcgtgtaaagtaatgtaactaatgtgaagctccctatagatacctgaattcccaaattgaaaaattagaaaaataataattaataaaaacatctcattaatcttttcattttttaagcataatctcactcgttgattttttttctcatcctattcttaagcaattgatgaacaactatactgtctatgcatacatcatatgaatttaattttgttagtcaatcatagatggtaatataattgatttttttttttacttttgtactaattactttaaagggttaacaaaaaacaaatacttcaaagaatttaattttcttgcaataagaaattattattaacatgatttttttaaggtaattactataaatgttaaaaaatttaccatacattaaaaaaaaatcaatgaattttaataaacttttactttaaaagtcatataaaaaaagttatttttaaattagttaataatgtaaaaatattcatcaacattaaactcatataatatatattatttaccttggtaaactttgaggggtctttcatggctttatacaatgtgtcatcatagctgaagatgtaaaggccagaaattgaaggaatgttgtggaggtggaggaggggtatcttatgattaacttgaacacgtccaaaaattggagtggatgctactgacacaaaattgacaagggacatgagaatgccaccagttggaaaggaaagatatggaagagagatctctgagccacaaactaggcagagcaatcaacactgcaccaatgatcaggagctatgatttagatagttttgccaattgcagcttcagatgcatccctgagaagattgaattcaagttgtcatgcaatgagatggtgtaggaaacaagggccatgaagatctccatgtagatgaaagttgtagctatgaatcttcctttttgcaccaaatgcatgaccctcaatgtccacgtaacttcttaacttggtgttcttttctagtcatttcccaagtaaatgagaactatatgcacatatcacaccgagtcctataagcaaaaaagcagatgtccaccctccttgtctagagcatatggagttgataattgccccagacctgcaagatattataccatatgttaaataaataaatgtgtgtgtacgaatgcatgtgtgtatatatagggatcgaatagtatattggagtaaacatacaaaacttccaactaattatttacagtgtcagattatatgtgctaaagtatacttaaggtgtttttcctatatatgctgcgattcggttttgacttttcaatactgagcgattacaattaattatgatgtcactagatcctttattattcttaattttcaattagtgggtgattatagaagtttctgttagattaaagaaaaaaaaatgataatcttgccatgagcatcattgaaagaggtctctcgtgtatataagtagtctgtaggggaatctcatgttacttatcttcacctagtggttatatttgaaatttgaaataagacttatattatatgatgctcaaaggttgactgaaataaatgtaggctttatttgtgattctaaaaatataatatgatttcagtttcatacttccatgcaatttttcaatccttagcaaatgtaatggccaaatggagattgaacatgctaatttattcaataatatgatataattgaaagtaactagctaaaaagactaaaagggcacattcatatatgttcgttcaaatggtacgtaagcaacagtgcaaactttaccatcccgaccacattgatgacagcatgagtgaaagaacaattgacttcagagtcatgctgtgtatctaaattggtgcccccttctgcactctttgtatcctcaattttgttttggtcacacttccattgtttagtttcctccacgcaaaaaatgcaatttgccaggtttgcaccatgcactgactcagcgttatcaacttggttcttgtgctggagacatttctgttgaaggcttaggcttttccgcaaagatttcaacatgttggtcaacatatatactgatatcaagttcccatagtttaggaaaagcaatagcaactcaagcaaggttcactaagatgcttgctgagacttgctaaccaaatggcatgaaaggtgtgtatttatagttgaataaatattctgaaagggtcagcgagatggcttcaagtattggagagaatcttatattctttcacctttttaatttttgcaatgtaatgtttttttttttttttatatcgaaaaatgttagttgcaatgttagttttgttagtagaggtgatcgaatccataactctttttcacttcctttttccattaaccatccaacccagattttgatttgattctgaattggattatcaaattgctagatgcaaagttaattacattagttaaatgtaacaaaaaagagttgcattagttacaggaaaaaatatgatggccactgtgagagattcaaatcagtaatagcggtgatattcgattctaaaatttcaacataaaacactatccaagtttttggcccgaaacaacggtctgacattaaagtgcaatatatatatgaatgattttaatgttataccattttgcctattattaggtgttccacttgcaatatataacgtcataccattttgtggagttatttataccttagtaaacacgatacgatttgaatattaggttccacttggaatatatatggcgtcgtcactgtggctgaggaatgcttggcatgcacaaatttctactcactttattcgcaatgtcggatgttgttttttgttctatctttttgtggggggagtccctggagaagaaaattaatcaatgggagatacaccgcacaaacggcgcctaactgatcttaattataccattgcaagatacttaattgtgtgtttcttgctttgttgacccaactaattacactaaaaaaagaaaaagacgactgattgatatagctaaaatttaagcaggtgatagtatgatgttatttctgctcttgcaattagggatgacggagttgggtgtctcgttacgtggacgggtgttcgttatgcggctatgtgaattttttcaatactatttcggaatgtttaaaaaaaaattaaatatacttttatctctaataaatatatatatttttatttatttttaatgattttttattttgcgttgagtctctaataaaataatatttttattttttatttttgataatttttttaatctaggataaattaacaaattttgtattttctaatagaataatagattttgttttaatcccgactaatgacaaataataataaaaaattatcaagattaaaaataaaattcattaatttattataaactaaaaacaagtgataaaaaaaaataaaattattattttattagagactttacataaaataaaaaatcattaaaaacaaatataaaaatcgaatatttattagagattaaaaaatagttaagccttaaaaatattttattgtaagattctcttttgaaaacagtttcaaagttaaaactaaaactattcaaatagtatatacaattactctacacaattatactaatcaagatacttcattgtaaaaactaaatttaaatgttaaaacacatcagtattgcaagttcaagcaaaagtcaataaagtagaataattcagttcttattatttagagagagaaaattcaatccttaagtataaacttaagtataaacaaatgttaataaaatatccatataatttttatttttttaaaactagaaaatttaataaataattacaatatttttaacaaatttctatttattatcgtaaatataatataaccaacttatgattttttctattttcaacattaatcactccattatccagcacgcctaaaaaataataaaaaaagtatacgaccaatttagtccccatactttacacttgctcacaattttgtctctgtattatgaaaattatctatttagtccacgaatgtcaaaggccatgacaatttggctaaaccgttaaaatccttgtgtttctgctaacaaacatagcctacatgtctcacattcatccacatgacaagtacaatgcgtacaataactttctacctcattttggattaaattatcattttttcttaatgtattgattttcaaattaacaaacataatgaccacatataaatgaactctccttctaaaaaatttccaccaaaacatatatacttactaaaaaattaatctctaacaaatattattaactaacaaactagtccacaaaataactaataatatgcactcagtagtagaatcatccatgaaataatataacatgcacatagtccacaaagctaaaatgagcattcatagaacataaaattgttattcattacacataacatactcaagttcccaagtagtagtaaaatttctaccatgattgtacattaccaagaaaacaaaagacaccaaaacatgccacaatgtcactgacataatagaattttccaaaaatatatccaaaatatgtttaaacacatgtcaatgcaatgttccaaaatatgtctacaacattgtattcgcaagtgaacacctggtagaagtgcaatcgacattgggaaggatgtgcgtcgtgttcgtattctaggtcttaggtggtggggatgacatcgtgttttggtcgcgtggcaaacctctatactctcgcaagtggccatcagaggaagcgcaaccggtgcctagaatggtgtgcattgcgacaacaagaagagaggaatgagggatggtttggtgggtggagttgactttcagaaaagaaaacgtccaaaaaatgactttttgtgatgttttacactttttaattttcatgacaatttagtcccatatgttatatatttgctttatcatgtaggctataattgtaaacataaaagaatgattttaatgaactaaattatcgtgaccactgacatttatagactaaatatgtaatttcataaaaagaaggaaattataagcgaatataaactaaatgaactaaattgcatgtacccaaataaaagtaaatagtttcccgccattttgtgccccagggccaaataatttggcgcggattcagaacctgggagggaagcaactcgcacgctcactctagtctacagtcgattgggagtgttgcagagagaagaaagaaagcgatggagatcgttcgtcctcagagtcgcagaaacttgttgtcctcctccaacgaagccgtttctgctcccaccattctcctctatcgctctgctcccccacttgaagtcaggctcgaggatttcgagtccttcgccatcgatcgcctccgaggtctgttttcttcatctctatacttttactgttttccgcttcttccaattccagagatctgtttcaaatttcctctctgttcgtgcctagtgtttcgataatctgctctgcttttaactgtgtccgctgctccacacatatatcctagatttaagaaactagtgtcatgttgaagtgaaagcctgaaatctgcaagcgatttgtttttttattttattttaaatatattaaattagtatgaaatcgtgtgtgtttgcatgtgtttctttaacttccgttgacatcggacatttttcaagttttgtggtctgtttttcatggatattattgcttgttgcagttctcaaggggatttctgatggtatgtcgcggggaaaaaaagcggaagaaatggagaatttggtaaaaagctcgatttgacaatattaatttattagttcatgtcttgtggttgacaaaaaagaaataatgctgtgtggtggacttttccatgtgaatcaccccttgtacaggtaaaggacctgtggaaagtgaatatgagacatcaagacgcaactcaggttctgaacaaggatattatatctcattttgttctacgtctggtgtattgcagaacgtaagagctcttatcttctctctcttttgtgcattctcttttactgttgttccatgccattgaaaagaatcctcggttgtgtgactaataatgcctgatcaaaataaatggaagattactacaaattgaataaattggtaatgatgagagtttaagaccattggcaccaattacgtatattgatcatattttatggttgtgtaagtgtattaatcctgaatgatgctttacccagatcaaagaaaggaaaaagacaaattaataagaaaactgttgtaagaaatatttctaaattattccatatatactaaaattacataatatatgcctgtattcccagggaggacttgaggaaatggtttctttccatggaatctgcactctttcgctaccgttttcgtcttctgaatgctgaagctcaggtaaaatctggttactctatattgtttttgcatttgaagttaagtacttattcatcatatactttgtttatgagtgcacagagggcagtcatggaagaatttgaccttccttacagggctgttagcaatgtggaatttgaggtagtcacatcatttgttttattggtttgctctggactcttgaatctgaattttaccatgaagttgatttgtgcaaaactaattttgttctgagttacaaatacctcttagtacctaaagaaatgatgttttggattttcagagcataaaagagaaattgggacaagttgcacgttctatgggtcagccttcacctactggtaggagcacattgctttttctttttgcaatgattatttagcatattggtatgaatcagcagaaatgatttgcatgcaccatgctggaggttgttgaatgaataggaatataactagctgttgctacctaagagctaaggcgcatctttttttagattttgtttagtatgtaattgtaaatccactagtgagctagcagttgcatgggttaatttctgaagaaagatatctagggaagtttttcaagtggtatatttgcactactattatacaagaaaaaatctacagtttttgaaatttatgcctcattttttttcttcaagttttatttcctggtttttattacttttccaaatctaacgtgcctatgttttgcttggcttcatttacttttttttttgcagctgatgctatcttctacaaggtatgtgttcaatcttttttttcgtacttatttattgtcttgcaagagagatccatgcaccgggtgacatgcagttctactttaaatattaactcggtgactgttttaaatattgaattctaatgattcttccttgttcacaaaaaaggaaaagaaagcagttaactagttaaaaatatttgaatctataaaaaaaactgttaggaaatagtaattaattatcctttggtattttttatttcaaaagcttgtttttgtgtgagagagggagtgataaacaaagatgtcttctctcacgacctctagttgtgagagaagacatctctaacattctccctcagtttttgggttgcaacatttgtatattttttcttttatttccatataggtaccgtttgaagaagttccagagcttgttgctggacggaaagtgtttataaatcaaggatatgcatatgttgcaatgaatcaggttgactagtgtaattacttactaattattcttgcaatgaatcgcagagtattggttatagtaaatcttgtttgtgtttcaactttgcctccttcatagattgtttcacttgtagccacactattccgcagtcagctgtcaaaggcacttatccttacaaacaggttttattggtcatttggatctcaataaattttctcacatgcaaaattgatttctttctttaaatgcaatttgggatttaagatgcttagagattcatctaattgttgcagaaaatggacatcttcaattagagagcaagagaaacataggttgactcctgtacgtgtgggttttggtcttgtatatcaatatatcctttctttgttataaaagttgactagctttctatgtagattgtggaagctctgtcctcaagttatctgggtcctgattattctcaggtaattcaaatagtatattctttcatttttatttctgttattaggtatttatttgaggattgacaatgttcattttgattgaaaacctctgcagtcaagagaatatgctgatatatcattaaaggacatagatcaagttgccaagagctcatttcctttgtgcatgcgtcacctatttgataaggttagagattgggaaaaattatgctcatgtgtttcttcctgcttgattcatctgtaatatctttctttttacttatcttttatctttttcatattgagtccttatattgtatttcagttttgtctgacgtcttgatttataccactttttatgcagctgaaagaggataatcatttaaagcatggagggcggatgcaactaggcttctttttgaaggttgcgtttagcttccatctgggcatgataaaaatactctgtagagtctagatgcttataagtttgaggtgttaaatgaggcttgacacttcacatgtggtttatttacacatggtttggagaaaggaaaatgattgtctggaattatcgtgacattcaagttactttttttagtttcaagtattaacaagatataagtggagaaaattgaaatttgtgttttttatacccataaatttatgataccctgagtctgaaatttatgtcagccttcgacactttgactcatttcgtctgggtaaaatggcacaattaaagaacacgggtttatggttgtatgattatgctgggttagaaataagtcaaagtaatacattttggttcacttttattctgatttatttttgtgattgatgagaaaatcgatgagatgtcttcttcatccgtttacttcttgattactgtttatctattttcctccttttgtcttctttattctcttatcttttgttcttttctcgataatgtaaatagggtgttggcttaaatctggatgatgcacttgcattttggaggtcagagttctctaaaaaggtaagcacacttcttgcacatgatctacgatggaagtattcgaaattatatattttcagctacatgaatagtgaattagaatttcaacagttttagactctgataatttttgcacattatttcataatacttttaaatcattctgaagatgtatacctggtctagacaatgtattccatatctctctagacatctttatatggtctttgaatagattttttataagcttctttcttttaaaaaattacatcaattaattaaatgtaagatctcgttgtaggttggtttggagaagtttgagaaacaatatgcatacaacatacgccataattatggaaaggaagggaagagaactgtaagttttgaatttccccaccgatttatgggatgtttcaaatatatttctgttgctgatttcctttttgaaacacaaactttcaatgtttttgtatgcataatgcatgtatatgatgatgagtttcaacaagtaatgttttgatggatgttacaggattatactccctattcttgtcaaaagattatttcatcaactcctggagctggagatcatcatggttgcccctatcgacatttcaggtcactcttaatactcgtgctatcaaatggatagttttgctttctgtattggagatgtgaaatagataagttattgtcgagtatattttacttgataaatgctttaataaaattataactctgccttttggtgtcacaagtcttgctttctaaagactatgatctgtagtgaaattgtgatgggaaccaggcaaatcctcggttcgcaaaccaggcaagccacccatttggaagatgtacactagcagacagcaataggaaacggcaggagtaactgctgcgtgagagttgtaaatagaaaataattagtaaaaattctttattaggagcatagtggtagtaggaaactgcctaatggcagttattcatagaaaataactagtaattagttatatattaagagtataactgatattaaggtctgtaattaggcaagtgtgttattaattgcagtttgtggacacagtattctgtaggagacttttgtctatggcgttgcaagtgcaactatagtattatattttattaatctatatttgattttctctcagattatttgtttctcttgactgtactacaatatttatttatctctctttgctgatgagtaagttatggttttactataaactaaagcacgtaagcatgctacaccttatttgcattctgtttctgctaaatacattttcgggattattattattaataactcaatcattgtaataacaaatttttgtcattgacgaacctaatagtggaatgattcaagagcaatttaaacccctgtattatgcttacaaatttttacttcgtagtttgtaggcagcaaacaagtgcttgaatgatatatttagtaattttatgttgaaaatgataatgcacttaagaaatagtattttcatgtaatatcttgtatctcatgttaaaatgctaattgtttatgggtattagtgtctaggacgttgcactaaatcaatatcagcttagtaataatccccactgcatctattaggagtctccctctgtccgtgtctgtgtgtgtctttgtggatcacttgcataacctatgcactacagctctcttaaataagaaagcattcatattctgtattctctccaaaactctgttctttcttcatccttctctccctctctaaattcaacgtactacactgttttagaaataatgactttcgtatgtctgtactctgttaatgtaatgaatattttagttgtaatttgggcatagcataaagcttggctctattcttggtcatgttctttgatcttgatatgcatgcatagttgtgaggggtagatcgaaccacagggagtaagctgcacatctgacaaagttgaagggggttataatttactaatttttaattattgttggaaatgcttattctgttcggattccttactggacagtattttatttattttgtacggacattgggatatgacatttaattgacgctatttgaatttaatagtgaagagaatctaagagctgctctcagcagaatgggggtaaacagccgagcgatggaagatgtgatggacaaagtgagaaatagacattatcaggtaggtcttagcacaacccgctgaacttcaataatcaattttcaacctttggatttgatatctgattatatggataacgtttgagcagttggcttgcaccttgacatttgaagctcttcatggcatgccgtgtgatgcagggattaaccatccaaatcaatacttcagtgacagtcaaaagatattaaagccaaaggtagcctacagtttacaaattgtgattcaaaccaaatacttgttaattacagctgatatgatgcaatgtctttgttgaatacattttttttttctctctcttcataatacagtcgacaagtgtaatctgatataagcctactacttgtcacctgtattgtgattatacatttcttattagtatgaatgtgaaaactgaaaacgatacatcaagttatcaattaatcatgacgacagtgaaagcagtcttgcattaaaatataatacaagaatcataataagctactggcatatcctggatagataataaattgcaaactgcaaagtcccccacctaatcttttcgatgtttaatgaagaatggcaagattatatacacaaaagtagatgtagcaatgcacatagcaatccagatagacacgtgtcctggttggaagacaacttttctcttttattcttgcctttcaacacactaaacctgaactgaaggatatgtttaatatcaaattataacaatttccactattaaaagagggagatagtcaatatcggtggataaatgcaattgttattatccccaagagttctgcaataccccttggttagtcaaagtttctaacggttttggagtatgtaattccaacataccacagtacgtgcaacatataggtggacccttataatacagtaaatagtatcactaacgtgatatttattttttgctgatgctgactttgctgacctgaataccttgtaatctgctctctgcttactcacataacgtgatatttaattatttattcttcatcattattatttttttaatgcagaaggattcttcaacctaagtaatttagttattgcagaagactggtgctggggcctttctcaggttgacttttgagccttctgtcttctttttccacattgttttcagtacctttcttgttctgtttccttctggttgtattcgaagctgaaaaaatatgctacttatttttgtaaatcgaaataatatatgtttgcattcattaaaatatatgttgataaactaacgaacattttgcacattttaaatttcatataggtgtcacacgttggtgcctctagtcatggatttgcagagagagacaatgtggtaaaatcttaaatgtagcttccaaagcagtttggaggcaggagttggaattcgagtcatgtattatcctgaaagtctggttgaaaatacggcacaactagatattctttgtagtatacttttcatcttttagccaaacacttgcatgtaaccctgttaattcaggtaggcgtgaaatgggaagtattgtagcataattatgcgatgaaactgtacagtataaaaatgacactcatgaatcatggtggagtatcggatcctaaggcaatcatttaagccttcccaactcaaatgaggcaggggaacctttcaaggaagataggtgcaattaacttttgatatgggttatatgatgccacaaatattccaacttccggatgttatgtacttataatacccagaagatttaatcatttaatttttttagcccaggtgctggcagtaaaatgttcattctttaatctttttccgtaaaatggttatgaattataaatggttcattctttttccctgagattcatatgcctattacatcttttatatgacttagaataatgagtttaatgattatatattaagcagtgtaaactaattttatattaacataattataatttatcgttgaaatgatttttaagatatttattgtaaaataaatacacttattatatatgataattggtattagatgacaatgaattgttttaccctgtttaattcaataaatcaatccggatcccccctttattgagccaacccataacttttcaaatctaacttgaacttcttatggataaaaaaaattaattctttttctgtttcaaggaagaaaaaaaaggataagttttgcttaggtcaaaataagcattaaataattctcttcaaaataaaagaacgaaaacataatatagttctttttaaaaaattgaaaaactctttttttttttttaaattttagctgttcataacaaattttaatagcaattatttattcttttcattctcattttcacatgaaaaagagtcctctcatatatatataaaaaagtaaatcaacccatgtgtaatgtgtggtgacgagttaagtgactttaagtctttagcaactctaattatgtaccccagaattttttttttacaagtacacaaaaaaaaatcctctaattttgacatgtgaaaaattttgtggattgcaacaaggattgataggtttcacatgttgataagtcaagcaaccatgtaacgcatgtgattcaatatggtgaatcgaggatatagagggaagtcatgtctactattttcgtggctggcaatcaaactatcctccttcagccatgcataaattgcaggtaaaatttatcataattaagaaattttggcaacaggctctaactttgcaatttatctccatccattgatctggcgcatgccatagatgctgtctttgtcaagtacctcaccacctcataaatggatggagaaaagtgcaacagaataatattcatgaaaattccatgtgcatggagcatccattaacaaccccatcatcaaaagcatatgaagcctttattattattattattattattattattattattattattattattattattattattattattattattattagttaaaaaaacaggcacttcataccttaattatctttttttagttagatgtagttgtaataactgttgtgttgaaaaactaactatttgtcattttagatggtttttaagagtagttaaaggataaattaggaataataaatatgtacacaaaatgagataattgtatttattaataggtatagattattattactactgatgaaaaacaaacactccgtgtcttaattatctttttttacttatatgtaattataacaactgtactattgaaaagttagtatacaaaaactacttgtaattatggatgattttaaaaattaattgaagagtaaattaaaaataacaaatgtgtatataaaatgagataattgtctttattaataggtatatattattattattattattattattattattattattactaattatttttaaaaataaatcactaaaataaagtttatctttttcaacaaaatatttttcattcacataattaaaaatcaaactcctaataatatacttaaaaaaattcagctatctgccaacttaagatggttgtttatagggacagtgacaaatctgaagagaaattcttgagtgggtataaactcaactcctcattcttacacataatcaataaacaattataactgaaaaataaaaacaaaaataattaatccaaccgtctatcaggatcaattacaaaagtaacaagtaatgataagattattttaattattactttatttacagaatgccaatttaattttatatactcataaaatcataaaaaaaagtcacctaagacgtttaaagtggcttttgtttaactcactaatggaattttcgatatatgaactctttggttcaaatttcaataattttattgatttttatgatatttattataaagtcgtattaaggattatttctaattaattcacagtatttttttttacaatggcatgtctatataaattaaagtaaaaagaatgacttttgtttgattaattttatacaactaatacaagtttaaattgtgcatgtaaatttataaattaaaatccatttaaatatttacatgaacaattaaaataagacaagccgtaatgtcaattttagagtctaaattaaatgacgattatttaaattagtgactaaattttgttttttcgtaagaaaatatcatgattcaaaacgactgataataatatttactaaaaaaggaactaaattgatattttattctattaaattcactcaattaataactattttataaaatcatgaaataaaactgatgtaacagtagttttaatgtttatgatattaaccatccctaattttttttttcccgcatgagtactctttaggaataaacatcgtacttacgacagtgagtgagagagagaggattacaaaagcttgtatattccaatctatagtctagagttaaatagggttccttgttgtattcgaagatccattgtattgttggtggtagtggtagagtgaggaccataatggagttttggattcacacagcattattgtggcacttttctccgtcgcacgccaatttctttatgtgttggggtttgaaccctttgttttctcttagttacaggcaagttgagagtgactttcatataatgcatatgacatacacatacggcttgcatgtgttatgtaataaacctccatacataaataaatgttgtcacctcacatatatcatccctcgctttccataccaattaaatcaccttcttgtctttgtgtattaaatattaatcccaaataaaattataagattaatttggtgattaaaaaaatcaaggaaaaaatcatggattttaatctcttctattaacaaaactaacatattgataattaacatcgatcttttaaaaaaaatgaaaaatcaacaccaacttaaatgatttatgaaaggaattttatgtgaagagaaacgtttgttattgataaaacttactttcaattatcaataggattttctttatcaagttaagtttcaaaacattattttacaatttaaagaaattagtttctgaaaaatcaagaataattttatgaatttaatgatcatgcatgcattgataatgtaaaatattttttacattgtcatctaatcatgattcattgttaatataacttttaaaataattaatgtgttgtaaaagataataaatttacataagataattgtgattgaatcaatatataactctttttctctaattttatttactcacattaaaaacttaaaagtaaaaagtaagggattttattagtcaattgatcaattaacactgataaatttctgctgctctttcaatatatttttggaagtagccatttagaaatgtggcaatagaagcgcatttattttagtcatcactttcaaccagcttagtgaaaattggaatcactttacggttatggctgcagtagaaagtaggcaaattgaaattgtatctgacgtaacatgtgataggctaacaaaactgtaattctttcaaaccagttaactggtatatgttaatttgtaacattgctgatgggtcaatgacattccttgctcttcaataatttctttaattatggtgttaataatttcatccctgaaattgaacaaatttgtttaacgctttaacctcaatgaacacctaaaaatgatcattggcccagtatatttatattctccaactaaggtagtctcaagtttaattaaagtctcatctttctaccaagtgtacttgaaattaatctgctctagagcctcacctacttttgtggcatgccaacaacagagtaattaatttgcaataattaaaggatttgaatccatatccaagtttgataattgaagcacttggatgtgtacctctctcatcagtcatcactagcatgcactatgaaacatgatgtacaagatattttgcattgggcagactttagtgcaggatttatatacaaatcagagcttctaaccatgaaagacctcaagacaaaattggtaaaatttaatcttttatatatgttggggtccgctgttatcaacataataatggagctcattgagtggggctatatgcagtcgcttttcaaactctgcttttctcgtgtgtggtggttggaacttttcaagtacccataactttgtttttccatcgtgaactggtagtacagcatcagtcgtgttcctcctttcacaaagtcctttttattagtttgaataacaatgaggtacaatgatcatgaccaaacaggaatcacagatgaggtattgatattaaaagttttcaagttataataacttgtatatatatcccatttgtttttatacacacgtacgggctttttgtttaagtagcttgtacagttgtacttgtataaagcttattttgagactactactagcatatctttaaaatatttaatgaaaaacttgtaaattatttaggctaattaagattatcatcttttttttcccgtaacgtatatataagagataatgtgagtcgcaatcatcttagataatttacagtaattttaacttggacaattatttaaagaattaacaataaaatctggctgtacatgtttttcgatctttatttttttttatagatgggttttatgataactcagtaggaagttcattcaaaatgatttggattcaatatagatcatgcatggatatgatggttaattatattgaaagttattatataaaagatcatgacatgaccattttaaaaagtaatcacatgactatgtgatttaatctcaactcgttatgatcttatcacttggataagattttactcatttcattttctcctaatgaaagttttattctcacttgatatgtcccctctcgttattgtgatggttgggtttgtgatgagatgaaaaaccaaaaaaatcatttttaagttaagaaacatgccggagtagccaccatgggtttattttatatatgaaaatcttggaaaaaccttttaaaaggaaaaaaatctctaaaactaccatgttgttggaacacaaggaatatttatcagtcaaaacaaattttattacttttaaaacaagagaaaaattaagaaaatatttttttaaacaaagatggccctcttcctcctatcgatctatacctgagtttaacaaattatattcatgttttttgtttgcaaataaaaaaaataagtctttctcgataatcaaacaagaaatgtatctaaaatgactatcattaaacctttatttttaatagacaagtgttgcttgtctgatggacatatataagtgatcagatatagattcacttcaagggctataaaaaggaaatgactagaaattaccatatgcttcacctattcaaatttggatgacttagatgatgatgcatgaggcttggagattttacagcagtgcaatcaatagacaatgaagtttgaaaatatatagtaaagcccatttgattcatatcctgggcaaatcgtttatctcataccctgatcctgtatacaaaaaaaagacttattagtaaagattaaaaataatcaagagtgtgaatgagttgattgattgagagtaaattgaaaggaggattgggtactaagagaacaaaatgtaaatatattacagatttatggcttgacccgtgcttgaattgtgaccttagctatatgatgagaaattttgggttgtaataattttgagaaaaaaaaatgagagattgctataccatcaatatgattagaagcaacagaatcccaatatttaggatatgacatatgataagtaagagagacaaatcacagaattaccagtttatgcaaagattactaaaatttacttggttgcttgaattagtcgagatactcatactcaacataggataagatgttcatcagactcattggcatggatgtgaacttagacaccaatatgaacggaataaataatttgaactaatattcgcatgtccatcagtccatgtacatcagtacattattggtagacaaggaatacataggtaaaaaaagaatatcataaatcataattaatcctacaattgagttaatgagaaaagcctaaatcaccgtcttaattacgataactagaaaactaatattaatgattgtaaaataaataagaaaaaagaaaacatttaggactaataaataattataataaaaaacttttaactagaatctaattttttttataaaattaagtgtgtttgtccacatgttaattaacacatataaaaccaaaaaagtgataaatatgatcgatgtaaaaagaattttttatattaattataattacaaccaatgtaaaaaataagatcagccatatacattatttttatattacaacttttatgtaaataattttttattttatttgtttcttatttttgtgaaaaagccccttttgattcatacactgtcatcttgcgttagcacaggcgtgtactcaggaatgccatcgagctggtcttaacttttcttttttttttaaaaaacaaatcatagttaaaactgaaaataataatttcaatcgcaaaggaaaaagaagcagaacgaaagtttgtttgatttagttttagtccaatttttactagtcctcctcctttatcaataggtagcaatccattgtagaacaacttatatatttactcttacaatttttattatatttaaaacgaaagagacggggtttcgtatagaaacacagcacaagttataatgtgagcccacttgctaattacgacgtgacttgtttaaagggaagtgccaaatttggattaaggtccacgtgctattatgttgatgcagatgttgttcgccttaaaatggtagagtttctgacaccccctatgtgctattttgcaatggacccacgcattcaactctatttactcatccacgtctttttcccttacccatccaaccatggtccccaccacatactacaaagttctacctccatctcatttgttcaactttctttgtctttcattcatcatcatttcctatttctttcttcttcttttttaaccataggattctggaattttttattttacatttgattaattttctttcattagaccgattcattttgaagtaaaataatatctttaattatgaatttatatttaaaataaaaattaaaccctagttagacattaattaaaaaattcaagtatcaaatcccttgtttcaacaacttttattctcttttcttaacattaattttcctcctatcacttatttttaaacttgaacaaacaaactttaacttgcatgtaatgcccttaattatttgtctgatatttaattatccatttttcttaaaaatatgatatggtaatttatttttataaaacacatgcacatcatacgtgtattttctcatttaattaagggattcaaaatagtttagatcgtggacgagtctagtccggcatgacctaaattaggctaaaatgcgtgctagtttcgaagaacaaagacgtacgtagttgtcttccctttaatattgtttctaattctatacatgtggtagttgcatagtaattgctaatatatgtattccagatgtgaggatttgatggtctgattcaacataaggacttattgtggcccaacacagaaacaaaagctcttccacttctagcgtccttccctagttgcgacttgcgatccagagaaaaaatttcaaaactaaaaagaagctatagaggtaatggcggttgaaagataaatgtaaaaattagaatatgccttatattgactttgtcacattccttgtttgcaccaaagacgcaaagttgtacaagttccatgcagagtttattcatgtccgtgtgtggtgatttttcccactatatacacatataaactacgtatataactatataagtatattcatttcacattatatattttcaacatcttaaggaggtaactttcgcaaaggaaaatatgatgtcttcgataaataatacgtaaaatataatacgtaaagtatgattatacatacgtaaatttgaagtataaaaatggctttattctcatgacttttgtaatgacgttactctagcctataagattgtaaaagtattggaaatgatttgacattgaccatcacagttccttctcttccacgggtggaggacagagtgttaataagtctttgacggttgggtagattggcaaattaaagccacaccatgtgggccactatgactaatgacaaaagtgttgaattgacaaggaaagttgtatttacattaattttaacgcataaaaatatgcacagtaaaaaaatattaagataaaagtcataaagcgattgatgtggtttaaaaaaccaacaaaataaaattatagtatcagtagtataaattaattgaaaataaaggcacatataaaagcgtattgagggttgatttcgctttatttgaagttagaattaaacaaatcaaattaatcaaactaactgagttacattggttcacacattagataattagtttttgaattttacggatgacttagttgttaataattattgatgattattttaaataatttttaatttaattttcattacattatgctaaaataaattaagaagtcacgtaaattacatttaaaaaaacatatataaataaaaaaataagaaatcataatatatgtaaaaaaaaatcattattacaacaaccaaaaatatgatatacaattataataataaaaaattaaagacctaggtatttatcataattctcatgaaaacagttatagttgtaatcgtgatgataggtggtgccattgactataatatcggccacgagttgttccctgcttcatggactctatcacgccctaagttcaacgattttttaagattggtttgatcgaaccttagagttggaagaaatgtgagactctagttgggtggtaattggcacttaggttactagtgtcatagatagacctcttcgtcttcccaccactcctttttatccgcatgttcaagcacactcactctaatgttagggatttaagggagtctcagttcaatttaagatagagcaacttttttcttttatatactatagtagtgtaatcaaattaaattcttattgtaaagaataaatatataattgaatacatggctgtttaaaaacttttatactttaagaatattttgattaaattctattaattattgttcatattatatctttcacaatttcattatacgttaactagctgaaacatattttattcttgaggttatttaattagacaaatactaactaatgatctaagaacattgattaaaggattcaaagtataatttttttatagaaaagtaaaaaattatgttattcataatctttccgtattttcttataatttatataataaatattttttcttttaaatttcttaattttgactaataacactaattaattaaactctttaatttaatagtaaaatacataaaagaatctatagtactaaagacagtttctcactcgttacagaaaatctttcgctctcactttcaagaaagaaggagaggaaagagaaaaaaccgtgggagtctcaatcatcaaagcagagccagaaccatatttgtatgaggctaatatccagttgattggtcaattccatggtccaccagccagtagttcctgttacgttggaccacaccacagttttccccgaacgaacgagcccaagtagtcttgacatatatcttgctccatgcacataataaaatcatagttaattattgttggtgcaccagtgtgctgggtcccatgatgtttccatcttcgattcgatgccccaattcagattgttcatggttcacttcatttccactgttcctcccctcctcaacacaacaacaacattggtaagtggttcatcagtatatatatgcatgtccatatatatatcatatatgtataccacatgggaccttgttcagtgttccagctaattcttaaccttatcgttttaaaaaaaaaaatctctctctctctgggatgtacgatcaagtgcatgaaatgcaagaatggcccaacccacgttctacttttcttgggtggtaaaattcaaagaaattggagtgttggtcgttggacatatgcttttatttgggggatgaagttgaattaagacatagcactccaatacccatatatatgtggtactattggagatacggtaatggatagttttagaacacagaagaggactggattggaatcaaataattattatggatggagatgatgtgtatatttaacatttcattattttactttgaatccaatgaaagctaacattaagcatccataatcaactcgtcagatttagcgtccagggtagacttaaatacacatacgaaacttccctaccactatcacatatttaggagttaggagatctgtaaaatcgaatcttacccatgtgctgcaaaggagagtgataaggtgccttaacttttgaaaatctatgaatatttgtgtaatattaatcatgccaatatcacatacacaaattgtatgttgtattattgaataattttatctcaaaatctactatcaattgaaatttcgtatcatatttataaattttattttaattcaaacttgtttaatattgtactaatatacataaaaaaattatgtaatatttacttttagaatataaaaataaaaaaatgtaattacatatttatagttgttcaactttgataaaatttaatagaaatagtttagtaatatataattaaaattcaatgattagattgatttataaaaataacatctttgtatataaaattgttgatggtgcaattaatatagcaaatgtgattttatgtcttattaaaatatatgtttttagttgttatcattaattttattttataaaccagtgttttggtatatataaaaaaagtttcaagttgtttaggagttaaaactaatgataatctatagacacacttatccttaaattcgttgaaatgtggacaataccttgaatatgttgtgcaaatgatgcaaaggttggaactatttcaatatatataaaaagtctcatgacgatttggagtcaaggtcttagtttataaacattcttctttgagatattgagatgtattttaaaaactaaattgtaagaaacatgtgagtcataatagacaatgccttaaatgtgataagtttaacgatgtagtcgatttcaagttagagccttaacattaaaaagagggtttaggtcacacacataaactatagacacacactccctttagcctccagtggagggttaccattccgctatgttgccccttaatccattatacattttaaggaaaaaatcatgagacttatgtcaagcaaaacgaataatatatacctctaatacaatgaatttaatgatgtggtagattataagtcaagaataagaggtgacatataaagtaatgatactttgctactcgctaattatatcattactcataaaaattaaaatggaaaaaaaacatgtattttaataaaaataaataaaaataaataaaaataatgagcatataaataaaaaataacaattattttagacaaaaatagtttttaaacctatgagattgaacaatatttatttcttggcacattcttccacttataacaaaggcataatttatgatatctacacacacaaaaaattcatttatttattaataaataaataactaccaagcattagaactacttttattagtataaccttatctaatggaatgagatttgttgttgtataaccttttgtctattgaaaaattaaacaatttgtaattgaagccctataataaaatttatcatactagcatttggtgtatttgatagtatataatgttttataccaatgaaattattttatagtgttaatagaaacttgaaatatctccaatttaaaatttgtcaaaaataaattatactaaaaaaaataatcacaacacttaacattttattttttaataaatactctagctagttgctaaaatagatttcttttcaattaacttattcattgaagcaaggttagaatctttgttgagagagaatatccacatccagtgtatcagatagtttcgaataaaattgtcagaaaaaatacacgtggaactaaaaataaaacttatcaaaatgagcaatatgaatatccttttaattgaactaaatcatgaataagaatagagtcaaatatgaggactgaagttcggctatatacttaaatataaaatgattctatatcggttttccgttagatattaacccgttatagacatgtttaactactagtgccaaaaaacatatttggctaaagttaattatttcttcaagctaaaatagttcttattttaattgattttggtacacaaagaccacacattactttcattgtaagcttctgacaaagcaccgatttggcatatcatgaattgcagccatcatgttggtttccaaaattttccataaaataaggtatcaagaactgcaatccaagaagcgcatgatttggcaggaaaggtaataacatgtctagttgataggggtacgtttttccctcctcatatgaaacagaacatgatctccaacccttttcagaactcttctaaattagttccaagagctaggtcggtattcggtaaatgtcccttcgcaggaatatatggtggaattaatttaaaagcttttaattgttagttccgtaaaataaaacttaatgtggctacggataccaggcatttatttcaaaatttagaaattgaagttaatcataatgaattttttagataaacccttataaactactatggtagaatatgtaaactactaaacttttatgtcatttttatcccgtactagtttctctacagcacacatcaacggaagccagcatatatatataaacacgcaacacaacactggataagataaattataaatgcatcgcagaagaagggatcgaaatcagagtttagtgtatatagattcacttaaagaggaggtgtatgataattaagtaccaaaacaaaaatagaattttgcagtcgtgttgaaattaaatttgcttgttaagttctaataggtcccgcaaactaagtattatctagcagagattttctattttatttcttaaaactgtgataattaattactcatatttaaagatttaatgataaatatgaaaagaataaaattgtacatatattttaccgttcatttaaaatttaaagatgttaaaagtcataaaaatataattttgttacttacgtttttctaaatgtttatctactttttgttaaataatcataatttactttatatattattatacttttttagtatatttataatattatatatatatatatatattaaattttccctttaaagatatatatgttattatatttttatcctaaaacaatacggatggaaatcaagtggtcccttgttaatgggttagaagtaaagaaaaagattcgtgaatttaaagtatcaaaatattttggaggaatatcttaaactaaaataaatattcactctttcttattttaaaattgaccctacacaaattttaatatgatattaaaaaaaattagtgataaattgacccccccccggcccaaaaataaaaaaagttagggaaataaaggcttagtaaatcaaaacaaacttgtaacgttaaaaattcaaggaacaaaaaatgcatttaactaaacaatagaagtagttcaactttttcttttcttttctgaataaccccaagatgttggtaaagcatcgagataatgccaatcactacatgagagacgtgtcagacttatatttcgatctccgatctccattcaaacttaattagaaagaaacaatggtaaaagaacccggaaacttgtatgaaaaggttgacaaatgacaataagcttgcatatgaaaaaaaggtatgagttattgagacgttatttgtgaaaagaatctaaatatgttgtttcatgtttaagaaagttaatcttataacttgagtataacttgaaaaagaaaattcatagtttaagcatagttggttttaatgaatcatttataatatgtcatttcctaaaccattttatcttctctttaattttatgtgttttttccaaaaacattatgctaccacattttattatagaaaagagaaaaaaaaaaaaaaaaggtatgctgtaaatttatctttactttgtaattatttatctttgacatgataaaaaaattataaatttgagtagctcatctatactctatttcgcctcaacgttaattaaaaaaaaactaagtttaacctattcgagattagatttttggacaatttttcctcacacccttgaagtttcatttatttatttatttatatcagccaacaaagacaaata

SEQ ID NO: 36 - DNA, 274564 bp, Glycine tomentella
ttaatttattatattatatgttatgctttgaataaaaaataaaaaaatttaaactggactcacattgaagcgcaacaaaccaaataaaaaaagaaaaaaaaacactaaaaacatttggcccatatggcccaattcccttgaaaccctaagttactaagatcagttagcccgtgctactagctaaatgtcatcgccgtggcccacaagttaatgaaacgacttcccaaccctgtgttcaatcaatctgtgtccatttttccctcttccttcttctttttccctcacgaaacactcaccaaattgtgcatttgcagcgatggattattcgggctgcaactaccagcagaaaccacaacacattcctatggctacgatccttctcagatccaaatcccaccctacgaacaatcatatgcttaccaacaatactacacttacaatccccaatatgcgtattttcccaatgcatatcaaacccaatttcaattccaacctgaacccatctacttcaccctcctggcgtctaccccattgctcctgaacccaccttgcttcaccctcctggcgtctaccccgttgctcctgaacccaccatgcttcaccctcctggcgtctaccccatcgctcccgaacccgccttggtgaatttttctttaatcctttcaattcttgattatgttgtaattattatttctatttattctagtttttgtttgttagtttatttatgaaaggaaaattgtgaatgggtcatgatctaaggtaattggggatttgattgtgtgtttgagtgggattggctgtggataggaaatttggatgtgtttgatgatgaaatgtggttcatcaacctgtaaaataagtaagcaaggttttgtggtcgcggttgtggtttcgtcatgtttcttgatattgttggaaattgcggacaaatgttgcttgatgtggtcacaactgcagttgcattgcagttgctgacacctgaaaaagcttgacgccgctattgaaattgtgactgtggaccattttttttatagagaaatcacaagtgttgcatccacaattgtagtcaaaattgtggcaacaattgtggtcgtgctgcagttggggacgcccccaaaaccttgacgttgcattccaaattgtagttataatctttgtaacaactaacaagtaggtttttttggttgatttaaactgtgtattggtgattatcctataaactaatgtttggctgagtgccaggatggtgtgtgggttatgtcttacaactttgactcttaacattactcagggtgggatggcctacagaatccttatgggaaaactgtttgggattttgttactaggtagcctcatttaagtgccatattcagcttcctagaacaccattgtttagggtttttttgggtaaaatattccacaagaacttagctctattttagcctccattgtttcagactttataagttgatttttcttttcttttcatgtgtttattttttcttctgcctttagatttacttgttcacattttgctattttttaaatctaatttgttatgttctttttagattaatgtcaccatcatctttcatgttttggctccattactttgttcttattgatcctagattgatggtgatggtgtgtaaactgtgatttattatttatcatgaatatctttaatttttggtattttgtgctgtttttagtattcatatatgtagtatagacttcctctggtcctatatgtatgaaacaaatatgtaattcatcaagaccaataaaaatagttaaattagttaattgtaattaataatgtcttaaatttaaattttattccaaaaatacccagaactattatcacgagaaatgagcaaatgtctctttaatagatttcaaataaattaaagctataaaaagaaattaacaattaatatacttgaaagtttataattaggatttaggaccaaaagaatgttctcatttgtttcttatataaagaaccagaggtagtactatttagttgtatttatttaaaatagtggtaatcctgaggcctttgacttgtatctctgccactaaacaaaattaatagaaacaagcattggtataggatattttacatacatacagcaaaggctttgtatatataattgctccagtgagatcattgaaagagttgtattatattcaatggctaattgactatgccaatctgtttgggcttttaattagaacttgctagttgcttcggtgtggctgaaactagatgatttaagatagattgagtcaaagtcaagccatttgatatggtttattcctccttgactcaattcagaatatttgctgcttcagcaacatggcagtttcttaatttcctaccaaaaaggaaaaaaaaacatttgcagaagtaaacgtaaaaggatgattgaagattttgcaacacttaccttttatacattttgtaatgcttttagagtgaatagcttgcagtgctccctcagcctcttttgggaccttctctggacaaaagattgatactggattaggtattatatcctcagcttttcatctaaaaccttcagaagatgttgagaattctgcaaacttggccacaacaccctagagtgaccagataaagacaggagttgcataatataagcacaagctattgtggctcatatcatatctttgaagtcacaataatgccacatggtggtgggtctttgctggttgctttagaactgatgtgggcatcagatcatcttgtttctcttcttaactgtctggcctttcaaagtaacaatgcagtgcctcacagtttagaacaagaagaaacattgttcttttgttattcattggatataatttttattcgatatactttgttttctcttttgtttgaggatgtttcttttcagttcagacttggggaatcctgttatgagaattttggatcttcttgctgttattagtctgcattttcaattttggaataaaaaattgaagcttggtacatgaggcacccaccactaatttgaattttggatgtgaagttaaaagtgaaggattagtaatgaaattaaaagtgaagaaacacattaaaactaaaattgttaagctatgaagctgagtgcttaatcaactgtcaagttaattttccatttattatttagcttcagatctgattaaacctttgttataatgaccattggcaaacactggatgcatttaattttctattgaatttatgattaaggatttttcaagtgaatgccaaccttgttaatgtttcatattcagaattttgatttcaagatacatagattgaattatataagatttggaatgatacttaaaattgttgatgtcttgtgaagcagtttcagggccataatggttgttaatgtttgtgaaaatttaaaatgactttctattttaaaaagttccttgattattatcacttgcctgaaccagattttccttttctcgatccgttttatgtttatcaataactcttttccccagtattttcaagagtttagtaatcatgagtttttcattaattgacttatatttcatcatgttgagtgttgacagattattgtgacaagatgcattactgaaagtttagtttaataactgttttcttttacatttctctctccggacataactacccttgtgattttgtatcatttgtgtgcatatcttgtcattctaataatttcctctcaaaatttatcgttcatttattcctgataattgtaatcaatatatgcttgaattcctttgttaattcctatttacagactgggccatctcaatacagaggtaggggtggcaggggtggtagaccatttagaggggctggtcgtggtcgaggccatggtaggggacatggagtggggggtggtagacacataccatctcattcttctggacctgctttttctaatgtgccagctcaagtgcaaataccagtaccaccacgtaaaatgtgctgtgaaatttgtaaggttgagtgcaatagtccagaaatcttggagcaacacaagcttgggaggaaacatcagaagaatatgagggtgcatgaagaatcgcaaagacgcaacgctataaatggacaacagagtggggaaattcctacttctcaattgaatttaacagaccagcctaaggaagttctggagtccgagaaaaatgaacgccccacagaaaatatgggctctggggttataatcaataatcacaaggaggaaatacagctgcagaataatgtaggaaacatttctgaggttccagctgaagtgcccgagggaaaaaccaaggataactctgctgcaagatgccgaggattgaagcggaagaagaaaggaggaaaaggaggtaaatacatgagaactaatgatggttcaaagccagtggaacctgcacaaactatgtcttttagatgtgagctgtgtgatgttaaatgtgagtcacaagttgtttaccagagtcatgtgactgggaaaaacacttatcaaaactaaggcgtgcttcatctggagtaggcctgcaccagcagcaagctctgtctggggcattctttggacttcaagcaatttacccacctgacatcaatgctctgtctaatgcaattaatgttcaagtccaacaaggtgataatgatccgcaggtacttttggctcagctcctaatgactgtactatctcaagcacaggttccagcaacagcaccagtgacaggtgccgtggctgctgagatgccagcaccatctatggctggaccgagttatgaaccccagttgttgcagacaaatccttctggggaaacaaaaactgagctgccaggttcaagtgtcggcacccaaattgaaggtggaggttctgaaactaaacaacaggtgtgaagcttcagatagtgctggtggtgctgacatctgcagccaattcaggtaaagcaaatggccaagtaaccttcggaatatgaagctcccaccacttggtatggccaaagaagatttaatcactctctttctttagttttttcactttttaggcccgaagggttgttaactatatgttgggattttcttttgtcagagggagatttgaatactgtaggatttgctcatatgaatgttagaatgtgtcagaaacgctttatgttacttcaatgtgcaaaataccttattgggaccggattagtgaacatgaacatgttaggataatgcagtttaacatttaagaaaactgataagtttaaaattttctgttatgacgtgtagaaaagttttttttttcatttgcaacgggttctttaaacctgaagcatgaaacaagttgaacaggaattttttggttacaaaaactgtatgtctaacgagtgaaacgatggtggaggaggataaactaaagaatcagattacttttttaaatttgaatttatcaagattatgattatgattaggtgtcaaatattgcagaagtaaaaatatagcatttacatatggttcatactttatgatatgtattaacgctgtgtatggtttaagagatggatataatatagggaggatggaaataattttggaggttgggtggagaaaaaataaggagaaaataagtttaaaattagtgagactcatgtgtactactagtctttctatttccctcctcatttcttctctattttttctgcatcaaacttatcaatatttatcacttattcctactcttttttatctactctatttttctccctaccaagcaacctaaatgccccgcttcaactatatgctggtattagtttaacaaggtaaaataaacagcaccagtgacctgggttggtaaaaaaattacacgacttttttttttaaaatgaaaaaacaaatatagtacgcttacaaaattatatttttgattttttttactttcatatactaatctcccgtctcaaggaagtagagtactagttatgaaaaaattaattttttttatgtgtcattctattcacatagttaatgattgaacctctgatatatatttgaaggaccaaagttacttgtcacttgtatcaaattttatgattaataaattttgatttaaatatatttttcgtttttgtaaaattcacaaaatttgaattttgtatctgtaatttatttttcaatgagtgaacaatacacgaagcaagaattttgtaactaactgattcaaaactcaaaatagatgggaaactccccttcaatggtcatgaaaagttctttgcctataaatataatttcaaatggcattaaacaatggcatagaagattttaagacagactatggtgaaagtaaaggggagagaaatttaacatgaattagaaatagatctatatacggggtcttggtccaatagaaggatggaaagaagttgtcataaaattatgtcatttttttagtgtataatttttttaggttacatatataaataatattatatttatttcagttatatatataatccatgtaaaaaagattagatttataattatctatacatctatactacttaatactattgataaataaaatatgatattttggtatacctatttcttttcttattttatcctcaaaatcactttttttctaaaaaaaaaattatctctatagttactcctttcaaccaatccacatccgcacacatcctaaaaattattcaatattatttttatttctcaaaaaaattagagaaacattatacataatcaatataaaaaaaatcattttgtataaatttgacggaaaacatttttgtgtaaaaatttgtagtgtttgtactagacagagattagaaaaaaggtgctatgaaaaaattgtcattttaatttatctctttctttccctttgcaactctctccctctctcgttgcaataatgtggacgcagcaagtgctgcctctaccaccccacaaaccgtttcttcgttattcaccttcgaacccatcctttgtaaatggtaaaaatggttattgcagagtaaaggcattgactttggatgaacttcccccaaacgcgcttcggaagaagagagagccgcaatggagaggaggcttcagcctcggactcgacttgggtttggctcgcactggcctcgccctcagcaaaggcttctctattcgccctttaaccgtaacagtttctctttttctccttttcttttaaggtttttcaattttcactttagtgtttctgtgaaatttggatgaattgagcatgtaatttgataccatgttttgggttctttgtccattttgtgaacttcttctcgaaatgttggaattaaatttggatgaagttacttgtgaggaaaaattactttttagtccctatgcttaaaaatcctctttgggtgtattcgattaagattttacaaaagacttttaggattttaggaatgtaatgacttttaagattcttttaaaaacttttatgattaggattttgtagtttggattttaatagatttacaaccaatgaattcttaagattttaaaggattttataaattcttagaaaacattcaaattttaacaaataaatgataatttttgatttttcgcaaacagtcagctttaagggaattttcacaaacagcttgcaggcatgatttaatggagaagctatgaggacgttcataagctgatgaagaaaaaaagagaaaacaaggagaagcttatggctttaaagtgatagaagttcatttgctctgttatttttgtttagaagtttgatgttgtgtgtccaagctagaagatatcaagctctatgttaatctcatcacttctcaagcagtggacctttttttctctgttttggtggcaagaagggatgactgtgcacattaatttgagagattactaataagagctgaatttgagacatatgtgcaaggaaaaagaggaagaaagaaaaagaggaagaaaccagtaggaaaaaaattgtttgaaaaatctcaagggttagattgtttggtgggcgtggtatttataatttctactaaaaaattccatgaaatccatcaaaatctattttagaaaaaatccattgaaatttgtggaattttgaataacgagactttttatatgttatgaaaaatcttaattgaatacaaatggattctattgtagtctttgaaaagtcctaatagtgttgattgaatataacaagccttatttttttcatttaaaagtcttgattgaataccacaagattttttaacaaaaaatgtcttttaaattccttcaaaatcttaattgaatgcacccccttagtccttgtacaagtacttacaaacattttggtcctactgtcacataaactttaccttttagttcttgccattttgtaaaggcagggatcaaaaggatccgaaagtacttctgcagtaaccaaagatgatcttttaagtgtaaggactaaaaggtaaagtttgtgtaactttatgaatgagttatttttcctttaataagtagtgacatgtcaaattgattcctaactcattattataggatatttggattagcttcatggtgaggaaaaattaattattttttcacggtgaaggtaaagctgcaaatagttgtagactctttcatggtagcacaatgattttgtgaggtagaattgattctgttgttttatcaaaacacactgtaagtgacatgccaagatttaatggaactatgattatggcagggaccaaatgtgctcacatatttaaaaatgatgataaaaaatatttaaaataaaaatgaaaataagacatactaaatcaaacccagatcatagagggactaaaaccaaagtttagtatacttgtaaggaataaaaatatgtttaaacattaaatttatgggtggagcacatggtaatattgtactacaactgataagaaaatgttgaagttgactgtgttgagattaatacatgtttaatactgcaagatcaattacgaattatgttatttgtgtttcatcagccatttatcctgataatcctgcagttactataggttttggaactgcgaggacagaagcttgaggttcagattattaacattgccgaagaagaggttttgattcattttatttcacttgtactacttggattggattgtatatctttgagggtattctaagtttgaaattgacatggttttgaaactgtaggaggttgatgagtttataattggacttccaaaatcttctgatgggaaggaaacaccacagtcgaacaaagtccgaagtgttgctggaaggcttgctgttcgagctgctgagaggtcaggcattttaatgaagctttgaatgtttaaactcttctatctctatttatgctttccaaaataagaaaacgaattgcattaggctgaattgtttattataagcttgatcattgttcacaataacattcttcttcaatgtcagttttatatattatactccatttttgaagctgctaaaccaccagaattaggagttatggtaatgcctccaatattcagtgattgaccttagcaattatattaagtggctttattcttctgtggccttaaatttccataaccaacaataaatttgtttaacttatatggtttctggagactggaattatggatggctccttataggggtttattgaattgattaatttctatttatatatcaactctatttcagaggttggagagtgtatctacaggatgagcatgggacaacaacagaagccatagatagaatgatcaacatgtaattgttttgaaacttatttattgattgtattatatcctttgcaattctagcttgagttttgtgtgaaatgaataatttcctaagtgatatggttatcttggcaatgatttggcatctgatgcattgtgaccaaagtgaaaagtttacacaaaggttatgctacttgcaggattttgtattcactatttatctagcgtattttattatcggagacagttatcatatgcttcataaagggaaattgagggaaaagaaccctgtaaccttagtggatctcattctctcagagcatcatgttgaagttctttagtgttaataaactaaatgagtagttgggaatcaaaaccttcatctgttgataatacttgcttgtgaagaaatatgcatgctatctccaaaaactacgaatctttttatgtagtttgaggccattttggtataaaattgtttgcctatgaacatagatgttattctaaccctcacaccagcatggtttttattatgtgcttaacttctgagatcaggggaggcgccatgttagctaagggttcttggtcatggtataagaggaagtagtactataagatgcgagagtcaaatgaagattccttttaaaagctgtctatcaaaattttgtatccgaattttgtgttttattgggaaactgacacacttattactctttcagaggtttaaataagtcctctcagcagaagaaacttgatgcctatgctgccatggtaagtgaatatcatgtttgatgcctttttggcaatatagttcattcatacaaagttttgtatgaacttgggatatctaattttatgctccctttttggcaatatagtttcgtacaatgctccctcatttacacaagacatttctagaataatgactcttatcattttttttaacagatggtactggagagatatttctccacgtcaggtcagggtactgaacttgttttgcccaagaatctagaattacaagcaaaacttcaaaggggtcctcccaaagatgttgattttttctcggatgaagactaatctcaggtttgctttgttccataagcttctatggtcaattttatggccgtgcctggtaagggttgacaacatgtttggaagcagcttacttgtaccattccttcatgattacaaattgcaattatgcatgagaaagttttcataaaagaaagatattccaacaatcagtgatcaacatgaagtatttagattttgtaacaggaaagggagagaagcaaggaaaccatgtctattcgaggcattaaaattattgtaaaaaatatatatttattcaacatgaagtttgagcttctgattattattattttcttgatccactctgttttccatgtgggatctgtagctattggcggtgaaatcatcctaatttttttaacccaattgattaatgaagtttgtgttttaagatcaattgaagttataatttgctcacatacaccttctaagaaataagtgggtgtatatttgtaactttctctaaggcgtttttcaaggttagttgtacttatgaattgctagcatactactaaaaaaacaagtgtgtgtaggttaacaaatttcatatagactcactcaaaaagtagagagaacgactctttcagtagagatttttttttaattattttaaaaagataattttaaattacatgattgtcctctaatttgtgtttgtctaaacaaaggaatgatgtgttttttgtctaacagaaacagtattcgatgttaacatacactttttacgtcacttaaagaaattttgtacatagtgagaatcgaacacggacaaaataaattgtttttacttatgtaaacgtaatagaattcacacgactaagtcaatcctttgaattataatttttaagtagttaattgattattaactaacttttactcttaattatttttatatggttatatggtttaaagttatggtgcttgcttttttaaaataagaatcattttgactaaatatgtctcatttagtcacattaatattgaccctatcaatatatatgcaactagggggattctaatgatattttctggcattttttgtacaactgattgaaatttagcaaaaattacaaattttggttgatgtaacttcaaatttaatgatttttctattctgatttaaaaggagactcacaaattggtaactttcaataaagtttagtcaatcatagagtattaaaaaaagagtatccagaaaggtgtcagtaatatttctccttataccaattctttgacttgactattgccaagtttaaaaaaattgtttgattagatcataagtttaaataataatataaattatgtgaaaatagtaactaattaactattaagttgccttaaaaaaactattaagttgaatggtctaagttaataaaacaaaagaaaaagttgaggtactaagacctaccataccaccatactgttattagggactaaaaatgtaactcctcataaaatgaaggtcaattttcataatttatctcttttggtagttgtgaaatataaaaaaaaaaaaaattgtcatgccctgttatacagataattcacatagtaagtcatgtgaaattcaatatgaatgttacctcatcacttaattaacattctaagttaacattgatttttgtcaaattttttaagttaacaacaaaattaaaaatggaaaggaaaaattcatgtggaattattgttggatatagggggagcaacaagaagaatgaatcctatgaattggaagaatgttttgagcttttcacatgtcttgaaaattatatttcaagtgaagtgtaggagagaccaatttttttatccttgcattgcatgcatataatcattaacatgcttaaatattttcattaaaatacaaaagctactcacactttgaaaaaagaattaattgagtaatatttttagaaaaatgtaatttcacaattttaatcgattattcaacgtattgattgattatttggttcatatttgaaactgaaaaagctttgatgaacactttaattgattacacaactcttgtaatcgattacatagtgtaaaatggattttgtgcattgatgtaataatcgattaccattatttgtaatcgattacataagctatttgaaaaaaacttgcttcattgctttaatcgattaccataaaatgtaatcgattacacaagctgtttctgaaataaaacttttctgttttaatcaattacaactcgaattaatcaattattttgttcgttttgaaacctagaatgtgccttgaacactttaatcgattaagtgacaatttaatcgattacataaactattttaattgattatttggcgcatgtaatctattacaggttgttacaaaagctgttataaatagaaaaaaggcttggcttggattgtgacttgaacacttcgaattttctgagtatacacaagccttctaagagttaaaaagtgattttctgggtttactaacttcttgtcccactctttaatcttcatgggtattaaatgatttcttgggaaagagatttcaaaagtgtaatggagagcatattctgaaattctgtttttgcaattcaaccttgattggtaattcatatgtattaatattcattggatcataaagttgtttttctccataatctttgattgtaatttcgttcttccaatttctgttatttgatgctattgtaaaagagttcttaaagcttgggctagagtagtgttctctaggaaagaacagagtaatgttctctagttcttgttcattagaagtctaatagaattttagatttctattatttatctagtgttgataaaaagagtttgttataaagcttgtaagaactaaaatttataataattgaactctaatctaatgttgattagaagaatctggatgtaacttctcttaagaagtgaaccagcataaaattgttttatctctatttttacaagtcatcttgttcatttgttcttggtgtcattatcattactcaacaagttctgttttgagctattggtttcttgaactgagtgatttgattgattaaaaacattcttgatttaaaagtgattaagattctttgactctgattttataaataaattttaaaaaatcaagtttaaaccaattcgccccctcttggttattgtgggtattcctattgtttttcaattataactagtcaaagttttattgaagaattaaaaatagaaataaaaaggtaacaaaacataattcacccattttaattttaaaagagaaaatcaaaataatcccatattaagcattttttttattttctcatactgttaattaaaaaaaatcagtttttctcaacgtttactgctttttaatcttttttttttttaattttgtattccttctgtttaaagttgtttctatagtttatttaaacaagacagtgagctgattcactgattttgaaattaaagtggccggttgaatcccatcccatttttaaaacttaagtctaaattgacttacgtatatataatatatgcatacgtataatttttaaaacatacgcatacttaatggattcgtactaaaattgacttcgtaccttcagttaatgggtagagtattcaatatgcatactaatttgcatactgttgaattcatctaatactgcttgtttaatctaattacactcaaatatatatatatatatatatatggatgaatatttactttataataaaattaggacctatttgaatataaatttctctagaagtatttttagaagaagaaaaaaatgaaatgaacttttccataagttaaaaataattttttatgagttcatttgtagatgttatctcatcttttagagaaattatattagtgaatttttaaaaattaactaatagagaacttatttttacttatagaaaaatttatctcattttttttttattttcttgttttaagtacttctaaaaataaaacttatcgaaacacgccttagtccgataccacggagtcttcagtgttattcttcttctttttttccttagcttctgtctattattaatttattattacattgtaattagttgcattcaaaagctttaccatgtgcgatggagaatatatcaatttttatataaatcaaatcatattgattctagttagtgtaaaaactctatcttccctttgtctttttcctgctataggggtgcgtttacttattttttttctatagaaagtgctttgtgtgcttagtgggttcgaagtttccatggcttcggtgccccttatatcttctcctaatgcttgttcaatcacaactcgtacctatataatgtcagctttcacattacccattacttaattacttctttgatttcattcatttttcttgtaaatcctttggtcatttttacattacaaattgtttaatttgctgactaatatgaggaaccttggtaattgtaggtggaaatctccggcggagtaaacactccaccaagaatatttactatgcaagtatgtatcagtctttcacattttaccttcatctgtaggtgaaatgtttagtagaaggaatcacttttaccttttatgagtcaagaaatattattagttacttcttttggtcctttatggtagattaggtataaatataattataagaaacataaatttactttcaaatattaatttttatttttttatatccttaatttactatgaaatctattaatagtatactcactcttctctatataagtggatgtatccattggtttatttaataacataagacacgtttattggtgaaaaaaatatcccttgaattataagtatggttattggattgaatataaccactacttaaaatatttaattctatgagtttttctaaaataaaatttaaatttataaaattattaattaaaacgactaattaacttaactacttcatgggtcctttgggaaggtttccaagttcaaaggaaagaaggattatttatttttatttcaaattaaaaatcaggtgatatttaatgaattcaaagaatttaattaaaataaagaatagtattaaatttatattaatatagtattttatatattttttaaattattaaattagaagatactaattcaaaataaataaaaaaatttccccacccttcaaaagttatatcctaagctgtctcttaacttgtgttaagattgggatggggttatggcccttttttgtttgtttgccttaataataaaaataatcaaagagtaaataaaaaattaaatatagttaaattaagataatacaatattcaataagtaatggaaagattatgggaccaattatatactacgtgaaaggttaaccaaagctatctagacaaaaatataaaatgttgaaaatatattgtttgcttcattttttccttttacacaatatgagtattttgtttaatgttgttcgtgttaaatttaattttgttcttctacattagtatttgcgagcgttatcttaaataccatttggatattaagagttttttttttatttaaaaaatagtatatactaacaataaatttaagcaaatgagcagtaaaaaaaactttaagcaaatgggtttatttttctcaatacaaaacaatcttatattttttttcaaaatgaaagtcaatctttaaaattaatttaatttccagtttttaaaaatcttcaaaatataattcatttcaaaattaaactcaaccttttttttaaagaaaaaccattttttttcaaagttaaagttaaccaactaacaataatattttcaaaattatgtgaattttagtttccaaacacctatgcatatataggagcaataattggactcgtcatccacaaaataaattccatttatcttaaaaaaatcaatttccttttaattgtctatatttcacaaaatttataaaatgtaatatactgccaaaatgcttaactaccctacttttagtccttatagttacaataacttttccttttaatctttatatatagtttaaaacatttattttggtccccatagttataatatttttatccttttggtccttggggtcaagtgttgacaaatgttgtttgaaacaaacataacacaactcatttaatttatgttcatctcaaatgtcattagaagaggatcaaaagggcaaaaaggacaactatgttttttttaaatagaaagttgttgtaactagagaaaaacaaaaataggaaacaatcaaaatcaattccatttttctatgtataaatgattatatattgaatccaaaactatattttttataactaattttttacattaaggggttttgttcaatgttttctctaaaactaaattttggtggtaatttctcaattatgctttctcgattcatcatcttgtcgtgatcttggtagcaataattttaaaacaagaatctattttttgttgtgcatgcaccactaatactacattacattcaacctttggtgctctaggttttggtgaattaaaagcttcacaagagaaaagagcaactcaaactgaatataatcatttgaggttgcagcaatcaagtttgaaccattattacaaatgcattaaaggaggttctacatatcaacaatattaatgatgccattattatattttttaatggaatgatatataagaccaaaagacaaaaaagtaatttattattaatctatattattcatttctaatagtaagttttatacgttgcatgtctatttcaaagtcaatacaattgatatatagaactaacataaattgtgataagcaattgaggtatcatagaactggctatttgaagagaaataacatatttggagtcacatgtaaaacagcacagcaaaaaaatgatatatatatatatatatatatatatatgatagtttctcaactttaaggagagatgaaaaaattgtgcataatgtctgtccaaagacaaataaaaaagacagtttatttttactgaaaatgacatagttggaacattaaagttattgctattattcaaaaaagagtttagtacaaatgaattatattaagtattaatcaaacattcgaggacatagttgttttatttctctttttttttttaaaaaactttttttaatttattattggattcatttaccatcgatcccaattaacttaaattaaagatattgttgatgttaattaatcataacattcgaggattatttgagattaatattaaaaagttcgaaattactatgttaatcagtgagtatggatagtaaaccttgtagagaacaacaaacaaatttttcatagagtctaaaatgttttggggagcaaaagcatgaggttttaatctaaaattgttttacaccatgactacataaacattaacctcttgtttttttattacatacactccttcaaagcatttgtaatgatggtccaaacttgaccgttggaatccaagcacatcattatattctattaagttctccttttatgttgcgaagcttttgatgcccaagaaccaagagcaccaagggttggatgtagtatataaaagtaaaataaatttcgaaaactaagatcatgatgaaatgatgaatcaagaaaaaaaaatcaatttgaaaactaaagtaagagaagtcactatcaaaatttattttattattagagatggttatgttgctcgttacaaggcacattttgtcgccaaagggtttcataaacaaccagggctcagaaacgttcgatctggtaattaaaccccacattgctctttccaaaggttggaccttatctcacatagatgtcaatgcattcttgaatgggaccatccaagaagacatttacatggctcaaccatatggttttgtgcatcctaatcacagcctaaccatgtttgcaagttgaataaagccctttacagcctcaagcaagctcctcgggcttgcaacaatgcttttatatcatttctcttggcttatggtttcaccaatgtcaaatctgacacttcacttttttatttataaaaatgatcatgttacggcttattttcttgtgtatgtagatgatttgcgacatacaggaaacaagtttctcagggactttcaacaagctgtttccaacaattttcacttaaaaatctctgaagtccaagcgactttctagggattgagattttgtctacatctcaaggattgtttctcacccaacatcattatgttctgaagcttcttggtcacttcaatatgcaagattcaaagcctatcttaactccaatgtccacaaactcatcattgatttcctgtagatagttatagttgtgatttgactgcatacaggtgtttattagggtctcttcaggtgtttaattgttagctaatagaggactcaattttagcttgggaagaaactcaattcattttttttcttattttcttatcctagaagtgtttctagaaaagtttaatctttcacaatacctgacatgagacatctccttggcagtaaacaggctttccagaatatgtaatgccccactgatttacaaatgcaagcaactaaacttgtgttgcgtatctcaagggcaccattgatcatggtttacgattcaagcgagactcctcttattcacatcagattgcaagtccacgagggcttagctacatcatttacttttgatccaatcccatatcatggtcatgtaagaaacaaccaactgtggcaaagtcttcaacagaggccgaatattgaaccattggttccaccactacattagccactttaaatccaagaactgttaaaaagaccttcatcttccaccgtccagaaagactctggtggctggtgcacttggacaatcttggacaacttatctttgtgcaaatcctggatgaggcaccttataatagactaacattttgtgcttgatccagtcccttccaaacagcttcaagagttgcatgtttgttcaagtcaccagattgtggacctcttaacaaagccattatcaactgcgcgttttctgctactcaagtccaagattgtccgtttgagtattcattccttccacataacggaactttcgaaatctatcattttattagtggccatatttataaattttaagagtggtaaaaaggctaattcctgcttgtctacaactcaaataatggttattctctgctctattgtcgaaactcaaaccttaagttagttgacgcaatgagaaacaaaggaaaatagttagttcccttagtggactatactacatggtattgtaaagctagaagaatttattacttttaaaatctcaccataacttacaaagaagccctatgttgaggatcaccttagatcttttaacaagatctagtgtactcttaatttaattcattttacacaaataattgcttactttgtcaacttctgagaacttctagaaagttatacaattatttctctaacttcagtctttaccaaacatgatataccccaatcatttgacgcaactagaacgatttatcgcatcatattttttcaagcgatcaagtccatccaacttgttctatagttgctttcacgttccatcctaactatgcagcagaaaacctgtaagagtagaaagctagaggtggtgaacaaaacaagcagagatgaaacaaacttccaccttgtacacaatcagtcaagccagaggtagacgacagaaacttgcattacccgtgaactagaaagcattttttttttcagcagcaaagagaaggtaaatggatttatttaactgaggtgaataaacgaaaagtggaagcaacaagactcaacaatagaatacaatttcgattgcaacgtcatactttcatatgcataaatgatcaagaaatccatgagaaaagtatgaaacacggaccacagtactacatagcttgcagattaaattaaaattctaatatgcaaatttattttttttaatttaattagaatgcactgacagtgtaaaagttttttacaccatcgttcaatcaaaattcacaagttttttctttcaaagcagacattcttgttttcagcttttcctttaaaaaatcatgaaggcaagatagtaaacaaggtaacatttttgtaattattagtagaaacatatacacttaaaaagaaaacgaaaatcaaaacaaatgcatgctaagcacaaacgagatttcaatttcaacacgagtcaagcatcataaaaagggtggtccagtgcaaaaggcttacactcttttgatgtaggaagggtttacaggtacaaagcctctgctccattagtggataacttgtttctgaaacgtgaacctataatcaacatgtaaaaaagaaaccttacaattgcaccaaggcttaccctctaaaagtgtcgaataccaagcagcagccaaaaacaaaattaaagatcataccagttttataaataaagttttagagaacaataagatctttattcatatcagttggaagacaatgactgttaatttcatggtgtatttagccttagcaataagaaagttcatttatgttgcaaaacaaagttgatatgagggatttataatgtgtcccaaaactgtgcattttgatgtgaaaataattagaaaaaggaaaagacagatcaaatatcaagcaaaaaaaaaaactagtaagaagatcccccctggctttccaaataactccaaactaagtacatcaataagaaataaatcaaaatgttagaagcagatttcagtatagatgcttatatcagcaaacacactaaaaaaaatgagttcatgtagttcaggggactgagaaaaacttgcctgactttgatgttctttatgtaacaaagacgactcagtactcttgtgcatcaaattaccatctttggctcttcaaatcaactaaaaaagtgttaaaaaaaaagataaagaaatatttaaaagcaaatgatgcagaaattactaccaacttccaatcaaagaaatgtgcatacagttttgcatcagcaatgtctgacagaactccagatcagtgattgaacactatgtagcttgaaccaaccaagatgatcaagaccaactgatcaaccgggtctccatcagtacgacaacatttaggataaagtccttaactcatttcttgccaccatgtaactatgaaataactaatgaatacatgaaagcctggatttcaaagcatgaaaaagatattagatggtccaactttcacacccccgtttggaatgccagacctcagttagtgatcatctccatgtatactctgcatgaccagagtcaacatcaatatcaacatcaacagcacctttaacccaaattaattggggtcggtggtagatgaacccaatgataaatcgaaaataaagcaaaagagagaaacagagttaatttcatgaccagagtaacagaccatattttgacatgcataactttgcataagccaggaacctgcttaacagaaaaatttgactataaacataagttgaagaatgcataaataaaaaataacttgaaaataaaacacagctcagaatcataataaatactccaagtcaaagaacatacctactttatgagaacctacatgcatactatctaagtaacatgcagaagcatatgtattagagtatgtgactgtataactgtgtaaacacttttgtaatatgattgtaagggctaacagcaccctctgtgttaggctgttagttcctgttatggttagttcagaggttcagaggtctatatatacctcttttgtaactaactctaactaactgctgataaaaaaaaaaaaaaactctaactaactttttcagtctgaaataatatcagttttctctcttcttcctcccactttatcaaagaatatgaaaggaaagacacttattacccctaaaaagaaatgttgctagttaccaaaagcaaaaggtcagtatataaattaccagaaaaaggacagttgtgtctttcaagttttggatgagcagtctacttggaagatagaaaacgaaattcatagggtggccttttctgttttggttgtacaaacaaacagtcgtgtgttttagaagagtgagagataacagatgagagaaaataggagagaactgaactgagatattatttctgttatggaaaatttagttaggattagttacaagtgaggtatatataagcctctgatcagaaactaactaactacatgacagaaaataactaactacctaatacaaagaggtgctgttagcaaaggctaacagaccttaacaaagagaggtgctgtaaaagctaacagcacttacaaagcataatacaaaactgtttttaaggtttaaatacatattctaatatcccccctgaaactcaaggggaagagttttcaggggaaacactcttcacatcgagtttgctcctaagaaactcaaatcttgctgaggacagaggtttggtcagcacatcaacccactgatccagtgctggaatgtgtacaactgaaagctgtttggccagaattttttctctgacaaagaagacatcaatctccatatcctttgtacgactatggaaaaaaggattatgagcaatagacacggcactttgattatcacagaacagaagagtagttgtgaaggagacttgtaattcaaactctaaattcaacaatttggtttaatatgaagcaaaatcaaattagaaacatcttaacaattgctaacaatcattagtgaattgaactatacctttagacataataacatttcagtcttcatgtagtgagaatcttatgatatatcgagacttggaatgatttttggaagcagtctgtcaggtggccttgaacatgactcaccatcactatttaggaatttgagttcattttcaagaacagagtaagcttctgaaaatgcctgcaacaacattataactaatgagaaacacttcaagaaagtcaaattcatcaaagcataattcttaaataaaaccaatttcaatattcaagaatcttattttactgcaatatttaggtgattcaaggatgacaccataaattgttaataatatagtatacaatgattttgatgaacttcaagaagtttaaactcagtgtcagtactcaaaatatcataaatgtaattatgtacccattagagttctactaacataagccgccttaattgcaattatcctatgctaaaggggtccaagctactagccacttgtgggtacaccgcagcttaatattttagagtcaattatactataagtgttggaaacccgccttaattgctgtcacccatagagcaccttagttgtggcatctttgggctgccttaattccagaattgagggttattagaatatgtaaattatataactgtgctaacagtttgtaataggattgttaagtgtaaagctgtaattgtaagggctggtagctattgccaacagcacccctctgtacagctgccagtttctgttagctgttacagttttctgttaggagttagttagttattgttattttcagttgtagttagttcaggggttataaataccctctttgtaacaatcttcaactaactttcacattctggaaataatattcagagttcatttcagttctctcttctccttttctcatttcatctaaaaagggtgtgtttagtcccacatgactagggatatggcttaaataaagctaataaagcttggataatcctcaccttacaaatcagttttctagggttgaattaggccctaagcctaaattctaacagtaagttaacaaagcttgccagacttccaacaaaatttgtccatcctctacaactttcaagaatcatgaacacatttcctcttagaaaatatcaaactgacacatgccacattgttattcaaagtacatttgtcatccacatgaatttcaggcgcattgttgcataaaaagttatagacaccttgatcagttaataaagacattagaagcagctttactgctaaaattacatgaaagattttcttttttattggtttgaattatagatagtttaacagcttgtggataatataaaccacaggtttctttttcctgtcatcatggatagcaaaggccaagtatgacaactgaaatatggaaaagatgttggtaatcaataccttaatacattgatgtattcggaagcaattccttcccacattatttgttggaaaaagaggatcatctatgtgaattggatcaatgctgcaaagaaggtaattatcattaagctggagaaaaaggaatgatatcgcactgtagatagaaagtttggtttctatattacctacaacctctttctctttttatataaagtccacttccctgaactgatattctcatttggcgaggatcaaacacattcctaaaagaaaaaccattgaattgaattctaacaaaaaaatatgattatacaagtcctctctagtagcaacaataaaatatgtaattatgactagttctctcacccaaaaaagtaaagaaaatccatcagaaggcttccataattctgccagaaaatgcaagcgaaatttatttagtagcagtaaaatatctgaaatatataaaaaaaaaaaaaaggatctgaggaagtaaaaactacagttctccataacccagcttgttttttttatactaaatcctcatttgattacaagaaaaacaaaataagagtaaactctagtttttcattctctttaaattgtggcattatacccttagtttaataaaattttagaaaataatagaaaatattattattagtccacgatggccatcaacagatacagacttgaataactagagtgatcaaagtttacttggttgattggccggccaagatggtgctcatgctgaagaaatcgtataattagtaagacctgaatacaaatacaaaatgcaaaaacaaaacaaatgtgagtttagcagatacggactaaaacaatgacaatgacaaagcagcgtcattaaatccagaaagaaaatttttcaggagcaacatagttgcaaaatcaaattgggtttaagaggaagacaataagatatgttaaagtgtgtttcctacacagcttccacctcaatttcaaaaagcaagtgaatctaaagcacatattcccaagaaactgagatcataaaaatcttttttttcttcactttttccgctgatcatcactaaactgctgaggacaagattatataaaacaattatcatgccagttgcacttgcagatagatctgaaaatctaataaaatcaaagattcttcaaatcttcatagcctatctgaaaagctacgtcaatttgtgttactacagtagaaaagggactaagaaaattcattgaggaatgaaaactgaatgaaaaaaggaagcaatcatgcataccaaacagtaggaacttaagccaccagagtaggattgatcaaggctccgatcagccaaaaactgttttagtaccaatgcaaggggtgtagcagcaggaaattgctctgtcaactccttaacctacaggaagcagtatcataactttgaattaccaagcaaaataaagagaaccacatgatacatttgacctcaagtacagtatcaaagctgaatatagaacaactcatacacttagggttgattttgttgacagcccattggatctcaacaatcccaaccaatggactcgttcagttctgctgctcttaataatcaacaaaaaaaactagttgcgttatgctgtgtctaatccaagttcttgtgatatgttaactaaaccatgggatcaagctgaattatttaaaaatattccagggaggaggtacaagaggaaaatataagatataaatcaaagcattgaataaatatggcatcaagcttctttgaagtacaatttttgttgcatttcttctcatcaatgttgttaaaataagtggaccatttcactggtaggcatctaattctgcattctacatatgtaacaaagcaatcctaacaacccaccctaagtttatgcttggggttaaaatatatttgtgaaaaaaataaaatttaataaaaaaatagaaggtatttgttcatacaaattagcatgtttggtacaacatcaaagaaatttttctaacttcctgagtgagatttggggaaaaaaatattttccaaaaaatagtctatcccaatcaaataaataaagaaatttcttcaagatttatgattagacaaataaagtaggttactctccttgaactagggcatacatgtgtgtgtgcacacgcatcacacacacaagcttgcatgtccttttgaccaaaagatggataggtatccaacagaaaaagaaaatattaataaccatggaaacaggaagagtttatgtaattgagggccctatagacattagaaaatcaccatttctgtagtctggagtccagtatgtgatggggacttaaagctgatgtccagtctaactgattttgatttcaaggcatcaaatttcatttgggagcctttgggcgaagccaaatcttctaactgaatggtatccgattgattgtcattaccatgttctccaggagtacaatgtggcttttcatttaatgactgtatcataggagctaacgaggtaataacatcctgaggtacttccaccacaagcattataataggaatctgatagaaaaaagatacagaatgatatcttatcagaaatcaagataagagtacacttattaagtagataataacaattaacagcttaagagagaggaggtattacagctgtattttccactgtcttcagagaatcatttttcacccaatcctgattggcaagatacctagcagcatgctggcaaataagcataatagcatcaattgtctgatatacagaaaatcttcttgttcttattattactattgataaaaaatatacaaactaggaagcagacatcattatatccaccaataattttgttacaaagaagaagagaaagaataaacaacaatgcaataagaaattctctttacatgttgatcaaataaaatatcattcaaacagaattcgaaagattaattaacaagatctgtaacacgcaagttgtgcaggaagattgagaggtaaagcaaaacatgttttaatgtctcaattttcaggaaagtcatgttcaattcaagcctatccaaaatataaaggtccacaccaccaactagcttccagttttttcaaataaaaaaaccagtttgtaaagtatgaaagagaaagaaacaagtcaatgaactggcagggcaagtgcagcttattttatatcatagtgcacttcatatattcatggcaagtgtcaactcaaattctaatacaaatcctattaatgtagatgtgcacacccaacaggcaacaggtagatggagagtcaaaagtagggccacatttattgccaatattacctgaagacatgtttctttaattccattacgaccttccagtattccagcttctttaataggttcctgaatattttattacagaagttaaagaaagagtgttaatccatcatagttatgacatggcaagtaccacaaacaggagaaaaaaggaaaaaatttaccaggtttctcactggagggagtccaaccacaaggtcaacatcacttgttggaagggacataccagttgcatttgaaccaaatatgtttgtacgagatctgggccacagaacctgcagaaatcgggtaactctcttgacagcccaattaatgtaaggcctcctggccatattttctgcagcaacctggagtccattataatagttataagtaacatgataaggtttcgggtgatgatatcaagaaatgtaaggtttctacagattcaatagaaattctatttggaaagatattaaacaaaggactggaatgctgataagaaacaatgatgaaaatataaggataaagatactaaaacaagctatgtaaagttcaaatgtggatcattcagggaaaaaattagaatggacaggatgttatccactagcttgcaaaggagtatgtgagaagtgtgcaagtatgtttttttagtataacaaataagccctgtacctgtttacagaaagagtcgatctcatcatggagaatgccatgcatcaaagataaagatgcactctgtgcagaacagctttgtaactcgggaggttgcaaggggaaggtgacatctggctgtataattcaaaacccaaaatgaacaccaacatatacacataaagtaagacttgataaggatctttcttacgtgttcctggtcacgtgctatctgtgacaatgcaatcaggcggtcctgcagcaaggcagcaggtaaaggctgaatcaaaggtcgcaccgcaagattattacttctccaaggccacacaacttcagcaccatccgttcttaaacacgcttcctcgaaattactcccatcatgataccagcctcgcattccccagtgccttgggctggaactaccagatctaacagtgggaaaacccctgtgtttcctggagtcactcacaggggaaggtgggggtggacgaggtgcacgtggtacacaaagcactacaggtgatggtggccgctttatacgaggctgctcccgcctggagggaggaacacagggacttttatgatcaaatctttcccttgacaagttaggaataattattggccgtagaataggatatggatgtgaatcgcctgcctttccttcaacttctccaggcaaattattacccaaagaaccagaagtatcttcatccactgctgcatctgtaactgaagaagaatgcaacatctttccaggtacttcattacctgacatcacataaccaatagtctgggtagcagttcctacaggatcgaaaggagaacaaaatgtagcagtagtgggtgatgttaaaccattcgtactatacgaagatgagaaagcaaccatatcatccaccgtcctattcatgtcagcatcacgcaaagcccatagactgtcatcagagctaagcgagggaggccgggagaaacctttccctggatagtcagaagggttccagtacattacgcctccaccaaaatattgattataatctataccagaaacagtatgaacctcatactcttcctcagatacacagtgattgtcaaattcatcagctagctccaatgtatttgtcagctcaggtaaatcccatacatccccagaatattttctttcatcatcaggagcagttgcatcaacctgcatgttgtgaacagccaatccttttgaaaaggtacattgcttcctagatataaaaccagagtcatagttatagtttggtgatggggtcatgccaccacgaaaaactgggggccagtcgaaactcataggaataggaagagacaggattgggttgcatccaccttcaataggaggatttcttgcctgctgtaatgtgggaacaaatgggtggcagaagtgattatgccaattgcgcccaacatccagatgtaatctatctgtggcaggagggagatgtgagttaaaagatggaaaatagatagaaggtaagccaggccactcatatggactgcactttgagaaagctgaatttctactttcaaatagacatctatcacgctccttcaacaacccaaattcttttgcattaacctctctaattggtttgtcaggaagactggtctttaaatcagctttggcagcacatggtgagttcaaaggacaggtatcttccttgctgaagaaactaccttccaacgcaggaacaggagttgtggcagcagtacaatctatgtcgcaagttaaagtatctaatccagaacataaaattttcctttcatctgacaataaacaacactgaggacctaaactattgccacttttagcaaggtcttcagtctttccttcaactttcctggtagaactgttctccctactaagcccactaagagaactacaaaggcttgagtttgaagcaagcatgtcattaccaattgaattgtcatttttgacattctgaatggtagaactattcaaaaacctatcagatatcgccacctcaccttcagaaataactgtggtagaggcagcatgcatacttgactttggagaatctccacctgcactgatgagaatatttttacttttatttttctcttttctacttcttgaagtggtccgtacttttattttgccaatatccaatccttgagtatgatcctgatgacaagtggctagttaaaaaccatttaaatctttaacaagaaatatgaattagattaaagaaaaaagatttgcaaccatttttacagttgatgatgggaactccatagaaatctccttccccatatgaacagcaggaagttcactggatcccactaaatcagtcttctttttattatccactttacaatcaacgtcctgtaatatcatatggaacaaatcagaattgcaattggtagcattaacgggataaaattatttcagccatctctttaaataaagattagtaccttcactggattttcgcgtgaaatatcatccacagatgtctttgagacaggattttgccttttattattgcgattccgtcccttctttttacggttagaaacactgggcttttccttaggtttacctgatgaagacttgtcatgttcctctcctaatagttcaagttttgtgcagtcaagtgaaataaccatcagaaatcctcgcatttttcttaatatacaatcagatatcgtacagacagaacccaatgaactaaagaaaaggtttcctatgtcatattcactattaagacttgatgtaaccataatattaacatcgtgaagtactaataaagaattaaaggctctggctaaagcagcaggttttttacaaaaagtgactgatgaaataactgttccaaattccatatcagcaggaagaggggaaatgctacgttgagatggcacgggacgattgttttgcagtaatttatccactcccatactgtatagccaaatctcatcatcagaggaactacttgccacttccaaaacatcacgagtctgaaaacttatgaaaaataagtcagcctagtacctagagaaggccacaaaaatatattaacctagatcataacatgtaagaatatactaactgataacaaaccctgatattgaaaagtcataaaaacagaaagtataaaactgttcatcacatccaagatatgtattgcaaaggagctttaacatcttgatacttgatagcatggaagtaattagctggaataaaatgtggttggaccaattttcatccaatttgttacattatttagagattcatttataaatcttagaatattgtttaaaaaagagagagaaatgtgagtttttttggccttctaaatcattgtactcttctccttttacagatacttattacattaaattattcctacattttttactacagtcaatattgttttggataaaatacaaaatcctaattatcaaaagctatataaaataaaattccaaaagacaattctaagttttccctactatgaaacaagtccaattcaaaaatgaaggcataagtgattattatgtggacctcttctattcctccaatcccctttcctcctaacaagtcggcaatccctccccacccaaaaatgaaaaactatcttatatagcctcaaataactataaagttaagaatgtactttataacgaacatcatcattagcagtaaacacccccagtgcattcattaatgttcacacatcaattaagcttaaaacgaaagaaaaaggaagtagctctgtgatcccaaaagccaaaaccatgggtgcacatatcaaagttcactaaaaatgagttttacattgaatctcctctttgacattccaaaattttccttttaaggaatgaaacaatcttgtagaaccataattattttctgatataattgtcaaagaatgaatggttgcatattactttgaatgatttgtcacttttttagattttactcatagtatacagtggaaaaaaaaattgcactccctcaccactttcccaaacttgttcaggtagccaaatttgggcaaatataacaatatagttggtccaattaagtcaacagttataattgtaagcacgacacaccacaacaaaatgaatccatgttgaacaatcctaatggatttgctaatcattgccctaggggcaaagattacagaatttttcttcccataaattacaatatatgcattagtaacattcataacattaaatgttaccctcttcaataaaagcattccaattctttaatcactggctaacatcatcgatgttttccaactatcaacttttattaactatcccaccaattccacaacttaggtagtgtttagtccagtttgttacagcttttcttctccttacaaggaaaagtttggtgaggaaaattttaaaaattgaggagcttaatttttataaaagaaaaaaaaatagcttttaaaaataagttccatatcctaacttctctcttcctctcattctcaactaatcaattgtagaacattgaaatggagcttttaagctaaaactgtaaaacaacattttactttatgtttaaagttcttatttttaaacttctaagttttacacattccctagaaatcttccatgaactataatttttcccagaatagaaataaattaaccagttatcactaacaaagcaattcacacatcacgctaacagttccataggttcccaggaaagtgccaacaaaatggaaataagttaagcagatatcactaactattcacacatcatactaacagttcgataagttcccagaaaagtaccaaggtttttgcagctttcatgaggaaggtggaaaagaccttcctcctggtcccagcatccaaattcccccaccaatccacacaccccttcttcctccaaaacacattcaccccaacacccgcagcactcatcttctccttcaatttcacaccccttttcctccctccacagcaattcaaccacgccaacctcatcgaaacctcgatcctattcgcaataaacgcctcaattccatagtatcccttcgatttcagccaatgcaactccacccagtcctcgccgagctcggcctcctccccgcggaggaacccgccaccggagatccggtccatggcctccacgaaccagtccacgtccccaacgaagccctcggcaagggccagcgcgtcgagccgcctggccgagggcagcgaggacgtggcaatggcggcctcctcgccctcgcgcgactcgaacaggcgggaggactcaaagacggcccgcccggcggcgtccgaatcagcgacgcgggcaaggaggccgcgggacttcttgaagcagagtgtggggaggttgtcgtgcgagggcaggtcggggaggaggatgaaggagccgtggccgttagatcggagcttcgcgagcatctggagaaggatctgaacgaaattcgcatccacgattgttaaatgagcctggcggtggtgaatggagagagaagaaaaccatttcaaaatggaggatcgagggttagggttagggttggggttagggtttggggattgggaatggtagagtgagatgtgcgaggtgagggtgtcgatgagttggtggtgagccatgggaacgagtttagggattgtttggtttttggtttttggtttttgttttcgttttccgtgttttgcttcagcaggttgcaggtataatcatggtgtgagggaaaagagaatggctaaagggaggaatctacgctggatatttttatttttatttttgggttgtttttatgtgtttgtttgtttggccgtgtttggatagaacggtaaagggaaaggagaaagtgaaactgaaacgaggaatatatgaccttaatgagaccatcttccttgttttccgttcttctgtcggcactgttcttatttatacacgttattttttcttacaataacttttgtttttgtctttctaacccgtgttataggtgatttttttttaaagaaattaaaaaaatatatttattataaaataatagcaaaacataaaaatttatagacaatataattttatatattcaaataaaaatatttatttgtttacttctttaatcaatactaagaatatagattattatttgtcttctttttttaagatttttttaatatttttaggttaaaatatgttgataatttttaataaatattcgaattattgaatttgatgttgcttcttgatataaaaaattatttattattagtctctcttaaaaatatttataataaataaaaattatcaaataacaaatataaaatttactattttattttggactaaagtataaaaattaaaaataaaattattattttattaaaattaattaaaattattaaaaaataaacaaaatttaaatattcattagaattaaaaatatattttaaaaggtttttttataccacaaatttaacgttatgctctcttttgtttttttactaatttaacgttactgacagttgtttatagtctatagactactaatgtgtttggttgcgaattaaagcaaatattttaaaaatcagtcacatgtctaagcattaaaaaataaataattgaacagtagtaggtttttattaattaattgaacaacagttgaattggtgttaataaaacaataatgaaaatattttttaatcatcgtaattaattaagatatttagtttctcattgaaattttaaggtattttatataagttttggttggacttttataagtgcaatcctttggatcgagagaaaggatccagagagataaattacataagacatctcattcctttttaagcatgtattttatatgataataaacaaattactatctttttaataagcttaataaatttaatatgtgttgtcaattaaattatatttattaataaatagattttaaataacacataaaataatattaaaaatttaataacataaataaatttataatactaaaataatgtttttcgatcaaaattatataagaagatcgagaatctaggaataaataaatttataatactaaaataatgtttttccaccaaaattatataagaagagaatctaggaatactcgatcaagattcaaacgtgtaaccatacatgttttaatatatttttaatatttagtattatatagttactatattaatattatatcattaaaaaattatatgtacataaagccaatccttatgtttacttatgcattaaaaaaatttcacaagtcaaatttagcttccaacgccctataatagaaattcaacatccaacgtattgtgttttgtttggttcaaaagataaagaaaattttcacttaaatttatatttatactaagttttctttcatccaatagaaaggtgtatacatatgctctaatcaatgatgactcaaaagtttcatttgtcctatgttcttgacatcttttgaaattgtctaattattttgaatttcaagtatctattataaggtagattgagcacatccctaaagaatatgttttattgcgagttattttcgtaaaagtaatagaaattaacaaagtaaatgttgttcacaaattaaggaatgtacctttgtgtttctctctcttcaccaaaagcatatacgtcaaaagtagcatgtgttgtatctcctaataggaaaaatatcaacgagcactcattttcaaaatggtcaccttttcaatgaaacctatataccaagattattaaagctttgaagaataacaaatcaactaagtttcaatccaagctattggacaatactctacaacaaaaaactcaatcatttgcttaattggcaaagctatttgttttatgttataaatgtttatcttcattttgtaagttgatttctttgtaaatctttcaaatattattgttttcagaaagttgaaaatgactttgtgacaatgagtacttatttgagtcaatagtctttgggagagagattattgttatgtaaaaaatggtctaaaaaatacttgttataagtcaaaagtgattggagaataagacttatttgtattcaattattgattagtggaatccttcttaggttcaaggagaactagacataaacttaggaattaatataaaaataattattcttgtcatgatacttttatctttttctcgtgttttaatctttgcatgagtcatttgcgaacttggtttgtaacttatatatatttgtaaaaagatttcaaagaaatttctaagttacacatacacattactaaacctcccttctagtatgtttcacttattgcacgggacaacgctgaacttactaagtaaacacactccatgatttcatctctccaacaattatattagtataataaaaataaaacctaacattgcttgggattcattgagttgggagtcgatgactaagatgggggagtcagagaagtcccctaccgtgaaaaacatatttgtagacattagatgtattaatttttaaaatgagtgacaaatatttatgtaggtaacatattataaaagttaacttatatacactttaaaaaaataatcaattccacgtggaggagaaaggtccacaactatgagttcctctaattattataaaaattgatatatcatctaatgtctataaatattttcccatggtagtgttgggacttctctagttcccctacacttgccagcgtctgagttgggattcatttcatttttaccctagctaattgcccattgactctttctagtctctttagtcggaacacaacccaactcaagtgctgcttttgcttctctcttgtctcatctgtaataccttgctagttattttttttatataaatatgaataattgttgtgaaaatatatttaaataattaaataaatagtaatttgagaatatcagtataatatcaaaagtgggttttcataattttatttatatatattgtacagagcattgttgtaggagaaatgatattgcattggctccgaaaattagagactgaattatcctctaagagaattaaagctggcataattgtctctgatttgcaattaaaaaattaacaattaatatttagtctttttccggacttaccctttcgtatatagctacataaacataatcacgtcactgcgtgtcacacatcacaacaacatgcataccaattgaaacaaaatctccactcaacatcaacatcaacatcaacagcacctttaacccaaattaattggggtcggtggtagatgaacccaatgataaatcgaaaataaagcaaaagagagaaacagttaaaataaaagaatggtgagaggagaagagaaaagaagaagaaaagaattaaaacagggaacaactggagcatagaactactaaagggtttaaccctccatcagacttataacttttctccactccgtcctaagacatactgtccgccaatctaaatcccactccattaggtcttgtttaactacctttccccaggtaagttttggtcgacctctacctctctttgtatctagctcttggtaacatactcttgttctaacagaagcatctaatggttgtctcataacatgcccaaaccatctcaatctatgctctctcatcttttcacatactggtaccactgatacctttcgtcgaatatcctcatttcttatcttatccatcttcgtgtatccgcacatccaccttaacatcctcatttctgctacctctattttatgctcatgttgcctatgtgctggccagcattccgctccataaagcattgccggtctaacaactgttctatagaatttttcttttagtttaataggaatcttgcggtcacacaaaagccccgatgcactccgccatttcatccaccctgctttaattctatggcttacatcctcatcgatctccccacctttttgcaacattaatcccaaatatctaaaaacgtctttcttgggtacctcttgcccaagcagatgcactgtgttttgctcaccttctttaatcctcgaaaactcacacttcatatactccgtcttgctcctacttaccttgaatcctttagactccaaagtgcttctccacaattccaattttctattaacgccatctttggtctcatcaataagtactacatcatctgcaaagagcatgcaccacggcacttcttcttgaatatatttcgttagttcatccatcactaaggcaaagagataaggactaagagctgaaccttggtggacaccgaccgtgatagggaaataccttgatgttccattacaagctttcacacatgtgatagccccatcatacatatctttgattgcattaatatactttaatgctacctttttcttctaaagagtccaccataagactttccgtgggactctatcatatgctttctcgagatctatgaacaccatatgtaagtcttttttcctttctctatacctttccgtcaattgtctcatcaggaaaatagcttccatggtacatcttcctggcataaatccaaattgatttactgaaatcttggtctccctccttagacgatgttcgataactctctcccacaacttcatagtatggctcataagtttgatgcctctatagtttgaacaattttgaatatctcccttgtttttgtaaataggcacaagcatacttttcctccaagcatcaggcatcttgtttgtttgaagaatcctattaaaaagattggttaaccattttattgccacatctcccaatcccctccatacttcaatagggacatcatcaggtcctaacgctttattattcttcatcctctttaaagcctctttaacctcatatgtattaattctgcgcacaaatcttctattcagatcatcagaaacgtcctccaattccacctcactcttgtcaccatttccattaaaaagattgttaaagtagtgtaaccatctttcacttacatcttcatcccttaccaaaagtttttgattttcatccttgatacatctaacttgggtgagatctttactcttcttatctctcatctttgcaagtttataaatacctttttccccatctttgctcccaagatttttatacaaatcatcaaaaacttttcctctagcttctcgcactgctttctttgcatcttttctcgctactctaaatttttgcaaattctcctcatttggacatttatgcaaagatctaaagcattccttcttctgtttaatagccttttgcacctctccattccaccaccatgtttcctttgtaaaaactttgtttcctttgctttcacctaacaccctccttcccacattatgaacacatacaaccatcttattccaaatttcattagtttctccgataaactcccacggtccttcacgcaacatattttccataaattctaattgtttctcctcctttaacttccaccatcttatccttggattttgatccttcttcctcaaattaagaactttgttgaacctaacatctagaactaccaacttatgttgtgtcgccacacattctccaggatagaccttacagtcaatacatgaatttctatcttcccgtctagccataaagaaatcaatttgactgcgattttggccactatgatacgtgataagatgagactcccttttccgaaaaaaagtgttcgctagcatcaaatcataggctattgcaatgttcaagacatcttctctagtctcatttctcgtcccatacccaaaaccaccatgaattctatcaaaacctccattgtttttaccaacatgcccatttagatcgcctcctaggaaaatcttctcttctcgtggtatccctcttagaacctcttccaagtcttcccaaaaatgggtcttttcatctgataataatcccacttgaggtgcatacacactgatgatatttacgataagatccccgactacaagcttaaccatcataatcctatcgcctttcctttttacatcaacgactttatctctgaaacttctatcgatcataattccaactccattgcggctcttgatattacctgtgtaccacaacttaaaacctgtgtcctccacttccttggccttttctccaacccacttagtttcttgcaagcaagcaacattcactttccttctgacaaaaacatctgataactccctcagtttacccgttaatgttcctatgttccagcttcccaatttcattctaaacccctgggctgtgtttgcccgccacgctcgcccatctgcgtgttgggacccttgcccttttgtcaccaaattcgggtggagacctggcgccttgcctttcggcatggaccctagcatctttttcactacatcccggggtcgatgtagcaccttgccttgtggcgaggaccctagctcttttttcgatacatccggggtccgatgtaacgcgtcgctatgaagggaacgccccaacgaaatatcataaaggttcatcacataagaatagctaactttttatggccggttcgcaactcctgacgccaaccctcctcctttatcctggcttgggacaggccatgcatgcatacacacataggcggagttaaacaaaatctccactatttgaaaaaattctccattgtatgctttggctttcggcttctgaatcacctttcagcaatcaaaggaaggatcgtaatgaaagtttgggacatcgtagaagaagttgttggattctctgcaaagctgagtgaaggtgttgaagaaatttcaaaaggaggcgttatcagtgacaacgtgaaccaaacccaatgcatcctccattcattccatacacaactcatgttggaatgacattagccatgggtctaggttacacaagaacccaaatcaattaggccttttacgtttcttgtgatttggacaagttgtgaatagcttgaagcaattggattctatgctgaattgtttattatgatgaattgagttttccctcttatatatgtgtttttaatgattgggaacgttgtgacctatgatgcaattgtgtggatttttaactataatgtattgttttcgccttaaattggttttattagtgttaggattgtcttttgaacctttaaggtatgtttttgtgtgtttggaatgctttgggaagccctaggttatgcagaaaacttgttatgaagttctatttgttgtaaatttgcctagtgatctcaatatccaatgactttgtgtccatgtttaatgatgctaccaccagtgactctaatcacccaatgactattttagaatcaaacatccaattaatgcttctattgttcaaagtattaatgctttcagttgttgaaattgtccacccaatgactattttagaatcaaacatccaattaatgcttctattgttcaaaatattaatgctttcagttgttgaaattgtccaatagttattccaaagtgttcaatgacaatagtgtaacttacatgataaataattgagtcaaattagcgaatttttttttgggtctgtaataaataattatttaatataaaaagtttgagaatgcaatttaagttttagaataaatagtgacaagttttaaaataatttagcaatttttgtcttgtgttatttttaattgattttgacagtttttaaattgccaaaaaatgtaatttaagttttaaaataaatagtgacaatttttgagccaccataaatctcatttttaaatttgtaactaacatgttattactttaagtgatgataatgatttaaaatattttttttaatatatcaacaattcaatgctaattttatttattagaaaaccaaaataaaatttgttaatttatcatgaatctaaatgatatttaaaccacctcttaaatagcataatttatcaccaagtcaagtcaacgtaactttctctttctttcaccaaatcaccattaagatacaacacaaaaataatgtattttattagtgtctttatgtgtaatataatttaaatttgttttttaacaaataaatcaaatgaaaatgttcacacctttaaaaaataatctgatatcaaactattttttaaaagtatggacatcctcatttcccgatacatattgtttatattgctctctctattaatgcatagatttattcttctctgttttcttatacatttctcacaccaataatagagtgtgttaaaaaagttttttattagcacttaatattttaataatcaaatacatgtacattgcaacttacaaatatagtagatttatctaatgccgcgtgcatgcatactcactatttcattgagtgtgaagttttaactcacctcatctgcaaactggccaaagccaggatgctacttataatagtttaatacttatttttttttatatatacagaaatgccacagttcaatactgaattgcataaaatgtagtaattttttcgatccaattttatgctttatgctttatttaacataaaatattttaaagggttgagatacatgcacaatcaataaaaagggttgagatttgtgcacttaaaaagtttagttaaacgtaggagatcaagatcccctaccaaagtgtccacttgaactgtaaccaacaaaaacgttaatgtcactattcaaaatcacgcgtatgatgtacataatgtctctatccaaggagtgggagtgctttaagtttgtatttctctcttgttttttttttcttatcttatgtcttttcttcacctaccaacttaaatattacgtatatgacgcacaaaaaatcatgggcacaattatctaaatttgtttattggacataatgcacaccattcctccaatatcgccgtttgacttctctctcttaactatttcaaaaataaatatctccaaataagcatctctacctagctcaatcttccattgattcccttaccctattcccatctaatcattagtttcatttcacaattcccatctcatggccatctcaaacaacaatcatcatgctcttctccttgtttcaccaggaattggtcacataatccctgccctagaacttgccaagcgtttagtcactcacaaaatcatttccaaactcaccttcttttatggttcaatcaaaacctctactccatcaaaagctgagacacaaattctccaatcagccataaaggaaaacctttttgatctaattcaactcccccctgttgatctcaacatccatgttagtcctcatgacaccctagaaaccaaaatagcaatcataatgcatgaaatcccactactttttatgtccacaatatccaccatgaacctcaacccaaccatgatcatcactgacttcttcttcagccaagttatacctctagccaaaaacctaaacctacccatatttgcttttgcaccaacaaatgcatggctcgttgcagttggtcttcacacccccactttggataaagaaatagaaggagaatatagcaatgaaagcaaaccgatctcaatcccaggttgcaaatccgttcacccccttgatttgtttgctatgttgcgtgacaggacacaaaggatctaccatgaatttgttggcacgtgtgaaggggcagcacttgctgatgggatctttgtgaacacgtttcatgagttggagcctaagacacttgaagcacttggcagtggacagattattaccaaggtgcccgtgtacccggttggccctatagtaagggatcaaagaagccctaatggtagcaatgagggaaaaataagtgatgtttttgagtggctggacaaacaagaagaagagtctgtggtgtatgtgtcacttgggagtggatacaaaatgacatttgtggaaattcaagagatggctttggggttggagctaagtggaaaaaaatttgtttggtctgtgcgcccacctgtcgccaaagctggctgtgacaactacctcacagcaggtgagttggcacagtgtcacattttcttcttcttttttttttttttatattataattaaggcagaaccacctaattatgcctatgttttttcaaacttgttagttgagtctcaaactctcaatatatatattaatatggtttatattatcatttaattatatgttatgcatctagatggcaaaataaatttaacttcttggtcatctagtttacttaatatatatatatatatatatatggacacacacggtaattcatatattattctattgtagaattaattagtttccttttttccttagattttgtttgggagagagattttagagaaaaagggagggaagaaaaaggtttaggtgatgacatctctttgtttaggagttttaatttttgagaaaaaagatttgaggatttttaaaactcctctaaaatcctccaaaccattaaaatcgttgttccacaatttgaggatttttagaaggaaaagtaataaaattactatcatatcccagctacaaattcaaaattacgttttatttgtaaaatatagagtgtattaattttagaagtaagaacaaaattgtaaaagtatcttattaactctccatttacctctcttttaatatatttttaactcttaaattaggaggaagaaatttctctcattttccttcctttccttcccctctctttcccttgaatttctttcctttccttcccctcctaactcccaaacaaaacctgaatgatatagaattgttgttttagagtgccatcgtggtaatttttatattgtgcttgagttttcatcatataattgtcaatttatatgttgaattgtaggttcacctcttggatatgtttaagttaggtttcttttgatatagatatagccctattagaaggtaaattttttgaaacgtgaaagaattagaattgttaaaataatcctatatgacaatttttaaattattatcaatgcaggtgaggaaggagatactggaattacccttgggtctaataatgaaccatcaaactcttttcctgatgcgttttaccgcatacaaaccaatggaattgtgatcacagattgggcaccacaattggatattttgaagcacccatctattggtggttttgtgtctcattgtggttggaactcaataatagagagtgtttcatgtggggtgccaataattggattgcctcgttttgcagagcaaatgatgaatgctacgatgctaatggaggaagttggcaatgcaattcgagtaaaggtgtcaccatctaccaacatggttggaagggaggagttatcgaaagcaataaggaagataatggataaggatgacaaagaagggtgtgtaatgagggaaagggctaaagagcttaagcacatagcagaaagagcttggtcacaggatggttcttcttattttgcactttcaaaaatcagtcaatcaaatggcaaatgataactcatttgggatagtcaaatacattctttggtaaaagaatagtaaaatatcattttggttttgaaagtgcaaggtcttatagattatttcctaaaaataaggtgattcaaaataagtagtgtctaaagtgttagataagtctcgaaatttaactaattattattactttagtccttaaatgtattttaatgttatcatttaagttaggtgactttttgaattttggattaaggtcattggcatatttaatttctctatcaagtttttttttctctttaaattttcttacacagtaatgtagtgttttgaacatttttaagcacctgaatggtattttatctgtaaaagcatttctattttagaataaacaagtaatatcattttgtttgagcttttataatttaaatgactaaggaagaaatttatgtagcttaattgatgttgctaataaaattccttccaaagagggacaatttcttttgtcaatattgcatgaaactattgaaactttaaaagaatttaacacaacttgtcttcatctgtagactgattgaatgaataacgcttattatcattttttttattttgtgaaagaaaggggcaaagcactccaaactcaataacctctataaaagttacattaaaagcatcaaccgacaaaaatcaccaggaggaaattctagtatacaatcctcaacatcttctaaatccaatttattcaaggtatctgtaattaacttgatttccttctctacgaatatgatgaaataacgcttaaacaaaaaacaaattaaattcgtagaatgaatgacctattatgcagcatatatataccaacatcccaacaacaaaaaaaaaaagaaacatattgacacaagaataattcgaatcacaatcacaattcgaaactcagataaaagcttaaaagactcacgctataatgattctctcaattacttacgtgcacaactaagattatatttggaatttcacaaaattaatcgaaaattagctgaaagttaaataactatctaattagtagctactaataactcgttgctgaaatatatcaaattaatttgttaaattataagtgcttgataaattatttgttgaaatgattgatttataaattcgggccatgagaacggtaccaaatcgagataaattctgaatattagatatgacctcaaaataaaaaaggtcaaggttggccaggatgaggaccgtaccctcctcattgggaggaattccaggttttggatataataattggcagagtttctcacaccaatgttggaaaaggtatgtatgtatacaggaaaaattacacaaatatgcaatggtaaataaaatcttttccacttaagtgaacctgtgagaagtgtaatatacggcaatccaaaaatccaagagtgcagaaaaataaagagataacaacaagaagaacaccaacaattttaacgtgaaaaacccccaatgtgagggacaaaaaaccacgggaccaagtccagaaaattcttcactatgtaaaatatcaaagagtacagcaaataatttctacaacagaacctcacaaataaatgcctactcactcttaaaatagtggaaatcaacaatgcaacaatattcaaatagagacccacaacaggataaaaatatcttctgccaaaatatgagagaaataaaattctgagtataccagatgaaagcccacaattttaggaacaattggctgaaatttcatccaaaacagaggacaaatgagtattcaaccaatatcgcaaagtgagcaaaactttttctttttctctccagcggcgcagaagaaaggtgaaaaacaaaaacaagcagcgatgcttcatgtagctccttttctcttatcttttttttttaataataaaagttgttgggctcacttgaggaggcccaccaacaaactccccctacgactcaagtggaggcaaatgtcaaaccggcaataaatcgaaaagcttcaaacttccactttggtagtgtctttgtcatcatatcagaactattatcatctgtatgaatcttttcaagttccagtaacttagaatttaaaatatcacatatccaatgatatcgcacatcaatatgtttagatctaccatggaatgtaggattcttgccaaggtgaatagcaccttgactatcacaaaataaaatatacctctgctgcttaaaactaagttcctgcacaaactttttcatccaaagcaactctttacatgcttcagtaatagcaatgaactcagtctcagttgtagacaatgcaacacatttttgcaacttagactgccaagccacagctccccctgcaaaggtaatcaaataaccagaagtagattttctagaatcaacatcctctgccaagtcagaatcagtgtaaccacaaagaataggctccccaattccaaaacacagtttcaaattagaagtaccacagagatatctcaacatccacttcacagctttccaatgctcaataccaggattggaaagaaaatgactaacaacaccaactgcatgggctatatcaggcctagtgcaaaccattgcatacatcaaacttcttactgcaaatcatagggaatagattgcatgtcttttttttctttatcactagaaggagcttgtctagtgctaagcctaaagtgtgaagctagagctgtacttaccacttaagctttatccatatgaaaacgttgaagtactttctcaatgtacttctcttgtgacaaccacaacttcttggcttctcgatcacgagtaatatgcatgccaagaatctgtcttgttggtcctaagtctttcattgcaaaagacttgctaagctcctttttcaacctgttaattctagacaaattatgaccaacaatcaacatgtcatcaacatataacaataaaatgataaaatcactatcagagaatttctgcacaaaaacgcaatgatctgaagtagtcttcttgaatctttgttggatcatgacagactcaaacttttgtaccactgcctcggggcttgtttcaacccatacaaactttttttcaacttgcagacataattctctttacctttcaccacaaagccttcaggttgctccatgtaaatttcttcttccaaatcaccatgaagaaaagcagttttcacatccatctgctcaacctctaagtcaagactggctgttaaaccaaaaacaactcggatggaagacattttaacaacaggagagaagatttcatcaaaatcaatgccctttttctgacgatagcctttgacaactaatctcactttgtatcgtggaacaaaattgttttctccagtctttaatctataaatccaccgattttgcaaagctttcatgtccttaggcaacttgaccaactcaaaagtatgattatcatacaaagacttcatctcatcctccattgctgcaatccattctttcctgtactcattttccatagcctcttcatagcactcaggttctcccccgtcagtgaggagcacatattcattagatgaataacgagtagaacgcaaatgctgtctagaagaccttctaaaaggaacatcagacttaacaaaatttccagcatcatcattatcaacattctcaactggatcatctggaatatgagtaggggcatcatcatgattgtcaaaatctgctacatcaggcatatctgtatcaggaactggatcaaaatcaactaaaccattagtacttaaagactttgatttctctgccttcccaatgtcttcaatggtttgatcctccataaaaacgacatcgcggcttctaacaagcttctttccaaccggatcataaaatctatagccaaattcatcatgaccataaccaatgaagatacattcctttgtcttgacatctaacttggacctctcatcttttggcacatgcacaaatgctttacagccaaaaacacgaagatggtcataggaaacatccttcacataccacactctgttaggaacatcagcatgcgtaacaccccggacgtgttatcattaataatatcataaacgcgctatcagcgttatctgaacgcagtgcggaagcgatagaatcgtttttcttgattacattatgcatggaatacaaaacacacatcaaacatcaataacaagcccctgagatccagttaacacaacatagaaaaataggcagatacaaaaccaaacttaaaagaacaggaggaaacataactcatgtacatcacataatctgtacatacaactcataattctaccacatctgtgattatacaacataaatatgtacagacaacgggtgtgcattcacaccctctacttatacagaatacaagacagagatcaaaagaaaagagactcttctagtcttcatctgcagcccatgaccacttcagcaccctcagctagggcctcatgccctgtggtaacttctccatctagaagtacctgaaaaccacaaaccccacacagggtgagacaaacgtctcaataagctcagggtcctaggagatcctcccttaccctagttcaccaccaagcacaaacacttataacaaaacatatttgggcctaggacatcatcctggccgtcacacattccccagctctctgggtactaactggatgctctcagcatcagaggtctctcacctcatactggctctcaagccttaccagacttgtctcacagagtcgagccgtaaccatggcatctccacatatactggctcttacagccatctcatagagatctcaccgaggtacctaatctaagtgtcaaccactggacacttctcataccagggaggcaccgcctcctgaaccatataaaccatgcatgaggactctcactcaggactttactcattcagatatgactcatctaagaggctttaggctctcatccccttgagaagccgtctcttagagatataacatatctgtctgttgcctggtctcaccaggactttcataaaacatgcctgggcaagaacatccataaataggcaatcacctccaggactttccacaacacgtgcctgaggagtcaatccacacaaggagcaccatccatcaggacttccatctcaactgcctggggagtcatccacaacgggagcaccgtcccacaggactaacaatcacatgcctaagagagatcatctcacaccggagacactcaatctcttaggacttccacagcactggcctgggaaaaccttccaggacttaatcacataattggcatgggaaaaccctccaggactttcaatatctctgcctaaggaggaacatccatgtagggcaatccatccttaggactttagtggagagcagtggcacctcccatggaatctcagttatcccagggagtcctcaaactcttcctctggctaggaaacctcatctagcccgatactagtccagtatcctataggttccagcaatgaccatctcctggtcttcatctcaatcatagaacactctcacagtgttcctcaatccaaaaggcccaaggcctcacacctgaagccacaggtgtccaaataccctcacaccatctcggtgtctagcctagggttcatcaaccttcatatatctagaatggtctgagtatcactccaagcaccgtccatctagcccctcaggctcacaaacacgtaattatcaaaactggccacactggcctttcattccatagcatgctgttgtgcgatttatgcgaataaatatacggcaagtgcaccgatcgttaacaagtaataaagtaggtaagtgagttatcgtctccacagggattggaatgagtttgcagtaattaaaacaattgtgattgaaacagaaaacagaaaattacgcagaagttgttgaatgattgtgttgattgaaagcgaaaattaaacaaaacagtaaatttaaacttaaaagattaccaatgagaattaattgcggtcagacacaatcccttatgagtattacctccttcaattgactgattattttaacttgaagtttacataagatagatctctcctatagttgtaaatactagataactagcaatctcaccctttaatttgatcgagaaccctaaccttctagcgattctgtcaaactaagaattcagagaacaaatcttatgggtttgtgttatgattactcgaagaataagtctttcctatattagttaacccctaatttcttagtgaatcaactctttaaactgaaattgtaacctaatgtcttagtgaaactaatcagtttaagcaatcaaagaacatattataactccgcacccatgcatccctatgtttaggcgaagaacaagtgttattcttaacaagtcagatgttataatcccaacgtgtccattgtgaattataactcccaatactcatttaaagtgatcaattctaaatgagataaagtataagcacataaaagaattaaagtaaacaaaacatatgcatttaataccagtcaatttacagagagaaactcataagatcatggcctttccacaatgaaatgattagctagccataggattcaagaacaccaaagcataagatgatttcatggttgtgcagaactttggcctcaaaatcttgagtcctagggtttgtaaatgactaaaaaagctctatatttttctttctctctgtcccagtatattctttttattcagaaacctcctatataaatagagtaatttaattacagtaactgaatcaaaccctttttcctaatttcgaaatatatatcttttaatacaggaaagaaaatcgcatccacgcgacccgcgcgcgattccacgctagtcgcgtggattggccgagaagatggcgcttgtcacgtgaattatggcgctttccgcgtggattggcagaagagaaatccttattccttaaggttgtggcgcgacacgcgtggctacagcgctcatcgcgtgatgtggcagagaagaaagtccttaatctttgaggttccggcgcgacatgcgtggagtttgacgcttcctacgtggtatcctcgggtcttccacgcgacccgcgcgagtaatggcgcgacacgcgtaacactccaggacttgcttcctttattatttgctctttaagtccctctttttggcctgcaaatgcttgaatgacattaaaattgcttgagacaattaaaaatactaaagataactaatttttgaactatttcctaactatttatttaaaatataacctaaaactaagctagaaataagatgtgtttgcaacacatcacatgcacattatatatataaacaaacatggcatgcagtcatcacccacttgggtggcaagcaagagaaagggctaatccccagaacgatgagcttacctggcaagtcgtgcctgcactttcagcctctgcaacgatggtctgctcctctgatacctcgtgtcaaaccctaacaaggcaaccaaacacatatcacagaccattcagacacataaacaatcattagctcatcagacagtcctcaactgtctctaagaaaggaacctcagtcctttctatcaacccaggtcctcgacctaaggtttctcaggctcatcctcagcaagcctatctatagacccttactagtctatctcagatcaaccatggcctcagagtccctctagactcaatccaagccatcaacaatgagctcaaagctcgcacaacccaaaacctcagggtttccatagggctcggacagtttatctcactcaaattcaagcttctctttatcactagttccagctcacaaacctcatctatactatctaatgagcaactttgtcaactactctaaggttcatactagtcaaatagtcaaccttttacctctgctcatacatactcagagccaaaatcaaacttcatcaataatgataattcaaggctctaacttcatcagagtaaccctctgaacacaaaactctacagagtccaagcctaataacgactctaacacctccaaaaacacctctcaagatactcaaaatacacccaaagacccaaacacagaaccaacggctaagactcgagtttcttacctctgtgcagctaagacacaccagggaatcactttccctaaggtagatcgctcaaacaaagcctccttcgcctccggttcttcgattccaagggctcccttaggaatctcgatctcgccgtttaccacctcttgtcgagaataaagctgggtcactagcttatcttgaggctctgaacactttctcagttgggtcagaggtgtttagatgagagatggagaagatatgaagcttctctgggcaacaatgattgttctctctcttcctctcttttccttctttttctctctctcttcctttctttctctcagcccaaatgggctatatataaagctagaacgcaggtcccgcacggttcgtgccacgtcccgcgccagaagtcagggtcttacagcatgaaaagcaacaacaagagacaagttaataacatgtgcaacagtacataaagcctcaccccagaaagaagctggtaactttgcttcagaaagcaaacatctggctttctccatcaatgtcctattcatcctttctgctaagccattgagttgaggagtcttgggggccgtcttctagtgtcgaatacccatctgtctgcagtattcatcaaaaggtccacaaaactcgccaccattatcagtgcgaatacattttagtttcttcgctgtttctctctcaaccaaaacctgaaactgtttaaaaacaccaagcacttggtctttattcttcaagacataaacccaaagctttctagaaaggtcatttataaaagtaacaaaatacagcccaccactgaaagtcttagtcctcataggaccacaaagatctaaatgtaccaactcaagtacctctgatttccgagagggaggatggctcttaaaagaaactctattttgttttccagccaaacaatgagcacatttttctaaccttgcacattttaaacctgtaagaagattcttcttggccaaacaattcagccccttctcactaatgtgactcagtctcttatgccataaatctgacgaactatcacagtcaacaacatttatagcatcaactaaaacagaagctttcatccaatacaaacctgaaaacttcttacctcgcgccacaatcaaggaacccttagtgagcttccactgtccaccaccaaaggtattaaaataacaatcatcatctagaacacttgtagaaatcagatgcaaacggatgtctggtgcgtgcctgacattcttcaaaatcaactttgttcctatgctggtttccaaacaaacagtaccaatgccaatcacctttgacgtatcgctattacccatcttcaacacaccaaaatcacctggagtataagatgagaaaaaaatccttcctaaaagtcacatgaaaactggcaccactgtcaacaacccaactagaatcatcacaagcaacactgatcacgttctcatcataaacaatcaaaagatctcatgcactagcagtggcaacactatcaccattctcatcatttctcttttcttgcttgcctttgttatcgttcttcagcttataacaaaacttttgaagatgaccttttttaccacaataattgcacttgtaagttttctgctcagaccttgatttgctactgcgcttgcttttacctctgtgacctccttcttgatccctgtttatacttttccccctgttttcagtgaccaaaacctctacctgtgaagaggatgcctgctaagtacgtcgtctgacttcttcattcaaaatagaagtttttacaaaatccatggtcacaataccaccaggagcagaactagtcaaagtaacacgaagattttcccaagaatcaggtagagtattaagcaaccaatgtcccaaaatttcatgatcaaattttacacccatgccagacaattgatcaaagcaaccttgaaaatcactcaggtgatcagaaatagaagtaccttccttatacctcaaattcatagcctgtttcagcaaaacacaatttgttgttcccagttttagaagcatacaaggtttcaagtttgtcccacaaggttctggcatttgaatcattagcaatatgatttaaaacattatcatctacccattgacgaataaaaccacaaaccatctcatgctcaaaagtccattcttcatcagatttattatcaggtttctgagcagcaaatacaggtaaatgtaattttttcacaaatagtaaatatttcatcttacctctccacttgtggtaattagttccattctgtaataccttgatttttaaacatgtgattaagcctagattaagctatgattaagagttagaatccagcattataatccttaaatgaaagcttgagagaaagagttgaaaaacagattcgaacaattggtgcgacccgcgtggggtatggcgctaaccgcatggaaggattaaacaagggcaatccttgcggccttctagcgctattagcgtggatatggcgctattagcgtggctgattcgaacctgtggcgctaccagcgtgggatatggcccgatcagcgcgggaagcttggatcaggccaatccttgtggccatttcacgctatccgggtgggtatggcactaatggcgcgggttattcgaactatggcgcgatcagcgcggcacctggcgcgaaccgcgtgggactttcggttcagttttataaatagctcatttggacgaaaatgagagagaaaagagaggaagagagagaacggccattgatgacttgtggagcttcatatcttctccatctttcatctaaacacctctgatccaactgagaaagtgttcagagcctcgagataagctagtgacccagctttattctcgacaagaggcggtaaatggcgagatcgagatttctaagggagtccttggaatcgaagaatcagaggcgaagaaggctttgattgagcgagctaccttagggaaagtgattccctggtgtgtctggactacacagaggtaagaaactcgagccttagccattgattctgtgtttgagtttttggttggctttgaataccttgagaggtgtttttggaggtgttagagccgttattaggcttggactctgtagagttttatgttcagagggttattttgataaagttagagccttgagtaatcattattgatgaagtttaattttggctctgagtatgtatgagcagaggtaaaaggctagttatatggctagtatgaaccttagagcagttgacaaagttgctcatgagatagtatagatgttgtttgtcatctggaatgggtgataatgagaagtttggaattgatcagtataaacagggataaactttgatcagagtcttagaagaggctctggagccttgtgtaggctgagttggatctttttgagggtctgagaatcacttgtgaagtgattgttatgagttatgtggaaggaattgtggtttcctttcgatataacggcttagaaccgttactaataccttgtgttttggttctgtaggacgtgagcttgatagtgctagtggtggtgaccacgaggccgagagagccggtattttccctagagcaggtaagctcttagttcttgtttgtgtgtcctttgctgtgttccaccattatgctggtatggtgatggttttgtgtaatgttatacatgtatatgtgaaaattgtgtattgtgactgattgctgaatgttatgctgtaccttgtgaaagggaaatggatgtacattgatatgtgatgcttgttgtatgagctgcaccctgagattgggtgattgatatggatggctatggttgtttagcttatgatctgcatgattgatagttgcatcctattgtagtaggatagaggacatgtgatcgagtaagtcccgatatgagatgttcctgtgatatagacgtagcctcctgaatggagatgttcctatatctacagacgtagcctcctcgggcaattgtattgaaataggatggagatgttcctgcgatatagatgtagcctcctggggagatgttcctatatcagcagatgtagtatccttgcaaagagatgttcccgttatatagatgtagcctccaagtggagatgttcctatatatacggatgtagcctctgatagatgcattgtgatcctgctatgagatgtttcctagtatatagatgtagcctcctggttggagatgttcctatatacatagatgtagcctcagcgggatagtgttggatatgatgaatggctgtatgccatgagtttagcctgattgtagtcaggtagatgtgcattgaatgtgcatgagtattgatgagtgattcactgattgtggtcagatgaacacatattgatgatgactgatttaatgatgctctgatgtttatttggattgttttgatatactattttcatgtatatgtgtatgaaagtgaaccaggggaaggaaataccttcaagggccctgagtttactgggattttatatctcaccccttgtgtggggcatatgttttgcaggtgaatcttcaggaggagctgatagatcccaaggcaagaagcctactgtgcagggatagctgtacggagaaaccttaggcatagatgacttgagcatgtggctctgatattttgtattttgcctttggtttattttgttgtaccctgtggggatgtatttgtacagttttgtacctaaacacggattaaatgtatattcaccatcatatatgtacagtgtatgatagtgacctttgataatgtcactcttagtttatgcttccgaactgcttaaactctgatgattatatgtgtgtttgctgtttatgcttggtaatgaccctgatgattgaggggacgttacacattcaaactaatcattctaccgtaattaggctccatcattcaatcaagcaaatttcccagaaaagtaaaccagctctgatgccagctgttgggaaaggtacgtatgcacaacggaaaaattacacaaatatgcagtgataaataaaacctttcccgcttgagtgaacctgtgaaaagcgtaatatacggcaatccaaaaatccaagagtgcagaaaaataaagagataacagcaagaaaaacaccaacaattttaacgtggaaaacccctaatgtgagggacaaaaaatcacgggaccaagtccagaaaattctccactatgtaaatatcaaagagtacaacaaagagtttctacaacagaacctcacaaataaatgcttactcactcttaaaatagtagaaatcaacaatgcaacaatattcaaatagagatccacaacagggtaaaaaaatcttctgccaaaatatgagagaaataaaattctaaatataccagatgaaaacccataattttagaaacaattgactgaaatttcatctaaaacagagcacaaatgagtatccaaccaatatcgtaaagtgagcaaaactttttctttttttctccaacgacgcagaagaaaggtgaaaaacaaatacaagcagcgatacttcatgtagctccttttctgttatctttttttttttaataataaaagttgttgggctcactttaggaggcccaccaacaaccaatgacttcgtttttagcactttaactaattgttttcacctaaaaagtgttattttggtgcaggtaggacaagaggtttttctttttctttttttgaaaaagccttacaaggagttagaaatgcgctgcagagcctaaagcacaattgtgctaatcactaaacatggtcttgcttgacttcatgagatccaaccaatgagaaggaagtgcttagaagcacgacctcgcatgccttgaagcacgatcgggcatgccctggcgcagttgatgaagacccaacaggcctataaaaaagacatagcaacactattttttttttttaccttttgtttatttcgattttactttgtttgagtaagaccttctaagagggcaacgaattgagaatagttgaagaacacaattgatcaaaccttgtaaagattttcctccctttttattcattatgcttacttatgtgattgtatttccattgcctatggctagccatatcccctaagctaggattgtgacatatctatgaaccctaatccctctccattgcaatagaattatcctttattcattcattgtgttgttcgtttaaattgaaactgaggactccaaacctagctagttggtttactgtgagtgatctactgctcttaattagttgaactatacaacaattaaactcgtacgtatgaacaaacttgtgctggaatttctaatccgattaacaattgttaattaacttcttgtttgtaaaccttcttttaatttagaccctaaatgatcaacaaagaataaagtaaaagaagaggattactagaacgtggcctaattttgtttatcattttaagaggcaacattagtaattggaaggataattgtggtttaattgaaatagaaattaggaggaacataaggatatgtctaaaatcacaaccctaagtttctctatttgttaaaattctgatcaattctactagtttatgattaatttgcaacccaaactcaatttgataccttggcttatgttaaaaaaaataaaattgagaaccaccattagtctctaggatataatattggactttagatccattattactagtgcatgagatacacttgtccttaagcagtatttttagcatcattgacaaaagttaaatgacagaaaaagacaggtttatatggcattttaatattattttactgataaaaatatattttggggtatttatatataattcaagttgttaattagttttaaattcttgttattttttatttatatatcaattattttaattatattttttacttttaattaacttatttttttcatgttgtgtatgattaaaataaacaatgcaatataatattatgtaaacaataataatgaaaataaaataaaataatcttatcatctatttttatcaatatcttatgtaataacaagataaaaataagaaattcatatattatgtaaggaaatgtgacaaagatcaggaaagaacgatgacctaagaggaaggaatcctcaattggagaaaaaaacctaggaatggaagagctcatcaaggggacaatcccatggttgggctaggaatactgttaaaaatcagatactcataaattggaataataatttctctttcattcattcacttcattctcttctatattttccctcaatatgaggttcttatataagagagaaaaattcaacaaaatgctaataatactagataataacaaactgaacaaactataacaacctaacaaatcttaacaataatatgaaatttaaatatacaattcaacactccccctcaagttggtgcatgaatatcggtcatgtccaacttgccaattgcttcttcaaacacttccaggaatgactttgatcagcaataggttcaagaggtgcttcaggatagtccacgtgcttcagttatgaggtagaaagaaaattgaaatacgagaagagattccacgtgcttcggttatgtgaggtagaaagaaaattgaaatacgagaagagattcggaactgttcatgtcaataaacttcagggatggtctatgaagattcagaacaatgcaactgacttcacatcaatgaccttcaaatagaatacgtgcaggaagacttcaatactgaggtacgagaaggattcaaaatggatttatgttatgccgtttgtgttgttttggggaagaaattaagatacggtaaggattcaagtcgggaccaaagatgcaaaggttatgtgagacaaagattgagtttatgatgataataatcataatttgtagaggaatcggagaaggtgaaggttaaggaggaggtagatgattgggtatttcagaatcagaatcggccatcaaagaagggagttaggaatttgagagaaataaaagtggaatacgagaagataaaaagaaatgtacgtttgggaatgtgaagaagaatacatttggatatggaatggggaagaaaaaagactttagtggcagaagataattttgttcatggaggataacctgaccctcattcatgaaggaaatcatgactcttgttcatggaggaaactatggttctgataccatgttaaaaatcagatactcataaattggaataataatttctctttcattcattcacttcattctcttctatattttccctcaatatgaggttcttatataagagagagaaattcaacaaaatgctaataatactagataataacaaactgaacaaactataacaatctaacaaatcctaacaataatatgaaatttaaatatacaattcaacaaataccaataaggggatgagtaaagagaccaagcgagcatttagattgagatgatcatcgacacattataagatggtgtactaacataagcttgaaacctaattttaatttcattttatttaagtgtttttaaatcaaatttaattgcaataaaacagttggttaatttaatgctaattagaagcctggattttaatcctagaataggtttaactttaatttaagttataatttgggccttaagtttgcttggatcttctgcttatgtttcttaaaatcaggaccaacctccttgtgtgagtagctccttggaataaactaaatatatagagatgtaatcgcttttatttttagaggctgaataatgttgttttaatctcattgtgagtgtgagttgagcaatattgattcctctttttgttcttagatattaaaatcttcttgattcttatcaaaggtaattcaatacctttgtggaaaatccttggcctatcactctccatatattgtggtgctttctttctcatttcttgtatattctatcttttgcttttgctgtttatacttttcatccctttttccatctattccatcttttttattttacttattattttaattttcctgtcactttgttgcctggacaccgagccaaactcagttaaaccgtccaccgaccatcaagccatctgggtagacagcgtattggatggaattattatagttaaggatatggaacatgattttaagggcgtagatggaatccacatcagaggttgattggaaaacgaaccggaaaagagaaagatgataatgcatactcacgaagcttggcgtagaatgaatccacccgttactctctcatagtaatggttaagcattgaacaaattaagaagaaggggattggggtttctagacctcaatgtctctcttcttaacgcttttttttttttcttaaaattttttgattaaacaacaattaaattaaaaaaaaaatgatgtagaatgcattgtacaatataacttaaccacactcaatatgatgatctatttgttacattatcacttaacgaatattaatggtaaatactaaaatcgaaaaaaatatgttaaacacaaaaataagaaaatcactaatttaagtataaaaaaagaactaatttacagatataaaaaatatacttaaacctttatatattttatcatctcataattaagcacagatattgttagctcgtgatcattcagttcatatcttactggcaagcaaattatggttacaaatagctagctagtataggctagtagcttatgagaatgacagttcatagatttagaaaacagatatcagatatagacaactaattaactacaaatataaaatataaacaactagtcaactacaagtccaacaaatatgtgagatgtgggatttttttattaataaatttaaatcgaataaaaaataatctcatgagcaattagaaaataatatcatattaaaattttcactttttggcaatttgttgagttcagttttcacatgctattttcatgatatttattacgattttttgtttgaacataagttttcatgaacattgatgtaatgaaatttcatatcttgaattagaaaaaaaaatcgtgtcccaaattaacttaaaaacgattattattttggaatgagtaaaagtggctaaacataattaactgtggacctatggttaactttgtttaacaaagtggctaaaagtgttatgaaattatttattttaactatatatgtaaatatgattaattttttttacttgtaatgattaaatcaattatcgatatatgattaataatattaaaggttattaaaatgtttaaataagtgagttaatcatgttaatatgttattaaaatatctaatagaatttaaatacttgcaaaacaaaattaactatatttatacatgtaaataaccacacggactgtggacactagatgtaataattttttgaatgtacgaatgtcaatactcatcaaccgatccaaaccaatgtaaaccgcggtgaccgaaccgaaaaatcgaaaaccaaaataattgaaaatcaaaaaaccaaaaacaaaaaaaatcgaaaattttcaccggattggatcgatttttggattgaccggtgcaaaccgatccaattgtaaatcataccttactctttatctacttgagcctattccccatcatagcccaaaaaccaaaaatctaatacattgctccttattttgtccaatgaacttatttgtctaatgaaaattagaaaatgatgtttgtttttgtccaatgaatgtgtttgtttatgttagatactccttattttgataaaaataagtctcataagttttatttttaaactttttaaaaaaccaaaaaccgatccaatccaaaccaaaaaaaattggattgaattggatcagatttgtaaaaaatttcaaaccaaatggatgatcaaatgaccaaaccgaaggaattggatcgaatgattttttgtttcaaaaccgatccaatccagatcatgaacacccctaactaaaggctgttcacatgtatgtctatgatagaaaattacttatccgtataaccacctaataaaaattattgagtctttctaataataagtattcttaaaaaattgattaaataattaaaaaataaaatatttattgtaaagttcataaaaaattaaaaatgttatagataatataattttttatatattttttaattaaaaaaattattctttaaccaatactctaaaaacacatacagcttaacagttatcaaaattattaaattatttaccggatataatgctacttacttacccttccaagttccaatcattgactcaattattttctctcggacaatctcaacaataaatagctcaccaattaagcatctatctaccaatctcaagccttctattcccttaccctattcccattcaaccattagtttcattcacaattcccatctatctcatggccatttcaaacaataatcatcatgctcttctccttgtttcaccaggaatgggtcacataatccctgccctagaacttgccaagcgtttagtcactcacaaaatcatttccaaactcaccttcttttatggttcaatcaaaacctatactccctccaaagctgagacacaaattctccaatcagccataaaggaaaaactctttgaccttatccaactccccccaattgacctcactaacctacttggtccccatgcatccgtacaaaccaagatagcaaccataatgcatgaaacaccactactttttgtgtccacaatctccatcatgaacctcaacccaaccatgatcatcactgacttcttcttcagccaagttatacctctagtccaaaatctaaacctacccatttttgcttttgcaccaaccaatgcatggctccttgcacttgctctttacacccccactttggataaagaaatagaaggagaatatcgcaatgaaaacaaacctatctcaatcccaggttgcaaacccgtaaactcccatgatttgtacgatattttgagtgacaggacacataggttttaccatgaatttgttggggcatgtgaaggggcagcacttgctgatgggatctttgtgaacacgtttcatgagttggagcctaagacacttgaagcacttggtagtggacacataaccaaggtgccagtgtatcctgttgggccaatagtaagggaaagaagccgtaatggtactgatcatgagggaaagagaagtgatgttgttgagtggctgaacaaacaagaagaagagtctgtggtgtatgtgtcatttgggagtggatacacaatgtcatgtgaggaaatcaaagagatggctttggggttggagctgagtgggaaaaactttatttggtctttgcgcccatctttcaccaaagctggcactgataattacatcacaggaggtgagtagctaggtagggtctcctatgatatagtagaattttggtaagaaaattaaaaagagtaaatatttattataaaaattaataaaattttttattgttttagttttttaacaaatgttttaaaaatactgattaatatttgtcttcaaaataatatcatcgttgagttatgatttactccagtcataaattatcacacaataccgatagcaaatattttatcggtttcaaaataagtatagcatggataacaaattatttcaaaataagtgttacatttaaatttccaatataatattaattttttaataattgttgctttaattatttagtataatattaatattaagattaatgtaaaataatctatgatgatgtttattttggtatatagggagtatagttttttttatcaacttttttatgacaactttatctctgtttaatgcacatattatttgatattcttaattgtgtatgagggtattgttgaaaaaatagcctaaaaaatctaaaaagactgttattttgaaaggaaaaaaaaaactaaaaagactattattttggaatgggagaaatgttaatttggtcccttaattattttaaaattttcaattagttccctttattttcgaacactcatatcaggtactttaatttaaaaaaaaaaatactttaatcaacctttttttgttcagccgatgctattaaattgtcaattttgacgatttttgtttatgaatagacagttaaatatatttattattattattttataactataagtaaacttaaatatgttttaaattttttataaatgataaatttttgttcatatataattactctttttaaaattttgtttcaataaatttaatataatataaaatatatgcatttagtcatagatgccaaactatattcaacttggctgtaactcgtttaacctactaaaatgaatctggctggattatataattcaacctacctacttgtataatccaccaatccaataggtttaaaaaagtgggtcaagttaggttgatcttcagttaatttttattttattttctattgttagttataatatattttaccattaaaaacctttatcactagttaaatataaggatgttttaattcgctctgtggctataattcttttgcaagtcttgtattctctgattctaatgaattaaatatattagttccttttttcaatatagaattttagtttgagagaggagagtacatcgtagtgattttcagaacattgtgtttgagttttcatcatataattatcaatttatatgttgaattgtacgtaggataataaattatatagacacacactatgccttttattttatgtcaaatttaaaagaataatattcttattattatacggagtaatgtttttttatgttttattactagtgttattatagttcaatattccaataaaaaaacatatagtttggttccttcacaggtgaggaaggtgaagctggaactaccattgagtctaatcttgaaccatcgaactctttgcctgatgagttctaccgcattcaagccaatggaattgtgatcacagattgggccccacaattggatatcttgaggcacccatctgttggtgggtttgtgtctcactgtggatggaactcagtgatagaggctgtttcatgtggggtgccaataattggatgccctctttttgcagaccaaatgatgaatgctacaatgctaatggaggaagttggcaatgcaattcgagtagaggtgtcaccatctaccaacaaggctggaagtgaggagatagctaaagcaatcaggaagataatggataaggatgacaaagaagggtgtgtaatgagggaaagggctaaagagcttaagcacatagcagaaagagcttggtctcaggatggttcttcttatttagcactttcaaaaatcactcactcaaatggggtgtgataactcatttggggtggttaaaataagtactcactttggtaaaaggaatttctattctagaataaacaatcattatcactgttttgtttgaacttttatgcttttaatttgttggttgttttagattaatgctaacttctatttaatatttaaatggtgaaatattgtaatattaattgtggttgtaatttataaaataaaaaatttaagactgaattgatagttggaaaagagtttaaggattgaaagtgataattatgttttttttactgtactttcacgtgaatttttaggtcatattcatccatattatgttattttattagtagaattcacgttttggtgttagtttgtacgtataagatagatgtgcaagagctctagagtggaaaagatcgagtaaaaaaaaaattgcaatctaactctatcacattcatcatagctgtgtggtcacctgattacggtcatggtcattcgaccatggtcatgatcactcgaccatggtcatggtcacctccccatgattgagtgtcagatttcaacaaaattttcaccataatcgtggtaatttgattacggtcgtagtctgtctgtgttaataattatttaaattgagtttcgtaataaggtgttttgaagagaaacttttatcttttcctcttgagcatgtttttggagatttttatgggaaaagagagttgtaactttgtggctatgaaggagcattgaaatcacaacgagggtcgatttgtgtatagtttctttatctttttgttgtttctatgttttcccttaggttttctagttttactatgatcatgaacatgttaatgatcatctgtttgtgattgattgatatgaaaagtaatcattttcatacagcttgcatggtgaaactgattgtataaatcctcaatgaattaatttattaatcatccatttcatttaataaccttatcctttgaactaaattaatatttctataatcaattgaatattggtttaggccaaagagtattgttagaccaaaatcaaaggctaatagttgacttaggggaataatgcttattgacgataattgggattcattagaattagaatcggggaaaaagggatacatgcaaattcacaaatccttgacttttcataataattgttttctgacaagttcttctactttagttctttatttcgttaaagagtaattgatcctaaatctttctttatttgataaaactcaaattgtagttatttatgaaattagttatttgagaacgtgacggatcctctatgttcgatatctggattacataggatatacttttctttgtacaagtactttttttacgcatggaaaatagagaggtcgtggtttaaatctctcacaagcattttaacataaactagtgatcaatatttattgataataaataaataaatagagtaaataaaataaaatcctaagttggatgtggttgctcaataactctcaatctctcatatggacaagagctgaaaatgtgatgtccaagtacgttttatcattccaaatacatgaactcttgcacttattaatttatactctaacattagacaaagagatacatggacaatatatagagatcacaagtccctaacaatcattggaacggcaacaactattagaaaaaaattagaaaaccaaaacaataaatatagcagtagaattatttcacatgtaatcaatacataaacaatttttataacaatacttaatataaaaaataaatataataacaaaagagagtttaaaaaaaaaattaaagtgaagagcgttatgcgttgtctttaattagagagaaaatgtcctgatagtaaattataatgtgttcatctcctaatatacatcaactcgtcagaccaatcatgtacaacaaaggattttcgaaccaaataacacgatactccaaaatgcattttaaataatagtagaatttttatctattgtttgagttatatacatttttattgctttgtgtgttgtattttcacgtgtaccgaatcacaaaatttcctaacgttaagacttgtaatattcacaaaggaaattgatcaaataaaagagtttccttaaatataataatagaagtaggggtgttcgtggtctggattggatcggttttgaagtaaaaattcatccgattcaatccctatgatttggtcatttgattatccattcggtttgatttttttttttcaaatccgatccaatccaatccaatattttttcggtttggattggatcggttttcggttttttaaaatgtctaaaaataaaacttagagacttatttttatcaagtatctagcataaacaaacacattcattggataaaagcaaatacaattttctaattttcattggacaaacacgttcattcaacaaaataaagagtaatgaaaccttattgcaaacatgtttattggacaaaaacaaacacaattttctaattttcaaattgaactcataacttaaatgtaaaactaaaaagcctaagtaggtaattgatcgattggattggatcgatttttaccagtcaatccgaaaatcgatccaatctgatgaaaatttcatgtttttttcggttttcggttttcggttttcggttatttcggttatcggttcggtcacctcggtttgaatcggtttggatcggttgatgaacacccctaaatagaagtggtgggatgcttttagtttttcacggaaactaattctaaaagcattttatctttaaaaacataattaacaaataaaatacaatttaactttcaaattataagaaaatatttttggattaacagtcaattttgtctctgaatatatagagcactaacaaattcatcctcgaaagatgaaaattcaaattttagttctcgaaagaaaaaaaagtgcaacaaataactttcatctgttaacattaatgaaagtgtttatgtggcacattcagcgacgaatttgtcagcgctctacacatttagagacaaatttgtcaacgctctatccaaaatataatttaatctttatctttttcccttttttaatcgttgcaagtataatattataataaacacttaaaaaataggaaaacaaacataaattagaacaaacataataataagtataatattttggttaataaacataatatgtctgatgctatgaaatttccatattatgcttattaattaatcaatattatatttattattatgtttgttttaacttatgattgctttcctatttttttaagtatttattgtaatgttatacttgcaacgattaaaaaaaggaagatggagattaaattatactttgagtagaacgctcacaaattcgtccctaaacgtgtagaacgctgataaatttgtccttgaatgtgtcacgtaggctctttcattaacgataactgatgaaagttaatgaaaggataaatttgtcacacttttttcactttcgaatactaaaatttgaattttcatttttcggagacgaatttgttaaaactctacacatttagggataaaaacaattatttacccaaatattttccaacaacttgtacacaccatcgattatttctgcatattgctagacatgactccagaattggatcatcattaattgattatcggtatctttatatgtggacggaactcagtgcaagacttaagtttagttgcataattgattttggcgaaaactatggaaggaaagcgaaggaagccaccaaccactgagcataaccattgtccaattttctagtgcttaattaatgttaccgataaattccctaccaaagagggaaaatttcttttagcaactatcgaaggaaaatgaaggaagtcaccaaccactcagcggaaccatcactactagaaaaataggttttaacatcgctagtttaacatcggttatcgagcgaaccgatgttaacgaaaatgcggtggcaattttgtaaataagcgaacttatttaacatcggttttgaagatttttcgcaaaaccgatgttaaccatgaacttttaacatcggttttcattttttttagtacaaccgatgttaacgacgaaatgttaacatcggttttgtagattttttagtataaccgatgttaaccatgaaatgttaacatcggttttgtagatttttgagtataaccgatgttaaccatgaaatgttaacatcggttttttagatttttaagtataaccgatgttaaccatgaaatgttaacatcggttgtcaagattttaagcaaaaccgatgttaaaataacatgttaacatcggtttttgcatgggaaccgatgttgtacttataccgtcgcgaggattaaacttcagtatcgcgccttttagcctttatatcttctgaaaagccacgaccccttcgttctcgcgcctttatctccttcgacacccaactccttcgtgccccaactccttcatgccgtccggtatcacccgacaccccacccgacaccccatctcttcgtgccttctggtatcaccttccgcgcgcgctgtgaccattgcgcattgttggtgtcttcttgagtcgcgctcctagtatcctctgcttccaccgcctccgtctgataatcgcgacctcatcccaggctttcggtgtcaccggtgacattgacggcagtcggaaaggctcaggtacttgccctaacctcagcttgtagagtcttttggtctgttctgttcgaggtactatgggaactcacatttcgaactaataagtcgttggtatttggtttttatgttaccgccatggatttgcaaagtaggaggcgtcatttggttgagaccgcggttcgcattgttggtgttagctttcacaggtacttgactttattccatgcttgttggtcttggttattcatgtgaaagagacaatgggtatctgttgatgtatgtttgtttaaaaaatgttggataattgtatggacatctgctggaattggttttgtttggtgttaattgtttgtgctgctggacatttacactatgacaaacaagagaggaaaaggaaaaacactatacatgattggtggtttgttttggtttctgttgtggtttgttttgactatagcatattgatgtttaatttattgtcactgttattatactaagtgaagtttgtatggctggttaaaaattttaggacactaagtggctgattaagtaaacttgtgatgctattttttgtcgttgttaagaatacttgttaagtatttatgttgggaataattgggagctatgttaggctgatgatgttggttataacataagtagcagcactggtagagtctgttttagtcattgggttggtcaacctctctaatacaacgtagacaatccctcctctttgggagcttccctgtggcttagccaccgaggtagggtgtaagtccagtgattttctttctccattgctatctctgatattcgtttggtctcttcttctccaagagaacaccttcctgctgctgttctcttttgggtttttctgagtgtaggttaccccttcaccatttgagcctgacccatgttacgttatgtttagtgacatggggaaaaccaaaaataatggatcgaagaagggtaaagagacccaacttgcctgctctaatgttgcttcggatgggttagttgctggagaagtgtctatgggtgcggctgaaagctccaataagagtgcccaccaggtgtttgatagaaagactgaaagagatttggttgaagattcttcaaatagcgattcggtatcaagaaccttggggacaaaggacaccaattgtgaccagacaagtgagtttgaagagaaatctccgattgtggcagaagagaaaccttcctcgaaagataaggatttggcaaataacaacattccttgggtgaatctattcaaagagaatagacaaccttcgaaggggctgtgcttggaaaatttaaaccttggagaagctgagttaattgcgttagacagtgatgatgttcaatccttaaatgcagtctggggatactgtctcattgggtatgtggctggctgcttccctggtaagaaggctattcatgatgattccagtgacgaagaggagggcatgaggatgttggtgtgttgaggaacagtttaagaaaaccttattgatagctttgatccccaggtgtgaggaggccttcagtatcaagcatccattcctcattaggcttaaaaccttgattgtcatcaaacttctaaactttagtattttttatgaaaaccttattgatgtctgggatacatcgttaggtcatttcagttagcatgttgctttctattttctttaagaaaacatcatcttcagcagactcatcctgaatcttgcccttagtgcttcatcattcataatacggatacgaagtataagttttgcagaattgtcatcattaaatatacaagtcaaatcatcatcaaattcaatgttaatgttctctgcaatgtcagcgatactcaacttcttatccaccctcatttcacgattcagctttatgcgaagcaaccaaggtgaaattttttcacaagcaacttcttcatcaaccatttcatagtaggacttcacaaaatgaacgtcctcttcaattattgtacatcgggtctggatcataccacacctctgtagcttcagtcacactcctgagagtagtatattctaaagcacagacaaagaaggcgttttaattctctttgccacattaatgatttcccttaacctacgaacaccaagagtaacattctttgcactgacaccagcatagtgtaaagtcttgagagtcatatgagtaacaggttctccaattgattgtgctgccatacaaccaatcatttctccatatgctacaagggactgcaagaaccttgattctatttctcgcactacccactcaaatggctgacgataaagtctgtattcctccaatacccttttactgccaaaagggctacagagcagaatattgaacagaagagtagcattcttctgagcttcttgactcaagagatcttaagcaggaacaaccttaagtcgctcatggagcttttcaacggcttccacaatctccattggatgcatatcagaaggcctttggaagtcaaccttaaatgtcttctgagcattccagattactctcttcaggtgaacaggcagtggcagagaactgtcaccagtagtggctatgtcaaacacattatcatactctctgatggtttttaagtcttctacagcctcttcaagcatgtaagtaggcttccagttttcagcatcgaattcatacctaaacaccctgtcaaattctcttttttccattttaagggaatccaggttctatgtttcaatccaacagcatccataccatcttctccgtagagaaattgtatgacgtcaccagtagtagatgtctcagttgcaagttgaaatctatcagcttcaaccttttgaacttcagcctcaacacattatgaactctctgatggtttttaagtcttctacaggctcttgaagcatgtaagtaggcttcttgttttcagcatcgaattcatacctaaacaccctgtcaaattctatctttttccattttaagggaatccagcttctatgtttcaatccaaacagcttccataccatcttctccgtagagaaattgtatgatgtctcccaaagagtttctaactgtcccatcatatttaaccatgatgtcctccatagccttcacaagtcgcatctggatgtacgcagtttcagaggtcttcactgcagtatcaataagaccttccctaccacccatggcatggcaaaaaaaaactcttcaggggtcagtccctgtagatatgagttctccacaaagccacgacttgctggcccgtaatcatcttttgtgaagtggggcaatgtacggtctacgaaaccatatggaattcgcttaccctcaacgttttgttggcccacacaagcagtcatttgagatatgttgataaaacttcctttggaaccagctgtcaccattgctttcagattgttgctctcagataaacttgtttgagcactatttccagcaccatgacgaaactatctaatggtttttaggtcttatacagggtctttaagcatgtaagtaggcttccagttttcatcatcaaattcagacctaaacacccttgggaaattctaatttttttgtcatcctaagggaatactgcttctgtgtttgttgtccttttaatatgaatactcccctaaatatgacgaacatagcattagtttattgaatagcgcaacccttggcaatgaacgctcctataataatgtgttttgatccttatgattatataaatatatatggtaagtattttgggataatgttgatattgtcatcatgttgtttgcaggtttacaaaaagattctcggtgacttctttcagcattacattcattgaacctctgcatctcttccctgcgtaagaacaaaggcattttactataaaatattcaccacattgactaactttctacttctaatgcttgtattttgatttggctcagtcgcttgataggttcccattgtttttgctcattcccatactttgatttggcacagctgtctcaggtactatgattttaattgtctattacaaatgccttgcatctttttttatcttatgtatgtaaattgttttatgccattaatgactatgtctatatacaaataatgttcattatgagtgaaccgtagtttcccgtttgagattcattacagtgattcttccggaaagtttggattaatcattgtattgaatcttgaattgtccgtttggacagtttgggagggcttaaatttttttagtatattcacatttatacgttgtcattcttgtcttaaatatgacaaaatttcggttcaatgcatttcactttgttctccgggtgcatacttgactgtggtggaacccatgtcaccgctttcatttcgtgtacttggagaccaaagcgaaatgctgccgaaatttcgtcatattaaggataaagactcaacgtatagatatgaatatactttaaaaatatgccttcctgaatgggatagggccacaccttgaattaaaaaagtgaggttttcatgcatggctgaactttgtcagtatctcagagttggtaagcacatggatcgatcttggatgaatgcacctcgcatcacggttgagtacaaacaaggagttgaaaatttcttacaatttgcctccgaaagagctcgacccgatggggatggaaactattttgcccctgtatcaattgtttgaatggtagacggcaaacactagaagacatacgggaccatcttctgtgcgatggaattaagaagacttatacgacatggacatggcatggtgagtcgacagtgacgcagagggtctcgcatactgaatgggttgatgttgacatcggcgatcgactagaggatatgatccgtgatctggggcatgagtcttttcagcaagcacatgcccctatgtatgacacgttggagagtgattcgaaaaagccgttgtatccggggtgcaaggagtcgttgacactgttgtctgcagtgttaaatctagtgaatgtgaaggcgaaatatgggtggagtgacaaaagcttcagctcactgcttgaggtagttaaggacatgcttccagaggaaaacaccctgcctagcagttactataaggcgaagaagatactttgtccgatgggtatggagtataagaaaattcatgcatgtcctaatgactgcattttgtaccgaaatgaatttgaacaaatgcataaatgccccacgtgtggggtatcacgatacaaagtgaaggatgttgacgaatgtggcagtgatgacagttcagcgaaaggccctcccgcgaaggtgttgtggtatcttccgatcattccaaggtttaagcgtctgtttgctaatgaagatgacgcaaaagaccttacatggcatgcagagggaagaaactctgatgggatgctccgacatccggcagattcagttcagtggaaaaagtttgatcgtttgtatccggagttcggcaacgagccaagaaatctaaggcttgcacttgctagtgatggaatgaatctgtacggtagtttaagtactcagcacagttcgtggcctgttttgcttgtcatatacaacctgcctccttggttgtgcatgaagcgaaagtacataatattgtgtatgatgatatcaggcccaaaacagcctggaaatgacattgatgtttatctcagtcccttgattgaagacttgacaaacttgtgggatgagggggttgccgtgtttgatgggtatcgaaaggagacattcaagttgcgtggaatgctattttgtaccattaatgattttcctgcctacggcaatttgagtggatacagtgttaagggccatcatgcatgtcctatctgtgagcaagacacgagttacttgcaactaaaacatggaagaaaaacagtttacactcgccatcggcgttttttgagaccttatcatccttatcggcgattgaaaaaagcatttgatggaagtcaagagcatggacttgcaccgattccgttaaccggtgagcaggttcttgagcgggttgatgccatccatattgtatttggaaaaaggcaaaagaagcagaaaggtattacatgcttatggaagaagaggtccatattgtttgagcttccatactggtctgatctagatgttagacattgcctcgatgttatgcatgtggagaaaaacgtgtgtgacagtgtcatcggcacgttgcttaacattcaagggaagacaaaggatggtttgaacactcgtcaagatcttgctgagatgggtatacgtcaacagttacatcccaggtccgatggtaaaaaaatttacttgcctccagcatgccacacattgtcaagaaaggagaagataagtttttgtcagtgtctacgacgagttaaagtgccacaaggatactattcaaatattaagagccttgtacagatgacggattttaaactagttggattgaagtctcatgattgccacgtcttgatgcaacaactgttagccgtggcgattcgagacattttgcctaagaatatcaggcatgctatcattcgcctgtgctttttcttcaatgccatttgttcaaaagtcgtggatcctgtaacgttagatgacttggaggaagaggcggcaattatcttgtgtcagttggagatgtactttcctccctcattttttgacataatggttcacttagttgttcatctggtgagggaaataaaaatatgtggaccagtttatttacggtggatgtacccgatcgagagatacatgaagatcttgaaagggtatacaaaaaacctacactgtcctgaagcatccatagttgaaaggtacatagcagaagaagcggttgaattttgttcagaatacctgcagaaagcaaagcctattggccttcctgagttgcgacatgaggacagagtgggaggaaagggtacacgagggctacatgttataacgccttcgttgcaggagttgaatcaagctcatttgtatgtcctgaataacagtaatgaagtgctgccatatattgttcgtcatgaagcactccttcatcaaagtaatccaagaatgacgaagaataggctgttgaaagcgcataacaagaatttcttgaattggtttaaaaatacaatatttcgtgatgaatctgcatctgaaacgctgaggaagttagcagatggcccaaaaagaaatgtgagaagttggcaagggtacgatatcaacaagtactccttctataccaaacaacaagatgaaaagtccaccatgcagaacagtggggttagtctaacagctgagtcacaacactttgctactgtccatgacaacaatccacgtttggcgtgcttgccttactttggagtcattaatgatatatgggagcttaattatgttagtttctctgtttgtgttttcaaatgcatgtgggttgatgtcaacggtggggtgcgaaccgaggatttaggatttactttggtagatcttaacaagctaggttatcaagatgaacctttcatcatggcagaacaagctaaacaagtcttttatgtacaagatccatgtgacgaaaggtggtcagtggtcctgaatggaaaaaccattggcattaatgttgacgaagacgagtcaaaccccgatacaactatcacacatttcgccacacaaacacctgacgtcaacagagaagacgaggttgacgatgtgtatgcaaatcgttatgatcatgatgaaggagaattaattaacatcagctcatgtaatttgttttgcttaagtattttggactttaacatactatttgttatttaacataacttgtcatttaactttacttatatgtattcttgttttttatttcaggatcatgaccacaccatccacctccgctgaggcaccacatcgtcctgctgaggcagcagcggttcagcctgagacaccacttgcagttcactcaggacctcctccaccagtggatcaggctgagacagaacatccagttcactcagcacctccacctcctccaccagtggcccaggctgagactacacctccagttcagtcagcacctccacctcctacatcaaagaggacgagaaaagcaacacggctgaggtcactggctactagaggtcctggtgtggagaggcccgttgtccatgttgatcctagcacagggaaggctgatgggcctcaggctaagagattgaggacatatcttggggtcgtggccagagacaaggtagatatcacccttcctaattggaaggaagtgccttcagtgcagaaggacttgatttgggaggacattcaggtatgaaaatttaaagtatttaaataaattgttattcatgtaagttggaaactaacttctttgtaatgcaggctgagtttgatatacctgaagcctcagacgaaaggataaagaagaagatacttcagacagtgggtgagcggtggaggcagttcaaatccgacttgacaaggaagtgggtcctcgcagaagggaacgtggacgttgccgacgctgtatgcgagaaatacggcatcagtcacgaacagtggacccaattctgtcagagtaggcgagcagcttcctgggaggttagtggttttacgccttttgataaccctatcttttttcataaccctgtattttttcatttatgtagtcatacagtattttatttgctaactttacctgtcaacctgttacaggatgtgagaaagaaggcccaggcaatccagaggcaaaacaccgcccctcacgtattgtcacgcgggggttacgagttgctcgagaagagattaatggaggaaaagcaaaagaagcaactagagggagcaactcgtgatgacagcacggagacgatcattcatcctccgtcccccgtgcgacgacacgtgaagtggaagctggctcgcacgaagaaaagcggcgacatgacttcggaggcggcacgccagattgctgagaggattgtaagtaaaacaatacaaatgacatagacatttagttgtttttcgtatcacaactaacaaatcaaaggatctactttacgaattgcaggattccctggaagagcagtccacccagggttcttttgtcgccagtggtcgtcaagatgtcctggctgctgccattggacgatcggagcaccctggacgtgtccgtggtgctggagttggtgtgaccatcacccagtacttcggacccgctgcatcatcctctcggaagtcgaggtcttcttccatggcgcctgaggacttggatcgcctgaaagacaacatcagggtcgagctggagcagtctatcactgatcgacttacacagtcgatcacagagagagttacccagcaggtgatgatgagtttcagccagctgcagtcccacatccagtctcaggcagccattcagcctccggaggtacagtcaggtcctcttggtgcgcgtgtcagcaccaagggaagctgtgtcgatccctcgggcaatgaccctgacacgggtgcatctgacaggcgtgggttgtatgtggatggcaatcctccccgccttgttgcccttggtagagttcatgagggatcgacgactgtgcacagcgtccctcttgaggatggtcaggtaaaggtgagtgttgaggaggttcgcgatccagacgctcccgtccctattcccactgacgaggttgtgttagtgggacaggcacttaacactttccttgcctggccgacacatcttgtacacaccattttgactcaggtttggttatttttccgtaatgtattctaatttacgaatgatttgtgacatatgaacttaacatgatcgctcacccttgtttgttaactgtgtaggataagcaagaaggcaagggacggtcgaaacctgtagataaggcggaacatgcttctgatcccttgtaccttctggctctgaccatccctgatctttttctcagacccttccaggtgccatgggacccgcatatgttcggggtagttaatgacaacttccccttgtacatcaagcacgaggatatttcggagatcatccatggtggtcagtgtctgagcctctccgttttacagttgtggatgttgtaagtctcttgcaattgactagcattatttggtgaattgttttatcttctaccataacttactttattttcactgcataatagccatatgaatcatttaagtctgcaatccgatcaccctgatgtctatggattcctcgagccacagtcgatacagagatctggccaatctcaatttctgatcgaggactatatgaagaaatggatgcagacttcacagaaaaaagtctaccttgcaccatatttgaatgggtaaccataaataagaatcacaatttattaatgtatgcagtatatataataaccttgttttttacaatgcagttcacattggcaactggttgttatatgtccgaaggccaatgtagtcgtctggttctgttcgttgcataacaggcccgataactaccttaaaggaattattaacaggtaggttataatttctaacacatttacgttatttcttgacttgacatctaacttcaacaatatgcatactttttttgtctttaatagtgctttgaagggtctggatgactctccagcaagtaaatcaaaggctacaacaaaatggattgcgcttaaagtaattcctatcctaaatcatggtttaattactcaattaatttttattaatgttcacggtatttggcatttaattttgactttgtttttcaatttagtgtaataagcaaccaggaagcactgagtgtggctattatgtcatgcattggatgcagacaatagtccagggagccttcactgatagctgggacatggtaattgataagtgccttaattcagtcaaaatcatgttttaaatgcacgcacttatcatatgattttatgagttttcattacaaattcaccctaaaccgagttaaattgctttaatcgggttcgtacttttaatctgttaaaatttggaagatttgtccaatcacatttcacattttttgctagatttcgtagattccgtgacttgccaaagcttccgtaaacaaaagaaggcccaaaagattacttaaagcaaaacagaggaggtgcaacaagcaaaacaggctgaggcccaacaaaaaataggcccaggtacatttaactcgcttaagcgagtaaaatacactagaattgctcgcttaagcgagtggcattcaacttggccacttgttttagtgcaaaacagctggaatcgcactcccggaaagctctgctcgcccaagcgaccaaaacaggcaaaaatcactcgcttaagcgagttaaggcggctggaagacatctataaataccccgggagccttcatttgaaagacacaacttacacaccttctctactctctctagtgttcctccctcgtccaggagccttatttgggccttggaatgcttagtttaagccttggtttcatccaagagcttattctaagcatggagatgtttctttagttattttttagtgaggttaggctaagggagagaaataggcgggagtgcggaagctctgcccaaaggagggatgatctctgctaaggggatgctcctcatgcttggctagtctctctctgaaggattggatgtaatcttcttgctctcaagtatgtcttttaaatattatttatgcttaagttcttgtctattccttattgatagatttattctgtgcttaatgcttgatgctacttgatcactagtttcatgaattaaggttcttaagtttaactggaaagtactcttaaaactggatctgaataaatttattatttacgttacgatcgctaggaatagggcgtaccgtttagattgcattaaagcacgcgattatgattcataatgcgggagtgtttattttatatgcgagggatcgatatttaataatactcttagaacttgattgcgaggaatcgattcaaggctaacatagtgtgcatcaataaggatagataaggcttattgcatgataatgttaattgaatactaaggggtaagaatgatgaaatccaatcctacgcttttcctcagctttctgtattttttataactttttgtagttcatagtttttagttaattttctcaaaacaaatgaaaccacgttcatctacttgtaaataactattcaattgattaatttatttggattaactgagtaagctcaagtccctgtggagacgatctttataaattttgaaacttacaacgacaaaacggtatgcttgccgagagtttttccccaacagtaattacttgtctaattcaaattgttttggtttacttgttcttgttttgtacttattattacatgttttgttctgtcatgtcatgcatgcagtttttcaatgatcaaagaccattggaagcggacaccatgaaggcaatcagactcgaatgggcgaaattttttcttaaaattagacaagatgtattagtagattagggggttcatttctatttttgaaaacaattgtatatatatatatatatatatatatatatattaaattttagcttcttcatgtacattgacacattacattggatttgttattggaataattattaaattgtgcactgctggttctggaatatttaaattgtgctgggtggttctggatatttaaatttgcaggttgaagaactgctaaaattaaaaaaacaaaccaaatattttttaaaaaaaaagcaacaacatcggttgccaacaaaaccgatgttaacatgtaaatcaacatcggtttggtaaagtaaaccgatgttgtttgatgataacaacatcggtttactttaccaaaccgatgttgttatcatcaaacaacatcggtttactttaccaaatcgatgttgttatcagaaaacaacatcggtttacgttaaaaaccgatgttgatttacatgttaacatcggttctacgataaaaccgatgttgtcaaaccatcgtttattcttttgagcgttttcatgtacgacatgtccacatcggttattgatggcaacccgatgtgcttaatgtttgttaacatcggtttgtagaaccgatgttaaattatcaactttcaacgtcgcctgattcaacatcggccaataaccgatgttgaatgtctcaaataaccgatgttgaaagctgtttttctagtagtgcattaattgtccaattttctggtggttcattaatgttgccaataaatttcctaccaaagacggaccatttcttttagcaacattgaatgaaactaggaatggcaaaataggttagtccatttggcccacgaagaaaagtggactagactgagattttgaacctacaacaactaaacgggccaggccaacccaaaccacaaaaatgtgggccaaaactgggaacgggctggactagcccactgggccaactattcttttttttaatttgagtgaaagactgagagatagagtcattagagtgacttaaggtcactagctattgcccccgtgagtccgtgactccctccccctccgtctcctcttgactcccccgctctcctcgtgacggtgactccccagtcggtccccccgctccgatcccttctgcctgcttcgctcccaactccgctcccctctcctcacttcactcttgtggccgtgactcctcactccactcctagctccgttttcagctccaggctccttcgtcctgaaggtgtcaccatctccttaaactcctttcagtcctttcaattttataaattttatataataattttacaaaccctaacccacaatggatctcgaaggttaaagatggccaacatcttttggaagacatgcttcaacttctctgcgaatatgtactcttctttcttcgattgctcgttgttactccaaaaccctctcttgtccaacctttgctttgtttattttaccccttttttgtatattaaatgggaatctgattatgcattttgttcccattgtctttagcctttgttcttctcaaggttttgttttccctttttctttggattttttttgggaaacaaaattcttaatgctctctttgcttcttaacttcgtattgtgtctggagattttttttctttcacagttttgtactttgttttccttcattcaggatgatgttttctaaattcaattgtaacctatgctcactgaacacatcattatctcattattaattattaaacatgaagtaattcaattacttttgttttagttctcgtgataggtttgtgtttgtcagttgtgcaccttgatgttattagaatgttttatactaacttgcatattcttttattttaattgaatttgtaacaaacgtttcattttttgaattttgctatacctcaggtaaaggagatccttattgaggagttcaatgtgcagcctgtcaataatccaataactatttgtggtgatattcatggtcaattccatgatctaatgaaacttttccaaattaggggtcatgtgcctgagacaaattatatttttatggtatttgctacactttatttttctattaattttgatgatttcatatgttttggaattctatattttcctaaatgcattgcagggatactttgttgatcgaggttacaatagtcttgaagttttcaccatccttttacttctaaaactaaaatctaggtatgctcttttaattcatgttcttgcatctgtcttgattctctacttgtttttgttgtctttgcatgtattgttaataagattatcacttggaattttgcctagctttggaggcgtttaagaagagttttgagagacttggtgaggttgagagtttcagaaaacacctaaatacttgcacggaaagatgaaaattcattgattcttgtgaatcttatgattacatagttagggatcatactttatgctgcttgtgttatgtcatactgcaactacattgccatttttgcattgtgcttgttgtcactttgtttggtctccttgccatttagaatcaattttttcgttttctcatgccaactgtgaaggagatgtttttctattaacttaattatgtttaaatcaaatttctttattctggtattaggttaaatcatataataaagctcaaatgaattttctacataacattgaatataagttgtgttctgaaggtaaaatgctcaccctctatcaatgatgacaatagaacacaactcaattagcaaagtcatagaacaaaattttgtcaattagtcttatgagagagtaacacaacaattagtttatagttaacacatttacaccatattattattacattgtctgtataaagaaggcttctcttgtgtgagacaagaaattttcttgaacatccaaagtctttcgacttgtttccattttttctgtgtagcagaataatattctataagggtgaaggtaatcatcaaattaacttcatgatgaagtcagaaaattcaagttaaataataaatgcagaagaaaatgattgtttgtgggtaactttcaaatattgccatctatagacacgagtgatatatttgtctcaaaattcagtttaaacttagagtttgatttccttcttttggcttgtgataacaagtaataacattaggtgcttgtattttttaaataattattttgtctttttttaaaaaaataatttattttttattttttaggtggactggcccactgatccactaactcaccttaaagtggggcaaactagcattttcagtccactttacaaaagtaggtcagtctggcccgacccatatttttggttggtttgggctagtcagacccgtttttggtgggctggcccactttaccaacactaaaagaaactaatcaaacttgtaaattgtatttgagaagcccattattttaagaaggaaagcccaaccaagcttgtaatttacactcttcattcctaaatttaagatattgttttgaaatattttttttgtcctttttaataagattttttttcttttgattttttattttttaccaaaatatcttaattattttagtttataaataaattctatatttttttttctctttctcaaatgtactacttctcattccatttgagactttcattctgaaattgtttcacgttaagggtcatgttggcaaattgtctagaattgttcaagtggattggcaccggtcacttgtgggttgggtcaagtgcaatctgaacggggcagccagggtgttgtccaaggttttctctagcatggtgtattttgtgaccataactccataagggataggtttagggttgttttgcttagagcttgggtatttcttcttctattgtagccaaaataacaaccatgatggctatcgagctggcccatggcaaaggatgacaaaagctatggttggaatgtgactcaactagtggcagagtctggtggagatcaataatgcctatgacactacctaaaaaataaaatttgcagttattgagtggcaatttttttaataattatatatacttaatataattaattagaattttaaaaaaaaattggcattacctaaaaataaaattctacttaaaatttgacatacactaaaaaattttaatgactccgctactagactcaatcttagaggtcaatgctttttctcagtcgagcgtactgataccttggaggcttcataatcgttggagaaattgtatatccatttttcgtctcatggattttgtggtctctatagttttcgagagggaaatcatagtgttgataaacttcagaagtgtactattgacgttcaagggttctctttgtgggattttgcccttcgttttattagtgtggacatttatcgctctaggctaggcaatcttagttaaagggctagataatgtttgtcatggtgggtttggtttggtccccctgttagttttgttcttaaataaatttgctgggtatgctacaaaggattattgatattgctttgggtgccaacataattgaaatactttgtattttgcattatcttgatgcttacatgttgatcttattatgtactctctatgtttgtatttaaaaaaactcgaatttaaagtgatgtttgttcttttttataagactcaatttataatgttttttgtattaattatttttagattataaatatttctcattaaaagaagaaagaaaatatattgataaaccattagaagagagaaaaatattaataacaatgatagtttaaaaaaagttgtaaactttccttaatctcggtcaattaagtaatcgggtcttatatataggaataaagggagtatttgagtgttcaagagtttggttttaaaatgtaaaacttcactactattactctcttcaatacttacataagtataagtagaaaaaactaatataattagtcccaataatatcatatcacgtcgctacatagactaaagtcccattttcatccctaaaataaagataaagatgctgcaatttgatccttgaaagatttttagaggcaaaataattcttaaaagttttctttgttgggcacattagtccttttgggaactacactttgccattaatacataactttgaagaactaattcaactaaatgcataattcttttaaggagtaaattgcctatagttatgttttgtttgtgattaatttgccaatataattgaatgagacagacaaattgataaacttgtctaatagataaaactttaattcaaggagtattttgcctccaaaaatcttttaggaacaaaattatcacctctttccctctcaactacataaattttctttgtttataaaacttgaatccgaaatcaataaacctagttctacttatacttgctttttattattattataaacacatttttgcataaaaaatagacacatagttttactaaaattatattgttcgattacattaaggaaataatatgatttaaaccaatttcaacaagtaaaaagatgcatcacaattttctttttcaaatatgtcaccctaaaaagtacatggacataaatatttattcaattttatttcttaaaaatcttcttcattttctttttatttctatatcccttttcctttctcatcacatcacacattttttcattataatttgaataacttgtgtttatcttgttaaaataacaaatattaagtcacaataataggtttattgtatttttttatcaccaaatgttaatttgttagttttgttataaatgtcagttgagagattcgaacttgcaacctctcccttttcccttctcccttccccaaccattgggcctactctctatattcttatatatcttctattttttggtccccttttaactagtgttattaaaattggatcgaccaaactgatttgaccaagaaccaatggcctagtcggtctgattggggaatcagatcaagcatgcaagtgacttgtttcagcccatatcaaactgttcgatttttcaaataatcggtgacccaatgtgttttggaaactcgagacaggttgtgcaaatggaaaaaaaaatcgaaggtgtcgtttcacactttctcagtttttagttttcacttctcttataatttctctcttcacgaacctaaacccacaccccacactctattcttccttagttcttcctaaacaatgtactcaccaccatcgttgtgttgtccctttgctcgacaatgctcgatttgtccgtctactcattgttgcgccatcttgttgcaatgttgccacttcatttaggtacttccttcgctgctcacactcacataactaaatcaaactacatcagactgtttgtgaatgtttgtaaatgttgcttttgtttattagtgcgtgtaaatgttgcttttttttgttgatgctatttgtgattgctttttaaaacttgtttatggacttgtgttgtctttttgtttatggacctgttttgtcaactttggagtatggatggacatcttttattaagaactttatttgctatttggaatattaagtacttaaaaattggaaatccaaatatggattgatcaagaaaattttgttatgttatgttatgttatgttatatatatatatatatatatatatatatacacctccgggccatatcgggtcaattagtaacccaccaatttgatctttgacccatcaacttagtgtcttgaccaggtcgatgatcggtttgattttcacaacactgcttttaaccatgggtcttgggctgctgcacctctggactaagagcaaagtcgaccctacatgctgtttacaaaggcttgtcgaaagaccttgcgactattgaagcaatacgtactaaggagggagccttcggtggggccacaaaggttttttcaagcacatagcctcaacccaaccatgatcatcattgacttcttcctaaaccaagttctccctttagttaagaagctaaaagttcccatgtttgttttttcaccaacaaacgcgtggcaccttgcacttgctcttcacaccccattttagataagcaaatacaaggagaaattaaacctatctcaatcccatgggttgcaaacctttacacatcaccatgatttgtttgatgtgtattgggaccggacacataggttgtaccatgaatttgttgccttgtgtgaggaggcagcattggctgatgggatcttttgtgaacacgtttaattagttggaacttaagaccctcgaagcacttggtagtggatagattattaccaaggtgcccgtgtacccggttgggcctatagaaagggatcaaagaagccctaatggtagcaatgagggaaagaaaagtgatgtttttaagtggccagacaagcaagaagaaaagtgtgtggtttttgtgtcacttgggagtggatacacaatgtcatgtgaggaaatcacaaactaatggaaagaccaacttaatctaagaggcattttaagatattaaaatgaaatattttaaacttaggaaatgaaattgaaatttaaaactcagaaaaggtcgcaaaattctcttttaattagcctttctttagtgttatatagggatggaaaaaaaattcttacctacaaacattcatggataaaatccatcatgtataaatgatggatactttaaatgagtatttgttattcatgagtatacgtatttttttactgactcattaatgggtatggtatggacatcataatacccacgtctttgagatattgtaattttatttttatttataatttatatttatttatacttaagagatacttattttatgtttaattatgttgtattaatgtttcttttttattcttgatttttcactcactagttttaatttatgttgaaaatcacttttttttattttttaaaatcagaagtattcatgggtatccatggatacttaacaatataaaaaaaaatcattggtatttttcaaaggatactcaacgggtaacggacatgaattttttccaacgaacggataacaaatagtccttattcatgttggatctgattcctagtgttataattcaatattacaataaactgttgaactcagggggagttgcttgaagcacaaagtatagattgattcaagaaggaaagttttgaactttcaacatgtcttgaagctttgaagattaatttgtgattgaatgtaaaaggaagaaacatttctggtgatccaagtacattgcattcatatcattcattaaaggaattaatttaaggaaaagagtttacatggctttgattaattgtctaaggttttgaattaaatcaagtgtttttggaaaaataatgttttctactggattaatcgattatgttaagaaaagaatcgattattttgttcttgatgctttctggaaaacttttcaagaacaatgtaatcgattacatatcggaataatcgattattttaccttagttctcttataaacaactttgatgaatagtttaatcgattaccaacatgttgtaatcgattacataggctaatcagaatatatcaccttcctgtcttaatcgattacaaagaatagtaatcgattacattacatgcctatactttataagttctactgatttaatcgattaccaaatatagttatcgattacatagttcaataaggtttctgaagctttctgatttaatcgattaccagaatccgtaatcgattacataatatatttcaaaatatgaaacttcctgtcttaatcgattacatgttagaataatcaattattttgtttgtagctcatacccagaaatgttttgaatgatttaatcgattacaggagcgtatgtaatcgattacatgaactaaataatcgattacaggagcgtatttaatcgattactaacagttagaaaatttattataaatagaacccttgctcagctgtttcaataacttgatctattcatattctgagcattctaagactttctaaacattcttttagtgattctctaggttcataaagttcttgctttcacaaaaacattcatgtgttgttaagtgtttttaaaagcaagaagttctttttcaaagcttacgggaagtgatgttctgagtttgtttttattatttaacctggtgtagtcattcatatgcatatcattcattgaatcatcagatgatttctttccttaaactttgtggttgtaattcttttgtgaatcttgtttttgatagtctattgtaattgagtttcttgcttgtaatctagagatagagtttctctaggggatttgctgagtagtgttctcagtgggttgtctctaagaatctaatagtgtttgagatttctgaactttatctagggttgataaagagagactttgtaataacttgtaagaactaaaaattgcaatagtgaaactccattctagtgttgagtggaagaaaactggatgtagcttcatagtgtttgaagtgaaccagtataaatctttgtgtgttgtttattttctttatattggttaaattctgttattcttgattgtgtgtttttgttatcaataaagttcttgagctattgcataccttgggttgagcattagattgaataaaggttcttggtttcaaaagtgataaagatccaaagggaaaaactctgattttgttcaacaaaatttttaaattaccaaacctaaccaattcactccccctcttggttaagtgtgaagtgttcccatattttacataaacacactgtgattatctgacgggtgaggtaagtgaaactagaactattcatgtctctaatcctaagcaatcaaattctttttcctgaggatttccaccacataaaaaccaatgggattgtgatcaaggattgggcaccacagttggatattctgaagcacccatctattggtggttttgtgtctcactgtggatggaactcaatgatagagtgtttcatgtggggtgccaataattggatggcctctttttgcagatcaaatgatgaatgctacgatgctcgaagaagaagttggtaatgcaatttgagttgaggtgtcaccatctaccatcatggttggaagggagtaattagcaaaagcaataaggaagataatggatacagaaggatgtgtaatgagggaaaaggataaagagctcaaacaaatagcaaaaagagcttggtctcataatggttcttctgatttagcacttgcaaaatcactcactcaaatggggtatgataacttatgtaggtagttaaaagtactctccttgggaaaataatttctattttaaaataatcagctattaagattttgtttgagcttttatgatttaaatttcttccttagtctctttgtttgtttacgataggaaggaaattaaaataattgtgtaactagattacatagtggttggtactgatatttaacaatttgtaagtttgttttagattaatgctaactatcaccattaaagaaagattagtactgctaactaacatctatttaactaatgattaaattggtaaatgtatataggattaatcgtgttaacaataaaatgaaatgaaatgtaatcctaagtttgatatgattgtccaagaactctagtttggacaggagctgaaaatgccacccacagtacctttatatcacttcaaatgtatggacccttaacattagataaaaagatatataagcacaagtccctccaatccctggttgcaaccatcaattatttgtttacaatattgctgaaaagaattccaaaaaatttatcatcaatatcttcagacgtggatggaactcagtactagagcaaaggatgaatgttgcgcactacgcttatactagcatctactcccatacaaatgagtcatacacaataaaaaggaacacttgagaaactatttcattcagttaattagtaaatctggttttgaatttcaccaaatgtatcatagatccatcgcacttttattcatcgaagtaaactaccaaatcactgagcacgataacttttgttagccaattttctagtgcttaatagattttgagaataaaatttcaccaaagaaggacaatttcttttagcaacattgcatgaaactattatgacttgtaatttaacacaacttgtcatcatgcatcaatagaattgaattaatgacttgtaaatgaaaaaataaataaataatctgtagaatgcattatgacctataatgtaacataccaacatccaaaaagaaaacattttgaaacaagagtccgatgtaagcattaatctataatttatgttcaataacaatcatatcaagaacatgaaaaggatcttgggaattcatgagttttacgtaaacatgcctttgtccataattgcggaagatcttttaatggtagaatactttcgtagagtctttgggaaagattatttaatggcataatactttctcagagtcttgaccctttcaattcttctatcttctttgatagaattggatacaactctcatgggcagacaatgatggtattcagttttctagatatgtatttatagaaactaaaccactacgattgagataactgcataatacccatactacatacatgatcaataaatgtcttgggtggtaatcccttcgtcaacataaaattagtgctaacatactctatagacactccatgtttctgaacctcttctttaactacaaagtatttcaatttcatatttttagctccttttgaatacttgtcgtttttagaaaagaagactactacggaattatcacaataaattttcagcggcctatcaatacagtcgatcaattcaagccctaaaataaagtttcgtagccatttagcctgaaccatgaccttaaagcatgccacaaatttagctttcatagtggatgcagtaattacaaactgcttcgcacttttccaaggttactagacctcctataagtaagaatgtgacctttagtgccttgcaaatatctcagaacattctttgtagctttccaatgatccataccaggattactctggtatctttccaacattccaactgcaaagctaatatctggtctcgtacaagtctgagcatacattaggctcccaacaagtgatgcatatggaattgcttccatttccttttgtttcaattcattcttagaacattgcatgagactaaacttgtctcctttctgaattggtactggagacgatgagtagttttgcattccaaatctctctaatactttattaacatatgctttctgagacaaactcaacaatcattgtgatctatcatggaatatttctatcccaacaacataggatgcctcacccatatctttcatttcaaatttactagagagaaacttcttagtctcatttaaaagattaggatcattagttgcaagcaagatatcatcaacatacagaatcagtaatgtaaacgtactcccactgaccttcagatatatacaccgatcaacaatgttttctttaaatccaaaggaaacaatgatatcattgaacttaaggtaccattgtcttgaagcttgtttaagtctgtatattgatttcttaagtttgcacaccatgtgctcttttccttttctatgaaccccattggttggtccatatacacatcttcctctaaattcccatttagaaaggcagttttcacatccatctggtgtaactctagatcataatgagtcattaatgccataatgattcttagagaatcctttcttgaaattggtgaaaatgtttctttatagtcaatgtcatctttttgactgaatctctttgcaactagtctagtattgtaccgttataagttaccatgagagtcatgtttggtcttaaagacccatttacatccaactcttttacatccttctggtaactacatatatcattatgagaatgcaactaccaatgcatgcatcatgaaatgaccaccactcctccggagtgtggtgtggcacacaagatgtgaaatcatccccaggaacactgaacttacctggtaaggtctcagtcagcaattccttcccaggtctgtggttcccgccaccaacagtctcacaatcaatgcctaaccaaggcataagcaatttcatatcaaaaccagaccacagacatgcaagtcacaatatatatcataacagaatcccctatcctagggttcaatcagagcaagcctgcactaggctcctcacagaccatacaaggtccgctatggctgcataccaaacatctgagtcatcacaactcaatgcagctcacctaacagagcataaactaatcacaacttcactattcaattgtcatcagaaaggggctgaggtccactcaaagccctgctctactagcctcttagctcagaacatcacaatcaaggctctagcttatcagagaaccatcaacaagtgactctacataagtcacacatgcatatatagagccaagattcaaagttatcagaataaaaaactgaaagctaatccttcatctactcagagccctgaacaactttctcaactggaccctgggctaattctagccccagctcatatgggtcactattcacagggacccccagaatcaaaattaaacggtgaaacttgaggatcttacctcaatgacgactccaaaagaccccaagacgtcttccttgagcttctgtgtcctaatcacaacgtgggtcttcgccaaactcaagtcctctgagttttctcgctgagaattctcttctcaaacaaagaggggttttcaaaagagcaattgaaggattatagttttcctaaagtttctctcacaatcaaaggtcctcaagatgtgtttgggctaacatctaaggtccctaaaagcttggaaagccatcaatggaggtttggaggcaagaggaagaagaaaggctgatttccccttcatttttcgcgttttggcctatatatactcggtctgcccgacatccggcgctaccagcgccaactccggtgccatcagcgccacataggtcagttaggctggcgctttgagcgccactcccgcgctcctggcgccggttttcagaaactgtggcgccctcagcgccactcccgcgcctccagcgccaacttccagagaatctggcgccttgagcgccacatctggcgcccccagcgctagcttccagagaccctggcgccctcaacgccaagtctggcgccaccagcgccggctagggatttggcgctcctggcgccaattctggcgcccttggcgtggacctgcagggattctggcgcttccagcgccaacctggcgctcttggcgccacgttctagaactcacagcgcccttagcgtgaatctggcgctcttggcgccaccttccagtggttctggcgccatcagcaccgcacccttaacaggattttctgattcgaatccccgcgcgccgaaaatgaaggtccttacatataccacataattattataaataacaaaccttctttccctttgagatcttcttaatgctatttgttgtggttcttctataatgggttcattcggttcattgccaataatttcatcatgagcaatgggatcattcatttgttgttcttcattattgttaattggttcaataacatgaggaacaacaactttactagagctacaagtcaaaggaatttttactcttacttcttgaattcccactttacgtggtgtttcactcctattaacttcaccatcttcaatgaacctagcattactagtttctataatccttgtggtatgattaggacaataaaatctatacccttttgacttttctggataaccaatgaaataaccactgattgttcttgaatccaacttcttttcttgtgggttgtagtatctaatttctgtctggtaaccccaaacatgcaagtgccttaagctaggtttccttcctgtccaaagttcaaaaggagtctatggaatgactttactaggaacgttatttaatacatacatggcagtctttagagcataagtccacaatgaaatgagtaaagaagaattacttaacatacttctaaccatgtccaacaaggttctattacgccttcttgatacaccattctgttgtggtgtacctagcattgtgtattgagcacaaataccatgcttttctaagaatttagcaaatgggcccggatgttgttcactttcatcatacctttcataatactcacgacccctatcagacctgtcaattttcacctttctgtctaattacctttcaacttcattaatgtaaatctctaaaacatttataacttgagacttatcatgtagcaaatagacataaccataacgtgaataatcatcaatgaaggtgataaaatatttctctttattgaaagagttaacatcaaaaggaccgcaaacatcagtgtgtataattttaagaagctgagtgcttcttgtggctcttttctttgtgtgttttgtttgtttacctttgatataattcacacaaacattcagatcagtaaaatctaaatctggaaggatttcattctttatcaatctttcaattctttctttggatatgtgtcccaaacgtttatgccacaagtaagtagaacattcattaattaaggtacgtttagtaccaatattatgatgcagagtcataagtctttcaacataaagattatcaagacataatttatataatccattacataaagtatcattgccaatcatatgattgtgcttgtacaagctgaaactaccactaccaaatttaaaagagtatccaactttatcaagtttggaaataaaactaaattcctagatatactaggtacataaagagcttcacataagtccaaatgatgttcactatcaagatcaaacggtaaatcccaacagcttctactggaactttcactctattacccataaggacaaacttttcatttgaccttgtggtttgggtcgtaaggaatctctttctttttagctccttgatgtttttcgtaattgatggaatgaattccctagttcttaattctagtttcctcttgaactaacatattgtgtaattcatgcacattctatttgtctttcatggtattatagttcatttggaaaggaccatactcagacgataatgagttcatatgaactgcaccagaaaattttcatccacatccattcccgattactttagtcttgctgcaatatttttcatttcaacaacatactcatgcatagtacgtgaaccatcaaatttcatggtggttagtgtactcattagtgtcccagcaagagactttctgtcagtagtttgagagcactcttccacaagttttagcgtttctttagtactttcagtttgtggaagagttgacttaatgttgcttgcaatgctcattcgcatgtacatcagactcaacctattggatatttcccagttcttaaaatggactcttcatccttagtgcttgcatcaacaatagcactaggtttctcttctctaagagctaaatccaaatccattaccccaaggtaaaattcaatttgttctttccattcagagaagtttagtccattgaaaactacaatagttgagaaatgcgaatgtgtagcaacaggtgctgcaagatataaaacttaaaaaaataatgctttgaatcatacatatcacatactaacataattcagagattcatacatcataaaatgcatactaatgttcacctttggggatccattaatacacaacattcaactataatgatgctaataagatttcacataatttgattatgatgcataccccaactaaaaatatttgtcatctttggacgtccaaataaaactagaagtgtatcaacattatcaacgttcatgtttatttattataaaacaagtaatcatcctttgggttgatccttaactgtcctataataatgaacttcaatatgccacaacataaacaataattttataccattcatagcatcacatacaattgaaatagaacatttaaaaaagaaaaagaaaaagaaaaaattgattatttaaatttgaagaagatgaagaaagttagggaataaggaggttaggaaagatgaatttataaatctttgatcattgtttgcatttttgtgacagtttttaacccccggaaattactcactctcatagtcatcaatggaacctgaacctacgttcgagacaaaaagtaacagatttcaatttttcgaggacacaaaaaagactcaaaattttgcagggacggattccaaacatttcgatatttatagggacgaaaacatattttagcctatagtttaagttttaaaaaatgtcacgtaggctcgaatttgtctaagtctgattccaggccaaaaaataacatatttcaattttttgaggacaaaaaacataccaaaaattttgtagagatggattccaaacttttcgatatttataaagaaaaaaacatattttaaccattaaaaaataatcaaattccttgtgatgcttaccattatgctaaacaaaagattgaaaggagattaccacatgcatccacttctagcaaaacctctttcaactttcttgtaagatattttttattaattacttgatgcttcagcagtaagctattatagatggtggattttgagaagcaatgatgtgacactaatttcataacttatgaggtctaaggtctattaataattattgagaagatggaaaaatatacttaggatattgagaagctttaggatattaattattgttgtgctatttaggagatgaaaaacataattaaagcaagttcatgtatgaaatcaactacttggattgtcattcagaatggaggttggagagggaagacatgacatgtttgcaatgcaggctatgtttttttgttattattattattgttgtatgttgttcagtttaacctttgtgcatgatttcatttttatcattgtatgtattgcttgtgtatttggagacatttttctattatttattgataatagtaaaattatttctttggtttagacaatttatgattttttccttgctttgaggaggtttttacattaaaaatatgtgtctattgtgagcttttgttttataattgtattgattataactttaaatttgtaatttgatatgtatatatgaagctaaaacttatagcatatagatcatgatgtatacaaaaaaaatacttataggtataaaatataggaagatgaattgtaaaatatgatgtcaatttttttttaaaaaaactaacattttagatcggttctaatgcaactgatatacaaaatcacattttgtgagttcttgtgacaacaccttaactacaaacactacacaatgagagcaaggtcacgacaatgagagggaacacacatgtgcctaagaatgaaatggaaattgataaatcacataaaactaaaacttaaatgtaacattttcctaagaatccaaaatttctaacatgaccctccttaggtatgcttcttaatttatccttatgctttctgcctcacattacttaagatatgttcaaattacactattctccccactctaactcctaagagattattatgtgtcacattttagcatttagtctattgtaataggaacatacttttttcctttttttccaactttcaacatcaattacatatttgaactcattatcaactttgtgcttggattgcttccatcactcacatttctcctaaggggatgaatattacaccttttgggataccttctaccaaggattctcatataaaggtgtttagaaacactttttaccgacttggctctacttggacccacttaaagtgttctggttaaggaagtttcttcttattagggtattcaagacaattttttttttaccttaccctatctatttgacacttctttcttgcaagttgctctttgaattgcatcaatatatagagttctaaagctatatgtttatggtcgttggaggtaggatttgaacttcaaattgttacatgagttgtccatgttcatgcaacttcctgctctgcaaaacacttaccctccaaatcttttgcaactcttcttgaactacttccttcaactctgctcttccccatcattataataatttgcacatttcaaatttgaattgtgtctgttgtgtgcttagttgtatggtcttagtagtttctcatgatctttgaatttgaatcatggatagttttttgaagattgatctacataatgtttttcttttaagatgctatgataaatgcaatacattgtgctatggtaaatgttagtgaaggagacacaaggttgagaattgcctatagaatgtgccactatgactgacttcactttcgcttcctcatttgcaaagaaggtatcaagctgagaattgtctacaagaggccctactctagcttcactcttgtttcactcaggatacctgaccgcgagtcaaatttcagtctagtatctcatgcaaactgacaaaaaaatagtgttacctcttaattcctatgtgtcaaaaattatctctaacatataaatagtttcaagataatttattttccaaaatcaccccttttagttaaaaaaaaaaaagtccaactttcaccacaatcgaacaccctttcaattttactttcattctttttcaatacactttcattttaacctcttacctttcagctatacctagcatggtgtaagactttggttttatttataccctcttagaagactttggtctctcgttcatgctctaattcaattaattgaaaatttcctccaacatcattacttgtgattatccctaattttagatgcctaaaaataagatccatgttttcctcatcgctagcaatatattagcacgcgctagttcatattgaaaagttctacattagataaacttgtcaactaaaaattcaaaagacgtgcaagtatcattttcctctaccgaatatactgaaatatccttttgacatattccccagaataggctacctcgtgtagctgcactgaaatcacctttgtcagaaggcattgtcttgttctccacatcctcattgtccattttttttcctttctatttggtcacattcaatattttaaaagaaacaatgaatgaacattggttcgctcaattaactttaaccaaattcccatcgtatgttaacaaaagccataatttttgtagtgattgtaagtgcatcacaagataactgcgcaaggctagagccagctctttcaaggaaactaccaatcccaaataaaccaaacccaatacgacaaaaaggcccaatcttgagtcataaatagaggacaagtctttgatgattttgccactcatgcccaaaaacaaacccaccatcatgacccaaagaacttgtttggtctcttctggtcatgacccactacatgaaatataaataaagcatttttttttcaaatgccttggggctcaaatgatattcttcatttggttacttccacaactgccaaagtaccatatatttctactttaattaatactcacgaatgcacactttttctattccatggacgattcttagtagattccgaggaatcatcctatccccccacaccccacatgacaactttttcctctacttcaaccttttcattcttgacaaatatgcaaggcaatctcttccttctcaatcacggatccaacttttcttttctttctttttttttttttctggccatcttacgttattttatatatttttctttaattgacaatattctttctcttaacttactaatattttcacccatattaacacgggtatgtgaaatatatatcttaatatcacaaatcttgattattaacttttaaatagtaacatgtttagggatgattttttcctttttaaaccatgtgacgatgtaactttatttgttattttgaaatattataattatttaaattaattcaatttgatttctaatttaaaatttaaatattcagactttatattaaatcaaagatattttttagataaatgtaaatttatgattattataatcttagtaaatcttaatttgaattttaaattttaaatactatattgttaaaaaaaataatttaaaaaactttgttaaaaactttcatgtaccattagcttctttttttcttcttctttaaagcatgtaccattagttaatattattaatgtaaataaaatactgacattgcagatggaatataaaaataaattaaaaataagttgaagatattttttttatgtaaaagcctaatagactttataaataggcaaaatgatagtgttttaagtatattttacttgcttatattttcctttattctgtttaagattaatatataattttaagttgttataaattctatgtaatttaatttgttatattttataaattattgaaaataaaaaatatatggaaaaaataaaagcccaaaacataaaataaaacagaggtaacttaaatgaatcaaaaagtgaaaaaatttaaaaaaaagtgatgacacctttattgaaacagctcttaaacatatattacataaaataatgctatgaaaattacaggacccacttaacaaaccccactccctattgttccctggttactaaacttaaccacattttgccaccaccaaggaaattagagagaagcaagtttttattttcaaagtcttggtcttaattacgaccatgaagtaatatagtaaccgaatatgcttccaagaattctcatgctccctccaacgaccctttttatacccttttctaaccgccacttcatcacggcaagcatatgctttctaatattctagcaaaccttcgctactaaattcccctcttaacccctttttttgtaccttcatcatcatatatttcgcatcacaccaacccattttgatttgcatttgatcttcttcatagacatatacacactatcataatattattattttcttccctaaattttggttgtttttaatgttatgaagtttgggaagagactcaagcaacaaattcaggagtcgttgccggagtggagggacaagtatttgtcgtacaaggaattgaagaagctcgtacggctcatatcggcggcgccgccaacgttgttgaatgggtcattggaatatggcaagacggaggctgagtttgtgtatttgttgaacaatgaaatagacaagttcaatgggttcttcatggagaaagaggaggacttcattattcgacatatggtaatgttcttagtgacacactaatcatttttactttagaaatttatatatatatatatatatatatgttgttctatatatctcttaaatttgatggttactaaaacttcttacacttacaaggaaatctttgcattctttattaacaattttatttttattttgttgtaatgaattttttgtttgaataaagttagttgcttagaaattaagagtctaaaaatttgagtattttttataaggtgttataaaactttaagtaagatttgcatacaagacaaagtgaacaacgaaacttttaaactataggataagacgcagtaatagatcgagttcagagtccactatcattgcatcgtgtctgattacactcaaattcttggtcatgaaagtaatcgtacggtcttgtagtcactttgttgactgcaagaactccatatatatatatatatatatatatatatatatatactgatttagagccttgtttattatatatatatatatatatatatatatatatagttaaaaaaattgagatgattcgaacattataattgtaaagatcttgtggtgtaaaataatgtatgtaacatttaaataatatttgaaaatgctgtggttttgtgtaagttatttcatatgtgtgaatagcaatttatggtatatatgcttgttttgatgtttgtgatatatatctccaaatgacatttttcaacattttgtttgaaagtgataatatatagatgtttgtatatcacaaatgtttatttaacatttctcatttttgtatctattttatttatcatgcatgaacccttctctctttttctttctcatggcgtcagataatataaggtgtacattaacctttattcttattctaaacgataacgtaatttcatgtcatgatttagcagacaaacattattctttttattagaggggattaatacagggactagattttttgtgtgtagaagtttatttcatcgatccttcatcataaattcataatcacgtcgtttattccttacgaatattcttttgaatggttagttaagtgtaaaagattgaaagttatgcattacttctattggaaattatgattagagtgaggatagtgttggccagcagcgaaaacgtaaagacaaataagatactgttatttatactaaatcaattatagaaaatgttaacagttattcttaggatattagttaaagaattaaaaaagaaaaaaaattattagaatgtgtaaaattgtgttgtttataaaaaaattatgttcttttataatttttataataaatattttctcttcctaatttcttaatcaatattctaaggacattgattaacaataattatatgattggcttaataagtagtgggtctaccaaacgaggaaacaacacaatggttcgatatcggatattgttaattttgaggtttcattagttataagttttatttgaagttttagaaaattaaacttaatatgatctacaaaaccatagccttatataactgaaaagtaaaattaaacacaattttacgtgggataactgacagtacttgattcaacaaaaagaaaaaagctgatagaacttgaagaaatattttatagatagttatatatatatatatatatatatatatatatatatatatatatatatataagagggactaacgtaaaataaataaataaataaataaacaaagttttcaagaaaataatagtcaattcaatgccttaatcgttttaaggtgagcacgtcaatccagtaaaaaaaaaaaggtgagcatgtcaatctttaaaaatatatataatttttattttagtgaatgaagctcgtaatagtccttttaaaaaaataatgcattttacttaaaggaaataatataacttaattagtgaattttaaatatttgctctttttaattttaataaaaaatgtttttagggaatcgtggttttccctcatccactgtaggatcctacacaatacacatatgtatatgggtcagaagggagaaaatactagggcactatgatggcttttctcgtggaacaccgtcaccatgtgtttgtttaaccttaaatttctcgaatttccctatcaattttgaaaaatggaaacatcatgcattaaaaatgcacttcaattgttcaaacaattcaagctgatcgaggaacattatttttgggccccttacaatcacgttttgtcccacacttcccattaatttgttaccccaagttaggtgcagaaattctatattaatgcaacagttttctgtttcttttaacatgtttcaaggtagttgtagcaaatcatctttattattgttgaactacgtgtgcatagggatttcaaggaatggaagcacgtccactcgacataattaatatttgaaataaatgatgagtatgaaatttttataattagatgtttcgtgcaggaagtacaacagagaatcaagatagtagttgatatgtggggaccaagtggaagtcaaccttcagaagaagattatagagaggagatggcaaaaatcagaaaagctatcgttgatttccacggtgaaatggttctcttagtcaactacagcaacatcaattacacaggttttttttttttttttttcacaagcttaagctgtgcactgtttatactctaatcatacacagattacagaataattcattttcataacatttaatttaaaagttttatctaagtaaaatataattgtattgttgacgagtagtactgttcatgattaattacttaattttcacttgacacgtgattgagtcttattaacgtttttgataattgaaaaattcaacttggtatcatataaagattagttgagactataaacaagttatattttcgaattaaacaatagtttctttatatttaaggtaaattttaattggttgacgtgaaattattacataatataagattacagtctcaaataatctttcatgacacattactgatgtagaaactaatggggaccataaatgtatcagtccttaaccagtaataatttctcatgtttcacccttaaaactctctacaccgcatgaaaattaaagtccatgttaaaacatggtttgctattgattaaaaggctagcaaatgcattgctattgattaaaagtactttgatgcagctttctctacataatttgtaattcataactatttccatttgaatatgctaccttgaacaagtgacaaccctgaattttgcagggttggcaaaaattctgaagaaatacgacaagaggacagggggacttctgcgtttgccattcatccagagagtgctggagcagccatttttcacaacagatttgatctcgaagctcgtgaaggagtgtgagagcataatcgatgcagtgttcccggctgaggaagaagctgagagagcaaaggaagcaaaagaggcagtaacggtggcaggagaagggattttcagaaacacggttgcggctttgcttacaatgcaagaaatcagaaaaggtagttccacagagagccctttctctctgccaccactcaacttgccagactctgatctcatccgatcaatacagctcaatgttgttgttcccattgtcaagtgaaactagatgaaaaatagttaccacagtttaatttggtcagaaagaaatagatacttaatatagaacctgtttggatacaagtcataagtgttttttagaatttttctattggaaatatagaagtttttttagtagagaagctctcacaaacacctctagtctttgtatccaaacagactcatattgtgtttttagatatccgttccgacacctcaagcatctgttcgttttaatccatgtggagagaaacttttcggtttgggtacatttaaatgtgtgccaacagttattcaaacacatctatagtgttacaatgttacaattggatgtaagagtactacaatgtattagtaattaatgagtgatctcaatatatatcctttcgatgaagtaacacataagttaattataaaagagtagctagcaatttagctatttcaagattattttagtaattattgttagggtatttaaatttcatttcagggtgatatggtcaacatattgggttctctatgaattagaaatgaaataaaaaaaaacagttctctcatgtccattccaaggctttttgtttaagttgtcttgcccaaatcttataaataaaaaataaaacattaggagaattttgttctcttaattattataacttatcaaggaatctaatttaaatggttaagtaaaatatatgaactattataaatcttctgatgttattttcatttattacgtgatagaggattatccaacgatcatgaagtcttagaagcactccatgaagagctcaataacaaggtccaaagctatgctcaaggtcaaggagttgaagaacatcatttgattaactttaaaggacccatgacaagagctagaactcaagcctttcaagaccacataaaaaatgtcttatatcttgtggacaagcatgaagaggtacaccagattcaatgaaaacacaaaaaaaagttttgtctgttgtaataaacatttgttgtctgttttaatcgattaaatgtgtctgtaatcgattaaaatgcaaatgttgtctgtctgtctgttttaatcaattattttgttgctggaatcgatgatttgtctgttttaatcaattatttcgttctgtaatcgattaaatagcacagaatactctgttttaatcgattacgtttcgttttaatcgattattttcatttaaaatggtactgcagctttccttttgttgttttcttgtaataggctttgatattttcgtaaataggtctaaacttacgttttttaggggtttattagaggtctagccctataaatacccagactttgctattttgggttaacttttgattcatgaaattgaacttttgcttgaattgagagcttagcctcttgttggttcttgattgagaccaaattgattcttatcaatggaactttcatttgtggtgaatcttcctctgacttatcatttcgattggggattgtggcgttattctaaatcatttcttaatattctccatttttctatttgaatttcaaaccctaattcattgagtcttgaatattacaatccgaaaacaatccgaactaaacattcatgttttcgcagtcatcactacggacaaaaaaaagttcatctaacttagactaatctattattgcttagtatgtgttctacatacattagttatatcacccgggttctatattggatgctctgcatttgtgcggacacaaagaaagagtatttatccatgttgtctgtcctcatacttacactttaattatgcatcttttagcaattatttttttattttaattgtgctcttacgtaaaagattgtaagcatcctcaacgaaaaatattgtatatgacctattagcaaaggggcatgtgatggatccccgattctgaaccatgactcttcagaaatatctagcattatataagaacagaatttaccaaccacaacattggttagcaatttagagtatagatcctttaccttcatgaacttttcttagtctcttgaggagcacatgacgtcttccgagtaggaatcagaacaacataagagattgcaaccaatctctttttcaagtggcatcacaaaagcaagttgataaatggtggaatatatgagtcttataatttgagtataatatctatgatattgatagaatttttttcttttttgtttgtaccaaagatatttttcaatcaatagtagaaaactaatttcttttgaaacatagatatcattgaagtgacttttgtctttttcaaaatctaattatgttatatcttatttggtcatgacattgatagaataggtggccactatgtacactttcttcggttcttccatttggtattgaactattttgcttacgaaaggataactcttagtaaagagaaatttccttttgtatggaacaaaattaaagcttaaatatctgttcccttgacaaagtcaaagatttgaaaatttattagagcagaaaggttgacattgacaacgtgagtacgtgacaccagttccaagatataaatgtggtcccatatatcattttgttatgacttttgtacaatggacccaacaacaaaccttgttgagttttcatctcagaatttggaagcatgtaccaacaatttcagtcagagcaatctcattggtttgacacagtttggtagattgtatagaggcatccttgaaggtcaacatgtagtagtgaagatatgggatggtgaaagaatggaacagttaagttccaaatatgatgatgagaatttgattatcaaagcaagttcccaccccatcgcttgcacttttgtataaccttttttcttatattttttccaaatttaattttgtctgtcactgattttggaagctcaacgattctgttttgcaggaggaagtaaaattttggactaatccaacattgagaggttgccccaatttggtgaagttgattggttatacttgggagagagatgtaaagggaattgcgtatgatctcaatccacttgatactttgaataacgtaataatgaaaggtattaaactattaattactttatacaagctttgatgattatcaccttcaaatgtcaacggttaagggaaaaattcaaaactcgttttaattggagaataaaagaaagaatctctaacgggttattgccttttcattgttattgaatgatatgtataggtactaatccttaatctatgttagtacatgagaatttatcagtaaccaagttgtgggatcatttcaataattatttttggtccttgaattcttgagatataataggaaccaaagataaatgatttactttggttttctgatatgatttctttgctgaggcagataacctgaattggcttcagagaataaatgtgattcatgaacttgcaaagctcctgaaattcattcatgaccaggaaaagcaaaatatggtgttgaatatcagtgcatctcatattcttctcgacaaggttagaacattattatgacaataatcctcttctcagcttctgaaaattttatgtattgatgtttcctttttcatttgcactttctctgttttgtcaatcaacatgaacactcatttctgatgcaggattacaagccaaattttattgatttggtgttgcttagtgaagtgacaatgtcaactggctacatcgatccttatttttctctaaggggtattaattttttttatctgcgtcgaaaatgtttcctttcaatttgttttcctactatagtactctaaaatatgttattattaatttattaggacaaactttaggtataatattttagttatattcagtactgttcttcaatagagattagagttttacttcagtaaagattagtgctaattagtaaagtgaaactctaatttcagtgggagaataatattgaaaacaccttgttcttactttaagtacgctccattattaaggtcactacatctgggatattacctgttttgtctcttgtatgagcctcatggttttgtatttaaaagacacttcattgcataaagcgtggaacattttttgtaggaccttgcaggccatgtgtgtgacctaggcctttcttctagagctaatattatgacctcgagtcatctgcattgttaatatcattgtattcgagttattgtctgttttgatgctcatgtgggtctcatggaattgttcttaaaagacccttcaatgattcaagggtgtgacttttttggtaggacgtggccgagaccctcctgctaatgtttttacctctagtttgcttcattgttagaattactgcattcgatatattgtccattttgatgcccgaatgaccctcaagtttttgtctataaaaatcatttcagtgggttaagaaacaaaattgttcataaactatccttcatctccaattcaccattgttatgcaatataggatatttttggtgtaccagaagagcactaaataactgtctctaagttttgccagtttctattatcaaagcaaaaagactttctgtgtctgcatatatgctgcattagtgcttaaaccaaactttctagtcctgtcttttgaaaaatctttgatgttcatttaagttctaattgttttggtaaaaaaaaaataaaaccattcatacggtctatgatgtaagattgaagcctaagcatatatttataattaatacagtaatgcacataacacaatcctcttttcactcaatggcaggtggtgaatgggatagaagctgtgaagtgttctcatttggcattgttttgcttgaactaataaccaaaagagtttcagtcattgggaagacagaacatgcaagcataaacttggatggtctggttcatatttgggccaagaaagaatacaagccaaattgttctcttgtccatgaaactttgcaggaagattggtgttattatgcggaagacggtgttgcaataactttattggcattgcaatgcatagaattttttccagcaaaccgtccaacaatgagggatgtcttgcacaggctacttttggtgttacaacgtttggcggatgctagagccaccaaaagggaaaagcaactcatttcatccacgatacaaatttagcaaacttttgtatgccaaaaatgtgtgtatataaaaagttaacagcttttcctaactttactgctagtagggggagtatgttattttttaagcaattgagatttcttcaaatgttttaaattctaccatttcacttctccctatttcctctgaacctctctttccttccattcatctgacagtactattaaagtttccaataaaacacattccaaaaattgtctcttacgctcatcattccgggagtaaacatatacgatgaaaaatatatggagtatttaatgtcatgttccttttacaccaatgaaatcagtattagagaacgaataaatcagttaactgatttatccacccattctgaaaagtgtcaggactggccctggttatatacccatcctatattaaaaaaatcatgcactactcatccatactcggatctgaactcgataaaagtgattattttccgtcaaagtcaagacaagttcaagtgggtacccacaagttagaatttctttgccatgtagtttataatagtttaacccattcttttactagtttaatgacgtcaatatcaagtccactacatatctgatcgtaaaagtaactcgaaccaagttatagatccggttcccaattagaccagccaatctgagttggatttaatgacagtgccccattctctaatgaagagcaacaatattaatctcagttgtataagctagggtctcttcttcccttaaagctaagttgatattgacaatggcaaggtaaaaaactagagcttcctttcaattctcattattggacctattcaaatttttcacagaatcagacatagaaactaggggtaaaataacaaaattactttaacatgcacaatacaatatatgcataaccaccgtacatatagcatgagtgcatgacataagccccaagcaagctagtgtaatgagataccaactgcttccggtgttcaagtcttttctaaaaatactttaattctacacccttgtgcgtctaagataagcttttaaaacattcaagtggacacatacaccaatctgaaaaagtgtagtgacgtccttgtggtttggccaaaaaacaaagaccatgatgtcacttttttaagatccagtttaccaacaaaatcaaaacattccctttggaataaaatttggtttcaaattgaccatgttacaacgtgccagaactattgagaatccaagccatgagtagacagcacaccaaagctaataataagacaaaggacatgaaaaaacaaatgatcagttttcatcacatgtagtaaaacagaatacgccagaaatcccttgtagctcattttacctactcaaaaccttcaaaggcagggaacacttccaaatatgtgtgaagactatgttatgctttgactatgagtatatgtttccaagatctacctgattctgcaagaaggaataagcttacttaacagaaaaatattaagagttgtcttccttcctaatccccttatccagctcctcttcttttaagttgacaaaaaacattacaaattggacagtttataagttaatacttaattaagatttcctcttcccacacatacaatctcctcctccaactccaaacttcatttcaccactccatcatatgtgctatcatagcatttttaattatctaaggaaagctgatagaaccaaaataatccttgataccatgcatgagtcaagctgatagatgaattccaatcccttcttccaataaaagtcattagatcaaaagagtcatatttatgttgcagcatgatatgcgtctagcatataatgttttcaagctaaaataagcaagaatagaccaaaatggaaccataaccaacctcatttgtggatgttttgattgatttactccaattcacattgtatctcattttgtttaatttatagcaggaaaaccaagagaagaattgaagaaagcaaagatcaagaagccaatcttttctggaatctcacgcgagtagcgtggaatctcacgccaggaagcagacatagggcaatcttctctggaatctcgtgccagttgcccgagagatggcaccagtcgcgccataaaccttaaatggacagattttttctggaatctagcgccatcagcatgagatctcgcgccattcacgccaaagatttaaaagtcagcaattttcactgtgatgtttgtcattagcgccaacgatgcgggatttcaaaatcttaactgatattgcacaaaaatagaagataaggcaggttttgttaacctaaatataaatatggactgaggagagcagagatgggggggctggactacgaattaacataaaaagaaatacaagaacagcttggagagcgattgaagttaggtcaagaagattaaatcaagattgaagggacttacacttcttcctcttctcttttgagattcttagtttaggtacatcttgttgatgagattaaggacaaacatgattatgttgggctaactatctctattgtagttaagactaccatctaatatgaactattttgatattggattgaattctattattattttatgctaaattattttatttcactttgggttgaatgaattatatgtctttattgaaattgatcactttgataaagttttgagaattaaggtttataataggaatattgaggttttgatttctaacaaaagtggaataacaattgatacattacctaaggatagagatgtataattacagatgaattgatgcgtctcacttaatgcttgatcaaagaggaatcactaaggaattggggtttttacttgggttaaagtactaaggtattagtctttaactagtattcatttaaagaaacattatatgaataattagtataattgaatgtaataatcaatctaattagataagttgggatcaaaacagtgtgtgtatcttgactacaattatttctcataatttcccaaaatccaaatattgttgtctttgaattcttattaattctagttcttattctttaatttttatcaagtcaagatattaaaactcaatcttatcaatttttcttcatccaatttaaagaaaatagttgtgataaatttggtgtcttaatcctcgtagatacgatactctacttatcattttattacttgaaacgaacggtacacttgtcaagttcgcaatacaacaatttataccatacagtttgtctatcaactaggaatcaccacttccactttgaaagaagacttaaattagaaagatctatatttttaatagccaacctcacccaagctatctattttgcatcttcgccaacagaccataagaacttaagaagatatctttcgattcctatatcacagtatttataactttctttggagcttaatttgaaaaatgactagaagtttaatggtaaacttgagaggacaacatttataagaacaaattcttccacctaatgacagcaattttcctttcaaagatgccaatcattttttcacagattcagtaacaaatcaaacacgcatatagttggagacatcttcattaatattgggggggggggggggggggaatatgttgcaaaaatttcagacctcactaactataaaaaagaaaaaacttagaccttaccatactatatttctttaaatatttcgaaagaggatgagttgaataggaccttaatagctctagcacacatttaatcaggtctagttaaacttggttgcataatctggtgcaaaaatatatggagaagtcctacttgtttaaaattgaaagtgttggcattttcttagctggtgataataatagaccgaatcccaatcgttaattttgtccaaaagaacattgttggcaatcccagcccaatgatcaactttgtgttttctgctgtaattaatgaaactgattattttgtttacttgcttttaacctacaggtttgcgtaagtgatttggtccaaactttatgtatggctcgtttttagttcaatttttccttcaatcaacccattatctgtcacacctaggtctctttttaaatataaataattcaaacaattttatgcggtcatatgttctctttggttgatttatatataatagaattcgatttaggagtaagccttttgatgggatatagtgttgctagatttgattaaaataatgtctgaagtcataattttcagttagttcatttgctttaaggaaatgatgcatttgtccatttgattacgtcaagccctactgctagattataacttataatgatctcattatatatggattagcgtagctttgtattctcgtcatatattagttacatatcccgtatatatctacttttattggacaaatagtgtgctgtggctattacaaattggtgggagccaatgtgttatattcaccattttttatatgaattttttatatgatcacatgaagcataatctttttttttaatccaataatatcattattttaatattaatttgatccaaaagaggaaaaacatatatatttgacccaataagtaattgtttcaaatgataattgacttgatttatttaaataagatctcatttagagtcttacggattaaaaaatacataactgaaagagaatatatcataaaaaatgatcaattaaattctctaattaattattaaagttaataaatattttatactaatataacacaataatcaaagaatgtaagttgccttttctccgatccaacaacagagtgttcctctttttattgcttcgaaatatccaatcgtaatttaaacacactttagcaaatactcctttaatacttggttctttttactacaatggttatattttgtgtcaaaggcatcaaacaggataaattaataggtgattttggattatcaccttttcatgattcctatcaatttttatgtgacacatgattaaatctttaaaaaaaactaattaataacattttattacatatcatttataaattagtggatcatgaatcaagtagtgtgactcaagactacataatcatgctgattaaaaaaaaccagctaatactttctcatgttgcatccacatgtaacttcttaaattctaataaatttctatcaacaatcaaaaaagagcatttctaatattgaggaagtacgagtaccgtcactgccctatgcgtccacaaaacaaatttagatagtcttgaagctgggaagctgaagtcattatagttcccaaaaccttcaacacttgattttggagcaagtgataagccagcattagtgctatatatatccctatgacatagagaaaccataaatggttgcctggttggaagatgcacaataaggaggctgaggaaagcaaacccaagacaagaagaacatgtttgaggataaaagcaaagtggccactactgcaagccttaatgttgattttgaatgcaagaatcacactgtaaaagcatatggaagttaggaaagtccacatgtgaattgggtgtgtctcgaagggcgatttggtcttgttttgatactcaacttgaagggctccaaggaattgttgattcagaaacatgaacacttcatgcgatgggaatgcagcaataaccagctcttggtccttctttttagttgatgtgctacaaaaaatagataaaaagacataaaaatgttccagtactgaactgaaaaaatgctaacaagatattgtgcaatggagtattattttatttgtaagaatttatgataaattttctaggtaaacgagatgatatagtaataagactcaattcatttcatgaatcccgtacagattcgtgttaaattagcacattttgtatgaatttcaatcaagaataaaaacaataatatatagaaagatatagatgttgctgacattgttatttatgttttacaaataactagtattttttctgaatacaaatgtctgtagtgcatataacataacttaaatgttgtgacaggttggatcagataaggcaaaatatgagatagagaaaaataaaatgggagtaaaatggaacacagacaagacacagaaatttaacgtggttcggcaatgtgcctatgtccacgggcgaagacagatcaagagtttcactaaaatgaagaagagtacaaaataggaaaaataacactcaaaacccaaatcccaaatatacccaataatcctcacaggaatatcacacaaaattggatacaaaagaaaaatatagaaatgggtatttttcctcacttgctattttctctctcaccggtagctactccttactttctctcttgatgctcaaaccgaatgaagaacgctcctttatatagaattgcaaaatactgtgcctcatactgtgcgttcaataatttctgctttcggtgcctaactgctgcactgtgcatttgaaaaagtcaaaagtggctgctgtgctttcggtggaaactgcgcctacttcctctgctttttcaacaaatctcccctccagcagatatggggataaagcaataaactaaactcctcttcattaaaatttctgatacagtcttctccaagaaatcctaataacggattatggcttatgaacgccaaccaagttcgagcaatgattgaacttgattgttgtgataggctttgtcatcatgtctgctggattatctattgtggcaattttctcaaccttgatagatccatcagatataatatttctgataaagtgatatctgacatcaatatgtttggtccgttcatgatacatttgatttttggtcaaatgtatagcgctctggctatcacaatagacaactaataaactttgttctaagcctaagttagtgaccaaacctcgaagccaaatggcttctttcactgcctcagttagtgccatatattctgcctcagtagttgaaagagcaacggttgactgcaaagttgctttccagctaacgacacatcctgagagagtgaaaatataacctgtcagagatcgcctcttgtccaaatcgcctgcataatctgaatccacaaaaccaacaacactttcagaagtgttaatattgctacgatcgaagaccagaccaacatctgaagtaccccgcaaatatcgaagtatccatttcactgcttgccagtgttccttgcctgggttttccatatatctgctggcaacactaacagcatgtgaaatatcagggcgagtacaaatcatggcatacataagacttccaacagcactagcataaggaatacatgacatgtgttccttctccttgtcagtttgtggtgacaacttcgctgataagcgaaaatgcgtagcaagtggtgtacagactggcttggaactttccatcccgaaccgctcaagtactttctcaatatacttcttttgagataagtacagcttgcctgctttacggtctcgatgaatttccatgcccaaaatttttcgagctgcacctaagtccttcatctcaaactctgagttgagctgagatttcaacttagaaatttctgacatgttgttagcagcaattaacatatcatccacatataataatagatacaaaaatgaaccatcagagagcttcctgaaatacacacaactatcatagttacttctagaataaccatgatcaatcataaaggaatcaaaccgcttataccactgtcgtggggattgctttaacccatacagtgatttattcaacaagcaaacatgatcttcttttccctgttcaacaaaaccttcaagttgatgcatgtaaatttgttcttcaagctcaccatgaagaaaagcagttttaacatcgagctgttcaagctccaaattatacaaggcaactaatgcaagtaaaacactgattgaagtatgttttaccactggtgaaaaaacttcattgaagtccactccttctcgttgactgtagccttttgctaccaagcgtgccttgtacgtagcatcttgagctccgggaaatccttcttttcttttgaagacccatttgcaaccaatgatcttttggctctttggcggtttgactagctcccatgtctgattcttgtgaagagactcaatctcttcggtcatagcaacagtccatttagcaaattctttgcttgtaatggcatcacgataattggaaggctcctcttcttcgaatgattctgccatagtcaaagcataagcaactagatctgcataagcatacctttgggggggcttgatctgcctgcgttgtctccgagcagcaatagtgtcttgttgcaatggtggtgcttcctcatgttgcacctcctcttctgtgggctgttctgtagttgcttcgggcatcgtttccgaagcatcaaattgtaactccacctgatgtttgtcactttcactacaatttgcatctgtatcaaatgaatcctttttctggtgaagcataaaagattcattgaaagtgacatccctgctgattagaaacttgggtgacttaggatcaggacaccacaacctgtatcctttcaccccctgtccatatccaagaaagatgcacttcttggctctaggcttcaattttccttcattgacatgagcataagctggacaaccaaatattcttaaacaagaataatcagcaggtttacctgaccataattcctcaggtgtcttacattcaatagcagtcgatggagacctgttcaccaaataactagctgtgttgactgcttcagcccaaaacttctttggcagacctgcagtaaagagcatgcaacgtgctctctccaaaagagttctgttcatgcgttctgcaactccattttgttgtggagtacccttgaccgtacggtgtcttacgatgccttcttttctgcaaaactcattaaattctcctgaacagaattctaaaccgttatcagtccgtaaatgcttcacctttttaccggtctgattttctatcatagccttccattccttgaatttctggaacacatcatttttattcttcaaggtataaatccagactttacgggaataatcatcaatgaaagtcagtaaataccttgcaccactgagagagggaacttgtgaaggaccccatagatcagaatgaatgtaatctagagttcctttggtattatgcacaccagtaccgaatttaactcttttatgcttgccaaaaacacagttttcacaaaagtcaattttacatgttttctggccacaaagcaaaccgcgtttgcttaattcggtcaagcctctctcgctcatatgccccaagcgcatatgccacagaagggtagtgtcagaatcaggatctactgttgaggatactgaagcagagccataaactgtatcaccctgcaagaaataaagaccacctcttcgttttcctttcatcacaatcagagcacctttgacgactcttaacgttccatcttcagcagaaaacttacagccaattgagtcaagagtacctaaagagatcaagttcttcttcaactctggaacatgccgaacatctgtcaaagttctcacaacaccgtcaaacatcttaatttgaattgtacctatcccaatagttttgcaagtcatattatttcccattaagacagttccaccatttattgatctgtaagtggtgaaccaatctttatggggacacatgtgataggaacaacccgaatcaagaacccactcattttctgagctataatcagaaacagtgactgaaagaacattatcatctgaggaattttcctccacaattccagcaacaacagaagaactttcattattattgtcccttttgtcaaatttattatttttcttcagtttaggacaatcccacttagtgtgccctttcttgtgacaatagtaacattcaatatttttctttgatctagattttgatcggcctctatttactggtcctttattttgactcctccccctcgcaataagaccgtcaccaatttcatcggtgttattgccagaaaccttttttctcaattcttgagaaattaaggatgccttaacatcttccatgctaatggagtctttaccatagagcaaagtggtaacaaaatgctcatatgaagggggtaaagaacataataaaataagggcttgatcttcatcattaattttaacctcaacatttctaagatccataattacccgattaaattcatcaacatgttccttaataggcgtaccttctttcattcgaagtgtgtaaagactttgtttgaggtacaacctgttggtgagagattttgtcgcgtagagactttcaagcttctgccatacaccaagtgcagtgtcttcttccaccacttcgcataacaccttgtctgagaggttgagaataattgtactgcgagctttctcatcaacatctgtcaactctgcagcggatggcgctattcttgttgcagttgttgtgcttgtagatgcagtgtcatcagctgacaatctttctcttggcaaaagtgctttttgtagtccttgttggaccaaaatagcacgcattttaactctccataggctaaaactaattttgccatcaaacttctcaatctcaaattttgccgccatggtgttggcgatactccaaatagtaactgctccggatcacactatttttctgtgaatagtgtcgtatacgtgaatagtaccgtacgtataaacagtaccgtatactatatcatatgtatgaatagtgccgtatactactgttcacagccgccgtaatagtacccgtgaatagtatgaatagtgatgaacagtacgaggtcgtagaaatgcatacgacttccttccaaaaatccaaccagtatgctctgataccagtttgttgtgacaggttggatcagataaggcaaaatatgagatagagaaaaataaaataggagtaaaatggaacacagacaagacacagaaatttaacgtggttcggcaatgtgcctatgtccacgggtgaagacagatcaagagtttcactaaaatgaagaagagtacaaaataggaaaaataacactcaaaacccaaatcccaaatatacccaataatcctcacaggaatatcacacaaaattggatacaaaagaaaaatatagaaatgggtatttttcctcacttggtgttttctctctcaccggtagctactccttactttctctcttgatgctcaaaccgaatgaagaacgctcctttatatagaattgcaaaatactgtgcctcatactgtacgttcaataatttctgctttacatgcctaactgctgcactgtgcatttgaaaaagtcaaaagtggctactgtgctttcggtggaaactgcgcctacttcctctgctttttcaacattaaaccttaataaaagcatttttaaattgtttaatactcattacttaagcgattaatttgtttattgatgcttctatgttcttctttctcaagaatgtattcataaaataattcttcattagtggatgatgacaaatattgctagctggggaaaatgaaaagatacaatgtgaaagccacaaaagttaataatttttgtccagagtaagatggctagcttcttttttttttttcaatgatctcaaaaattaaagcgtacaagaaaaatggctgaatgaagtatatgcaagtgtagtctaaccttgaggttttctttggtttaacccttagcgcaaggttaagtcttctggctcttaacctgtggattggaatatgaacatgcttatgatcaatattatcctccactctcacctcgctgatctcaaacttggatctttccatattgttataatgaaacaaacgtttgtccacaagagaccatataaatagatattaatgaattatgcatgttaacgtttgtggtttccacctaagcaaatatgtagcgactttgtagtaaactttttacatgtatctcagctgactttgctcatccagttccgtaagtagctgttttgaaaagttaaaaaaaaaaaaaagaaattaataacttaaaaattattttcatttgaatgttattattattttttcatttttaattaatattcaaaaaaacatccactgatctaaaagaaactcattcactgacgacgttatctctttttatttattaatgcttatggcatacctcattgatcttgacactttctaattactttccaaaacttttcttaggccggttatcaaaattaaaaataaaaagtattcttacgtgagcatttttaggtatcatttatcttgataagtctaaattacgtagtcgagttatttaattaaacccaacttttaaaggtttgtcgagtgggaaatgtgtgcaagctaggtaacaaatattaggaagtttcatattttctgtcttaatttttggaatataatttatatatttgttatacaattttacttagaaccaattagttttaagttgaaatctaataataaattaatatcaatgagaatgtataatccaataataaattagtaatgcttctactatggctgttgcctgttacatacaatccaatatttgaaagttattgaaatagtgtttttaattttgagaaagccagacgaaacatggccttctatacaattagtcctataattgatctgatcgatcgaagcttgtaggatcgatttaaacataaacataaacataacaataacaataacaacaacaataataataataataataataccaaaaaaagtaatgaattggagagttaggttttcaaaaataaaattgcaaattcaaaatttgaaagaaaaaaaccagtgtacgtcataaaatattctctagtcaagggcttttatatatctcaccaatcagagtgtcataaatgctagatcctaatatattatttgtcttttgtattatttcaacatcacctcatgggaagagaaaaatacacaaataatcaagacattaatttttttttctaaaaatgtaatttatcttctcttattttgttaaattcacaattttagtctctttattttttaattgagatatttatccttcacttttaaaaaatctgtgattttaatcgatcccctactttttaattgatacatgttgtctcttacttttaaaaaatatgtgattttaatccccttaatcattttcacacttgattgtgtattatattaattctttttttttaataaattaagatcattagcaattaaaaaaaaatatttatcatatagataataatcagacatgtattacagaatacttggaccaatgtttgaaattggtcatagaggctaaaattatagattttttaaaagtgatgaacaaaatgtctcaattaaaaaaatgaaagattgaaatcattaaatttttaaaaataaaagataaaatatgtcaattaaaaataaggagaataaaattattaatttgaaaaaataagggaaacaaaattacatcttaaacctttttatatatgtataatcagactaagactgccgatatctatttactagctacgatcgagcgtatgactaatgcagattaagtcaaatactaaaatttaattcaaaaacactaatatcaattaggttagagttctaaaattaaggttcaaatgatgttattttaaattataaattttctataaaatgtaactatgatgctgtgtgaacaaaacttgtacattattatccaataatatattctcaccctatttaatgagtttgacatttcatatattggctattatacttcaatttattaagtgaaaggccccatacaaagttttaagaaaaaaatatgagttaaactctttctattggagagaagatgttgagatcctcatataatgcatgtccggaaaaggaaaaaagaagcatcaatttggacttttacaataataattgttatggatttaatatatggacctagtagtgttaatcatataaagttccattaaggatccaatgtctagaatcttaacaataatcaagaagatctaaacaaacgaatatcgagcaaatcgaaaggaggcatcaactaattcagaggtaacttatttataaataagggttacattcatgaagaaaggtacatgttctctctactctacttttccattaacactatacacacacctcaccttcattggttggtattaaagtgcatagtgatcaatattcttaaaggtatttttttcataaataccttaaagagagcttttgattcaacatcaacgtactaattaacaattctgctagacactcttattcataaaaacagaataatagtaataaaaaaaattacgaaagtagggttgcatggaaatcatttaggatttatggattatgttttacatgttggattcagcaaacgtcatcctgagtgaaatattgtttttgtctttcattttttttaggaagtgccatcctaagtgtagtactagtcatggttgcatagcataggggaacaggaggcatcatcctaaatggagatacatgatgcaccatcctatatgacatttttagtgcataattgttattgttgttttgtaaaaattacgtgtcaaaaggttaatcaaaatctacatggataagaaatgaaatagacttcatggaatcacaacatagacaaacaggtgaccatttcaggcattgataaacacgttgtcgacacgcaccaaaacaattttactaagttaattctgtaccacagagctaacttaggtcgactcagagacacagtcaatatggttctagtttcaatttacaaataatagtgagggaggaattttatcaaacagtttgtgtgcgtaagtaaaacttgcaaaaaggtaaattaaaattaaagagcaacaacacagaactaacagaattcaaaagaagtattctaaaacagaattaaaacatcaatccaattctcctcactaagcaattcgaattatcattgttctcagaaatttatcctattgtgaaagatcattcaatctcattagaagcaactcaatcgaactaacccctaaattgattgaaactacaaccctaactgaaatatcatccaattaatctgtgattaatattcgaaattaggaaatgaatccataacctaatccgttttcaacactaaacgcattcataattatgaaaatagaatagcaattgaagaagaagatgaacattcacatagtattcgaaatattaaaccagaactcaaattctccttgtgcttgggttggatccttggattgattgaggatttagccttccatgatcatcatcagtgaaagccccatgaaattattgcacgagaatggaagaaaagaaaaacgaaaaatgaagaacaagcaagaacagtaaagagaaaatgaagaacaagggtttgattctaataactaaagaaaggaaataaaaacttgtttattgaaattgtaaagtgtggtgcccaagttttactaaagtcactaatatatgtagtgactgagttttgaaaataaaatgggtcacaaacaaacccaacaatctaattatttgctatttacaaccatgaaagtcaaattcgcatcccaaaatcactaatatttgctattatttacgccatcttggatgacacatcctgtatcaccatataggatggcacttcttgctcacctttggaatgtgacaatgattggtcaaagctttgaaaacaatagaagacaccatacaggatgacacttcatgatattacatacaggatgacatctcttgtataaattttacacttgttagcattgtaatgtgattctaagcctagggctggcaaagcaaggcagcccaacccattttggtctatcttgccatttgcctgccaaaaaactgggcaggttagtacgccatctaatggggcaataaatcttggctcgccccgcttaggagttggttggtgggccaacataccaaaaatgaaaaaaaaaatattatttcatataattaatcaaaatgaataaatttagttagaaaacataaagtatatcaattatttatcctaaaattgattttaatatgaattttttactagtattagagaaattgaatttataaaataatataataataataaatatgtattttgatttttgagtaaaactataaacttaaaaatagtgataatccaaagcttaaacacctattagtaattatattttttaaaaaaatataattatgtatggtggtcaacctgtcctgcctcattgttggcccatcaagtttactagttaggtgagatggaccaatgcaaattgatggattaagccacctaactgatccgttggctcaaggccccattgtcaccctaattataccacccaggatgtcacttcctataaaaggacaaaagatacaagcaagatatcacttaagatggtatctgtggcaaaaacaatccttattcaataaataatttttatactgttataaaaatattattactgttttcgtaaacaaaaagtcattcaattcgtggctttataccttgtgtgccttaaattgaagaactatcttttgtgccatttacacctaaaagtctaactcaagttcgtctaaattggcaataattgatttataaaataaatataaatgataaatttaaattccaaacttttatttaattttataaatattatataattatctttcttaaaaaattaataatttatctcgtcgttttgcgttctttaaatatctacttccgaacatattcttttttaaaaaatctctagaggataacttgaaatggtatatttatatataccattttataattataatgaccataattaggctttttaaccttttaataaattaagggagtttatctcaatgatatgtgaaatgttgtaaaaaattatatccatttcaatttcaatagataaaaaaaaaaaaaaacttttcgtaagacccaaagtatatttgcaaatataattattacttgtgattctttggtgaccttattatgattttttatgacttattacaactcattcgacaatgattatttctttataagtacaataactcacatattttattcaaatatgacaataattatttgagttagccttattgttattatatgttttttgtgcgtctcattggtggcaggtaactcaagattgaaatgaccaaacagattattgaaacctttatttgatttttgtttttgacttgtaaaacaaaatgttacaatttgcaaacctataaatctataatgtccattttttttcaaaataaattgatatagtatttaaaatgtcaaactgataacttttttaaaattactaattaagaatggagtattcaattaagattttaaaagaaattttttacataataaagtcatgtagatttaaaaagattttgtaaaaatataatgatttttaagattttttttaaaaacttttataattagaattttatagtaaaaatttcagtgaatttacaaaatatgaatttataattttttaaaaaatttataaaatttttaaggatttcacgaattatcaaatattataacaatatttatgataggaagtgagtcctaacaatagttatatttaggcccgattaaaaattgtgtctatcaatttgcttcagtattgaaatactctattgttgaagattgaagttcaagaataacgaaaatatttttttaatatgagataaatcatactttttttttactgaaagggtgaatcatatttaagagtactaacaaaaacataggtgttaccacgtctatatgtctgtatttttatttcactatcacatttattgctaaatttgatatattttaccatatattatgtattgatatatacattaattttattatttgtactaattattatttattttgtgaaatttgatatcttataacatttttcttttattatgcattgacgttttggtttaatatttttcctatatattatatgtttacattttttaactatgtatgcctctattgcttattgcttatggtaattattcactgtacacaagtgtaaacatacataaaaaatgatggaaataaattaacctaaaaaaagacaaaagtaagattagattgtcgattgtagacaagaaagaagtgtgtgtccaaataaaatatgcaacaattatacaatatgtgtataaattaaacaacgtccaaacctccaccatcaaataatttgttaataatatatttgtaaagaaaggttataagatagtatataatctacattacccatttgatctatacatattctatacattgtatgtggctataaacaactaataaatatattttttttgtttgtttttgaaaggcaataagtatttttttgttaaataaaaatatccataaacatgtataaattaagagatactctatatctataatattctatatggttatataataatgtccaagtctccatcattaaagacaaatttataataatttatatggcataaaaattctatgcgcgattctcttgttgtactcaagctaaattacttaacacttataattaaaaaatagtatttaatattgttttttatctctgattctcgcaacttgagtcatgaaactacataaagaaaagaaaaattaagcatgtgatagaagaaatgtaagaggctcacatttaagaaaacaaaatcaaacaaaaacttaaccggagaactaaatttctatctttgctacgtgcacttaattcacgtgtaagtttaagaaagaaggttacactcaagtatattattattgacatctcaaatcacacatgcatagaagtttaaaagaaaaattataagatactaaaagagagaaaaataataatcattcttgtttaaaaaactgaaaattttcaataaaggacatgttggtgtttcagaacacacacaggcgcgatttttattttttttttaaaaaaagatagtataaaattaagaagcctaggtaggtttttaaaaattagtagatttttaaagtttaaaaaaagacagtttaattaacaaattaacagattatttaatttaagtttaaaaaaataccgactttagaaggctcacattttaaaaatagcaatttattaaactatataccgactttggagaataatttttcatggactataatttttaacaaataaataaattgatcagtgtatctacaaaaacagaatattaggcatcaacattgttaacatattgattgaaaaagaacattagcactcattcctctatgatagtggcgttgaaagctagtgtttttatatgttgtttcgtctttgtattgtatctcatcaatatgacaaattgatttttggcttgatagtagacttcccctaaaaactaaaatcctagaagacttttgttctgaatccaaacttagtttctcatctaccatcggtagatacactttcagtcaataaattataggggggggggggggggggggggggggaagcactaagcacacacaaaagttaaagcctcaatacacatgacttctcaacaaagacaacttcaacaatagaaataaataaattttttatgcttatagaaataaatgaatgaataaaaaattcacagtctgatgcatcaatttttctaagaaaaataaaatattaatacatattcaagaatttcaacaataaaggtttttcttgaattttgggaaagtaaaaaagttaacaactttagaaacggtaaagaagaaatgttactcattgttgctcttgtaaaaacttatttatgcattatggtacatagatttgggtgctgaatcgtgtgaaggttgatcagatagagattttccttgaggtctgcactcttccattagattttctttcttgattagaaaatggagatttgaagaagtctacggaacattacaagaaagacacaacattaaattaacggtaagcatgaagaattttgaaaatggtagaaagttttggaaaaaaatttataacaaaagtgcctgagaaaaactgagaaggaaatgtcaagatatttatttacttttgtactctcgactatgtgagcatatatggctaacaattagtctgttccaatggcgacaaccgcgtaaacaatataattagagaggggttgagaatgctagaatgggagttcacgcgcattgtgtagagggcagttacataaacaacaatataaggcttttaaatcgataaaaaaaaaaaaaaaattacacccatgtaaaagaagaggcttagggtgattagtggtttttaaaaatagttgaaggttaaattaaaaataataaatatatatatcaaataagataattgtctttattaatcaacaaatcatcatctagtagtgtgagtaaacacaacccttgaggctgccattaagatccccaaagagaacacaactaagacgaagagtgaccacaattaaggcaactttgaaacaatataaaatcatttagaagcctctgctaataggataagcacatgggataaaaagtaattacttggttacctttgtgaatgaccaatcatctcatttcttttccttcacagaggtttcattaacagagttttaataaaatgtcaacagaaaaagagacagagagagcattagcaggtcagatgtgacatacaggattactaagggaaatttgtgagcatatgggatatccagaatggctactaattgatcaacctggcaatacaatgatacacatctgggtattctaagcaacactaaacagtgatactacaggaacaaaaagattgaagtttgcaccacacatgatcaaggtccaaggatatcaatcgggtattcttcttcaaactggtaggaattgttcctgagagtgtgttgttacgaatttgtaaagactgcaactctgccaaggaaaccatggattggggtaagttcccaacaaagtggttgctttgtaaattcacatcctcaagaaatggccaactcatccagcaatcaggtatttctcctgacaaattatttgatgcaagattcagaaattctaattgcattggcttgtgctgatttttacataaaaaatcattcatggattcagagaatgaattacttgaaagatctaacccatacacatcatttgaaagatagggtagtttaccacataactgatttctgcttagatcaatctacattttcaccaaataaataattacctccaaggtcaaggtagatcaaacaaatatatttccaatgcctcatccctcacaactaatgcattttctagcacgtgaaggatgcctaagttcaggagagcagtaactacatgctcttgggtgccagcatcaagtgcatagaggagatcaacaaggcgggggatagcacccgcttccgcaatcaaaataatccccgcacacacacaacaaacaagaaaaacaaaacattgtgctttctagaagtgcttaaaccacatgaaaatatagacaagctaggactaagaaaatgaaagccaaagtaccaaagttttgtattataatttatgacccactatttctttatccttcatttactttttgctgttttagtaatcctgtatgaaatatgaggattatttttaacactacactttacagcagcaacaattttgcagtacaaggttttgtcctgtgctcaaaggattactgaacacaggaaagcatgagccttaagatcaaatcagcttaatgttttggtttagatttgagtgaggggtggttataatattgcaaagacgatacccaatcataattatgttatggttaattggtaacaataagtattagtatgtggtaagccatattttatttaattctgcacttccatggccagtttccatatttcctttaatagtagtagagtcgtaatcctaaaaggattatgacttattcagttattcctacctaaggcagaataaaatattggtctgttattcctacttaagcataacaatccttttttcccagaaaatgaatagcagcataatgcaatcctattgattatttatttcaatcaaaatctatcctgcgtgcaaatcctatgattctagctttgatgtcatggtttattttcttctgcttcacgtttacattttcatcaaatttcattggtttactaacattcacccttaattcggggacacagcaagactaattaaaatttaaatcacagtattactgaaaattaaaagggtacctacttttcacccttcacagcaagcatagcagccatgatgtcactatgtccagcaataaattttgtagctgagtgcatcacaatatctgcagcacaaaaagtactagtcagatatactttgggttgaactaggcaagttgaggtgttcttaataaagaatgggttaagttgatttcctctgctggttatactaactacaagataactccagtcttgggcttaaggtctctcattgagatctatccatagtaagtgaataagatggggccagccctctatagactagaatattgattgaatatgtaacaataacaatagtttggactatatttgtgttgttggaacactggcaaaaaataaataaataaaaaggtctgaggataagtatagtttgtgtgccataatatgtaccttaagatccacagtgtagttatttgttaattccccactatgaacaatgattcgtagttgtgcactagaattatctttgtttaaagggaagtccgccagaagtggttctaaagcccgtaaaacaatggcatgccccaaccacatgcccttatacaaaaattgactgcccattattgcaataattaaatcttctgggccacagcccatattgactcgcaaattatctttctgtaaggccataaatgcttctgcttctaatgtttcgacaggggaaccaggaatgacataaaaatttccagcatcaaatgcagagtaaatcatctgtggaattacataaaaacattaaggtgccatacttaataatgtctaaacatagtgagattttactttgacaagtcagttaacaagttatcatatgttagttaataactataaccataacatttatttattgtagaactaaactcaggataatagtatgttagtaatttagtatgcaatatgaaacgtatttacatcttgtaaatcagacttattcctaaataaatgctgaagatgcagttaacaatgagaatctttaatccatccaaccaaaacagtagcattttctttgtcagtaatatattaagaaacatgccaaagtaaattcacatgaattcagatatactaaagcaaacacaattgcaccatactattttcaatattcaaatattataaggattaatacaaatcattaaaaagacaaacttaaaagatcatgtagcattctttttcactaactgaatataaacataactaaaggataaagaattaatcaagattgtaatctggttatataaaaacaaaaaattatttgactctaattttccaatgagttgcgttgtgtatacctaaaaccagaagtgatagaaaaccaaaatgtagagaagatatataaagctcgaaaagcttaaacagactgtcattttatcagctggagttaccacttggttcagatttttagacatttcaattatattgtgcaaaatgcatagtccaaaagtaaaaattagaataacaatcatactttagccagtctacaatgttgttgcgcttatcacaagttctaatgacagtgacaggaactcttaaatttctccacacattatgccctggaccatctgcaagtgaaaagacctgcaggacattgaaaatatttgagctaaaataaacataatataaataattaaaaaatattgaaaatgatgtggaggcaaacaataacaaggaaaaactcttaaccactaaaacattacttaaacaataaactagactccaacttaaacaatccaaattcaagcaaaacctgcccccagtttatcattaaaaaaatagaaaacatgctgaagtaaaccacatgcacaacctacaaatccagcgtctaactatcctcacaatgagcaacaagaaactctctaaacaaacaccaataagtataaaaaaataaaagataaaagttgaactaaccaatgccaactgaggcttcctgtacccaaaatgctgcactgtgtggttgaagaaatccacatctctaccccccactacctctttttacagtactggatgagccgaagtactaataacacatttctgctaacacttctttattacacattccttgtttattatttttaattattcagttaacaataaaaaatatgttaatacatatatattaaataggaaaaaaatgtacatacaattttataagtgttgtacttgtatgtattattctctaattaaaataaaattttcacattgatagtagtacaaaaaaaaactattttcattacagaactatgtatagtatttatgtaaaactctaattctaattgaacagtaacacatacaacacttatatgtgttagacaaaatttttatgtaaccaattaaacttttacatggagataacaaaaattaattaaatacttcttaatatcaaaaagatctaactcaattaatatatatatatatatgagttattataattttttttagattttttatctcgatctataaataaaaaatattcattactaacttaggaagactattaatgaaacacttacctacctaaccaaccaattaaaccttttttttttatccatatctaaaagcaagacttaccatgatatcatgcgccctcatgctgagatacatgtaaaaagtttactacaaagtcgctatatatttgcttaggtggaaaccacaaactttaacatgcataattcattaatatctatttatatggtctcttgtggacaaacgtttgtgtcattataacaatatggaaagatccaagttagagatcagcgaggtgagagtggaggataatactgatcataagcatgttcatattccaatccacaggttaagagccagaagacttaaccttgcgctaagggttaaaccaaagaaaacctcaaggttagactacactgcatatacttcattcagccattttcttgtacgctttaatttttgacatcattgaaaaaaaagaagccatcttaatactctggacaaaaattactaacttttgtggctttcacattgtatcttttgattttccccagctagctatatttatcatcatccactaatcaagatttattttatgaatacattcttgagaaagaagaacatagaagcatcaataaacaaatgaatcgcttaagtaatgagtattaaacaatttaaaaatgcttttattaaggtttaagttatgttatatgcactacagacatttgtattcagaaaaaatactagtcatttgtaaaacataaataacattgtcagcaacatctatatctttcgatatattattatttttattcttgattgaaattcatacaaaatgtgctaatttaacacaagaatctgtacgggattcatgaaatgaattgagtcttattactatatcatctcatttacctagaaaatttatcataaattcttacaaataaaataatactccattgcacaatatcttgttagcattttttcagttcagtactggaacatcattatgtctttttaactattttttgtagcacatcaactaaaaagaaggaccaagagctggttattgctgcattcccatcgcatgaagtgttcatgtttctgaatcaacaattccttggagcccttcaagttgagtatcaaaacaagaccaaatcgcccttcgagacacacccaattcacatgtggactttcctaacttccatatgcttttacagtgtgattcttgcattcaagatcaacattaaggcttgcagtagtggccactttgcttttatcctcaaacatgttctttttgtcttgggtttgctttcctcagcctccttattgtgcatcttccaaccaggcaagcatttatggtttctctatgtcatagggatatatatggcactaatgctggcttatcacttgctccaaaatcaagtgttgaaggttttgggaactataatgacttcagcttcccagcttcaagactatctaaatttgttttgtggacgcatagggcagtgacggtactcgtacttcctcaatattagaaatgcgcttttttgattgttgatagaaatttattagaatttaagaagttacatgtggatgtaacatgagaaagtattagctggttttttttaatcagcattattaggtagtcttgagtcacactacttgattcatgatccactaatttatatatgacatgtaataaagtgttattaattagttttttttaaagatttaatcatgtgtcacataaaaattgataggaatcatgaaaaggtgataatccaaaatcacctattaatttatcctgtttgatgcctgtgacacaaaatataaccattgtaataaaaagaaccaagtattaaaggagtatttgctaaagtgtgtttaaattacgattggatatttcgaagcaataaaaagaggaacactgttgttggattggagaaaaggcaacttacattctttgattattatgttatattagtataaaatatttgttaactttaacaattaattagagaattttattgatcattttttatgatatattctctttcagttatgtattttttaatccgtaagactctaaatgagatcttatttaaataaatcaagtcaattatcatttgaaacaattacttattgggtcaaatatatatgtttttcctcttttgggtcaaattaatattaaaataacgatattatatagaatgggagttcacgcgcattgtgtagagggcagttacataaacaacaatataaggcttttaaatcgataaaaaaaaaaaaaaattacacccatgtaaaagaagaggcttagggtgattagtggtggtttttaaaaatagttaaaggttaaattaaaaaataataaatatatatatatcaaataagataattgtctttactaaaagttatagataacttcctattatttttatataagggaagtcgtacgtataaaatacaacgtacgtagtaatttttttttttaaatggcaatcttcaagacaaaatagtttagtataaaataactaattcctcttaaaatactaatttgtaggtgttttccccctcccttccgattgcttcccttgaaagtgaagtctgctctatcctatctctccgtgaagagactctttttttatcagatgttgttgtaaaattatatatcaaattagataattttagttataatttatcaatatagataattttgactcaaaaattacccattttagtaaattataatcgcagtcaaaagtcaaaaagtcaaaatcacttattttttgtaaatgaattttcaaaccacttaatccagtatataattttacgaaattatctagttagataaaaaaaaaagtcttgctaagatgtgaaatttggaaaacaccacaataattaaaattatatatttaaatggttttattagtataacatttcaataaaaaaattgaaaaggataacatttcaattaatatatattagattagatcatctttatctcttgccttactttgttttctataatttttatacaaatggctgcctttttaatttcatttcatcagcaaagtacttgcatgtcctccaaagtagtcaatagcatgaatgtatgatgtggttgttttagagagtggaaagggggaaggaaagtaacaagttgctgtttcctctctatttcccccaaagttgtctagaaactttttatttctatgtcaatgtttatgtttctcttaagcactatatatcattgattatataagcacccatttgcaaattctgctctgttctgttaataacttttaactttctaaatttttttgttcctctggatcaacaactttcgactttaaaaatacatcatgttcttttgtttcaatataatgtgacgccatttaaaattatgttttcttttagtcaatactaattttttgagggatgattaaacaaagaatttgatttttttatttaactataaaaataggcatagacgtatgctaaagaatatagtaatgtttacttgactattttagtcataattaaatgtcttaatttatataccttaacacaaaatctcattaagtaaacctaatacataatgtcacattttatgagcatatgaaattttggatagataaaaagaatgtatttgaatataattgttttatagttactcttacaactattatttttatataaaaaatattacttttatttttatggattttagctaataaattctttaggatactttatttttcattcatttatataacgcaagattctcttaacttcaagaaatctatgataataaaaaagaatgattacctaaatgattggtcctattatgattacttgcgcaatgcataaacacaaatataaattagcatgatataaatagtatatattagttttaataatataattttttatactgtcaaattaaaaaaaataagactattttaatataaaaaaacttaatcatcattcctataaaagttgtatattaaatttaaatttaaatataaatatctaataatctcttgacataaaaaataaaagattataaaaaaattaatcactcaaataaatttatccaaatatgattactgatgcgatttgataaatataaatatgaattaatacaatataaataaaatataatttttaaaaaattatactttaaaattactaaaaaaatgaaagatattttaatatataaaaatataaacatcattcatatataaattaaatttgtttttcaattttgttatttgtgttaataatgtcttttaaaattccgtttccttttagtcaatgtctttgtcagtaagtcgtgtaattttctcacaaatggaatggagtcgtatgctcgaaggtggtaatctcttcaccatttaattgaagatattgaataaatgtgtaaaattacttaaattaagtaggcttaaatatatattttttcatataatttagtatgttttcatcttcgtttttattaaaaaaatcattttaatctttgtaaaatgtatttttcaccatttaaagcattttttattattcaaaatgctatgaaacgctttaaggaaaaaaatattttacaaagaccaaaacaaaaagaaaaggaacaaaaatgaaaaaaaaactaaattatagaaagaaaaaattatttaagtcaattaagtttaatcttgtaaaagcaatgtatgctttacaacattttaactatggtaattggtaagtatattattgtcaaaaaaaaaatggtgagtttatattttattaaacagaattcgtgttaattaagagtccaataataaattatggtaaatatgatttttaattagtttttattaaagacattagatttagcatacatgttaatgctaatttctaattggataacagtataaaaatttaaaactatttacactactaattcttgaggaggatgtctttaatgaaatgggattctataaattgtttatcaagtacttgtggatgaaaacattgaaagttgaatatttgtgataattacattttggaaaaaccttgttgtgtctttagattttattaacagttgtgcatggatgcattaccctatccttattttaaccaaattttaagaatggttattttgtccctaaaaaaagaatggttattttgtaatacaaagttaagttaaaagaaaaatatgtcgttatattccatacttacgcaatccaactcctgttttatccatttcaaatcatagatagttaagaccttaatttcgttgggttctttttaaggaaattccgatggtttagtcactacaaattacacataatgtaaatataaatataaatattataatctttatataaatataaatcaaataaaaataatgttaataataaatataaacaacagtaataaaatatagtatattaatactataatgttaagaaaagtataaataaataaaacttcaataataatataatatatagtctaaaatctaaaatattaaaacaatattaaaaattaaagtacacataataataataataataataataataataataataataataataataataataacctttttattgtagaatatgtgaaagttaaaagttaaggaattaaaattaaattaagactaaattaaattaagactaaattaaaataatcttaaaactcaaattatgtaaaacagaaaagtaattatctcttaacaccaataagatagcattaacaatataaaagaattatagagtcatttaatcacaatttattatatatgataaatttattaatttttaaaataattatcttaaaataattaaaaaaattataattagattatagtataacattattttatactatccgtgcatagtcattaaactctaccattaaagtaatattacaataaatatttaaaatatcataatatatttaaaataataataatttattaatatttttatataaaaatatatttatattattattacaatctttcaaatagatgcaatgtaattatgtaaatgcaaaataacactaacaatgaatgagaacaatactaataaataaaatccaaaaatgattgacgtgcagggccataagcattggacgcagttcaagttgccatgcagggcctttggtttgctacatgaatttgacgttgagaagatgaggatgaaagagaaacaagtgttcctaaattttttgagactttggttaaaatgccattctttggcaaattatttgtccaaatgccacggccaccaatgccacggctcttatttcgcagcaggtacaggcggatttcgtggcttgcgcggcatccacttttagccacgtggcaataggccattggtggcctattttggtagaagggtcagcgaaataggtgctgaccgggccagtttcgattggacagcgcagacacgtggcaaaatgttattggatacgtaatttggcatgatttatagcgaattaggtaaatttggtacgtgattcagcgatttaggtaaataaatttggtaaatgatagagcgaattaggtaaataaatttgtctataaatacctgcttgttgaaatcaccagaacgtgctcaaagtcttggttcttgaaaaattttcattctaatttgtagattgtcgtggcaacaaatattttcaaaacacaattttttttagtttttttaatttatgcaaaatgagtgataatagaaatggtttaataaccattgtctatcataatgggagtagatacgttgggcctaacggtcaagtttttgaaggagaaagtaaaatgtttcgtatgccgtcaggatgtagccaccgtgatctgatgaaaatgatttacaggaagttgagattacaacgcggacaatcggtctctcgattgacggctagatgtgcgtcgggcaacccagtgcagtgggttgctgtggatattgtagatgatgatgatgtagtgttagttacagacgcttgcatatcagatggagcaaatccaagatttattgagttgtatgcagaattaagctgtgggggacaatctagcagtcaccgtacggtccaacccgataggtccattgacataaatagagagtcgtcggtgaatccggaagatagagatgtgtcccaatcaccaccaataccaacccaaccaacacaacaaatggatgatgaagaaatgtatatatcgcccccactagcaccagcaactgaagcaatggggaatgaaatggtggcagcccacgacccagtttggcctatggacagttccgaggacgagatggacgaaggtgttgttccagatggtgactcgtcagatacgaacgtagatggtgacttcgagcgtggtttttgtaacaccccgtgtgcacccagtgtgttaacatcattataatatcagaatctcataaaataagttgcggaagcatgtaagaatcgtatttcttgatacattatgtatagcatgtaacagagacataataaagtatcacaatacaactataactagcccttattgatccagatagacaaaactaactaagaaccgggcagataacaaccatatcaatatagatatgacaggagacagaaactacctcactatgtatacgccacagggagcttcaagctcacagatgctaatccaaacagttaccctgcttgactccactggtttctccccagggatctatcctctattctacgcacctgcacataaaccccacacggggtgagataaaatctcagtaagcccagggttcttggaggtcttacctccccctggttcaatatcaaacatttctcccatactaaatattatggatgtctaacaaggcctgtgcccttatctcatataaaactatcagccatctcggctttctcatctcatgtctatatgtattcatcataggcgtcacacatatccagggaataagttctctggaacttagtcccatgcctggggccatcatctgataaatataatttccccaggacctcactgaactctaaaaatgcctgaggaatctctcaactcagggctttcacacacaatgcctgaggaatctctcaactcaggactttcacacacaatgcctgaggaatctctcaactcagggctttcacacacaatgcctgaggaatctctcaactcaggactttcacacacaatgcctgaggaatctctcaactcaggactttcacactgaggacctgaataggatcatccacttaagggcacatctattcaggactcaggcccgagtaggatcatctactgaaaggcacatctactcaggacttgccgcccaatacctgaataggatcatctacttaaaggcacatctactcagggtttacatggacgcctatggattatcccaagggagatcatccacttaagggcacattcccgatggggtccatagtccactattctctggccagagaatgctcatgcaatcataacacacagtatcattatcatcaatcaaaatccaatacagcatacattatgctaatataatcaatacaaagcatgacactctcacagtgtcaatctacatcaataccaatatgccataatggcattccctaaccacacatcataacaccatcacagtgttttactaacataatcataatcatacatcatcaaggtgtctggcatgtcatacagaactatcaacaatataagcataacactctcgcagtgttagcttatcatcaggcatcgaacaccaacacagggttcatttcatcactagaacatcagggtatatctcttatacccaatacagcttaatcctctatcctagtgtttaactacactagctatcacacatacatgtcttatacgcctataagaccaacaatatcatgcctaacactatcacagtgctaggatcctcattaacagtcatataatgatatctaatcagaactcagaacattaacctagtgttcatattcaccgtataacacataattcagtaaataatgacccccaagcagaggaatcaccccaagaaacactgaacttacctggtatgaccatgctttatcctctatcttcatctggctagtccatgctgctgacactgtcgtgccttgtcctattcaaatcatgcagcacagtcacatcagaacactataccaggtatctaacaacggtactcgaccgttgaaatgaaaggaagcctgattcttcccctacaatccctcaatcgtctatcttaaggttatcagcctaatcactgtataggcccccttacaggtcctcaacaggattattctcagcctgaccatggtcttagagtcttggtaagactctgcatcagtcaatttaatggtctattcattcataattcctcaaataccaaacatggccacatcaaacatattaatacatattcaccgtttatttggccttatgaataacttttgtaaaggtatttaagttaattcaggccataacatagctcattcacacccacttctctcgtcccagagccaaactcaaacttcatcacaatctcagattcaacatgccatgtggctcagaacaacctcctgactacatctccctaaagaaccgaagcctaattccagccctatcacaatttggttactattcaccccattacccaaatcacaaattaaacggtgaaagtcgagtttcttacctcaaaactgttgaagaaggccggagaatcccttctcccagctccaacatccaagaagcgccttcttctctcctcaagctcaactttctctctaaagaacctcaggaattggggtttctctcaaatcttggctggaacttagctctcacaaggttctctcatgtttattagtgatttggaggtgtttaaatgaggtgtgatgaagttatagagcttcccatgcccatcaatggctgcctgggccagaggaagaaggagaaagggggttttcccccaaaaatcgcgtagaatggccttttataggcctctcccgtgcctcccacgcttccagcgtggcttcccacgctccaggcgtgggtttccagccaaaaatggctttctggagcacttcccacactccaggcgtggattcccacaccccaggcgtggcactccagcaaaaaatcactttctggagcagttcccacgctccaggcgtgggttcccacgcttccagcgtggagctacagtactgctacagtactgctacagtaactcttttttttttttttaacttgggttattatagttttccaattccttctccgggcaatgtcagaatgcaagacccaatgggtcaaggtatggatgcacaatattttgttatgcagtagttattaaattattgtaggttgaataaaaactattgtaggtataatagaaattagtgtaggtttaataataaggtgatgaataaaagttgtaaaaacttttatgcaattattcaattatttaggaaaaagtgttataaatataagtgtgagaactaagatgattaatttatataattaatgatcgaaaagtttttcattcacagtgtttcatatgtctaatgatttaggagacgacatcgttccattttggtcggatgtaatgcattacacacatgttaattgggcatacacagagcagcagtctggtgatatggaaggaggtcaaatacctaactggcagatgggtcaaccattatataagaatcaggtgtttgagaccaaacgcgatgtgcaattggctataaaacaatattgtatggctgatcatcgcactaccgtagtcgaaaaaagtgatacgaaaagactgataatggtttgcgaaaatcattttgacagttgtccgtggaggatcagggcacatcaaaaaaagggtggcactgaatggattgtaggcatatggaataacgaacacacatgcgttggtcagaatctttctcaagatcacaagcaacttaattcagatttcatatgttccatgatcctaggtacgtatatacattaaattgaagtttggttcttgtattagttaaaattgggttagttcaagaaaggatagcatcaatgctcggatttcacatatcatacacgaaggcatggaaggcaaaacaaaaggccattgtgaaggttttcggagattgggatgagtcgtatgcatttttgccaaggtggttggcatacatgataaattttgctcctgggtctgcatacaagctggatttgcatgaccatttcattgatgggctactagaccgaagtgccaaggtgtttaacagggtgttctggactttcaaacagtgttgcgatgctttcaattattgcaaaccagttataagcatcgacggaacccatttatatggcaaatatcggggaacactgcttattgcaacatcagttgacggaaacaattatgtccttccaattgcatttgcgattgtttccagagagaatatcgacaattggtcatggtttttggcactgattcgcatacacgttacccagaaagagagaatttgtcttatttcagacaggcatgctggcataattgctgctgtaaacaatgttgatttgggctggcatccaccacgggcgtaccatgtttattgcattcgtcacctggctagtaattttaatcacaagttttcgaatgtcatcctgaagaaacaattgaaaaaattaggtatgtttgtccgatatgtagggcaatgttattatatgcaattattccgttgaagaaattaggtatgacattgtgtttgtttttgcagcctatacaacatcgcgcctagattttgatgtgggactagaaaaatttaaagagtcaagccctcaaatagcagcatgggttgataatatccccaaggagaagtggagtataccctatgatgaagagggaagaaggtttggtcacatgacaaccaatctttctgagtgctttaaccatgtgctcaaaggagccagaagccttcctattacgtcccttgtgcggttcacatacgctcgcttagtagcatactttgtcgcacatggtgaagaggcccaccaggagatggcaagaggcaatcatttctccaaggtagcatggcaaaaatatacgaggatggttgaaaaatcggcaacgcactacgtcacttgttttgactcagttaggacgagatttgaggttcaagagacgtacaacatacggactcatactggggggaaaaaatggtctgtgtcgttagctgaacgaaactgtcaatgtggtgagttcactgcttataggtttccgtgtattcatgttattgcagcttgtcgatcaacacaccacgatcccagacaatatgttgaccctgtatatagtgccgcgtatcaatgtcaagtgtatgcaccacagtggtatccaattggaaatgaggacttcataccaccagctgcaccacccattgtgataccagatttgacgctgaaaaggaaaaaaggaagaccaaatagtacgcgcatacgcaacgagatggattcgtgtgaagggtcaacaactcgcaccagatgtagttattgtaaagttgtgggtcacaataggcgtaattgtccttcagtcaaccaaccgcattgatgtattagttgataatcatgatgtactatgttcaaattaaacaataaacattacaaataaaattaagcagtgtccattagcatgcaataaacattaaactaaaatattgttcgatagagtcaatcataataatgcgtaaacacaacaacatattaaaatttaaggtaagaacaggtaaataaaaaaacaactcagtcatgctgttggtggtcttcatggtatcctccacaacggctgatgttgtgctcgtacggtgatagattacatcgaaatcgtgcttccctaagcggatttcgtcgaatgatacgatgggggacaatgtcaccaccatcatcgtcgtcgtcatctccatcattcaagaccgccagtatgtcagctgtcgagtacgacacgaaagtaagggaatgtacatccagatgcggatgtggcgtaggggtagacatcgctgcatcctcatatgacattggagcattgggcctataacaatctgcataactaggaccagatgaactaggtccagctgaactaccaccagctgaactgggaccagctgaactaggaccagctgaactaggtcccgcaaaactaggcccagctgcatacataggatgtggatattgtaatccaccctgcgccatcgacggtacggtaaaccagggagggtactgtgaaccaggtacttccatgtggtgaccaccaatattgctgagaaagtcccgccaggtacccaggtgcccagaacatgccagaaggacgtggaggaagaggcgataacacaacaggtgtgtccgcaatcgggggagtactgtgatgtagcggtaaccccttgtggcgcgcacgccgatttctgcgaacatgtggaggaggggcctcagtctgatgaactacaggtggtgctgtcgcatctccagcatctgttaatctttctacatcatcgcatgcggacaacgctcgaaccgcctcgtcatagatctgggtcatgttaaatgacccctgagcctcaggggaagtcatgtgaacaaccgtctcgacccgatccgcctgcacatgatgtataattagtcaattaaaaattacattaacaaccaataaatgtcataatatgaatttgcgtaccacatgggcatgtaacgcagctctgcgtgtcatccaccgacgggtaacagagtaataccactgcatgtactcgctgttaaccgataggtagtcgtctctccgcataggctgcacattctgcacaacaaggccatctcatgctacccattgggatatgaaaaatgcgtgccgcacagtccaatcgacctccgtcttacccgtgatgttgatcgtgaggagcacactacagtctatcgggtcttctggaatatgctgatcaaacccaaactgacgtagaactctatccggttgctgatatacaacaacctcataacaaataagcggacaaaccgccaaccatctacgagccgcgtcagccttcggtggatgaacaatgtcgacaatgtcgtatggcctccagcgtatgttcctacggcgcatcacatcaatatggtaccgatatctacgtatgtatgtaaacacagtttgtcgcatcgtgtatacgttaaacctgttacaaaacagttcagcattaacaatatacaaccataatataaagcactgtagttaaaactatcaaacaaaatcggtcaatacctatggccatagatctccacatctaattcttgttgatcctgcagataggaagcgcaggagaaatcgtggggaatcgcgtccaaacccacagctgcaacaacaaagcacagccacccatctcacgacccgatggatgggtagccctacacaactccctatataagtatgcaaggactgcagcaccccaactgaatgttccagtgcgttggaaatcatccaggtgtaacaagtagcgagcggggacaaagctggaagcggtgtcaacaaataacataccgcctaagatacgtaatatcaatgcacgtgtgtatcttcgacggcctatttcagtgccggcatggaccgcataatcaccaaactggtcccgtaaatagtgaagtaccaacaaaccgccatgcaaatctcgacgagcaggcggctcaatccctaataaatcaccaataatagcacgcaagttgtgtcgtccgtgacgcccagacacaacatgcccgtcagtcggtaaccccaaaagatgatgcacatcctctagcgtgattgttacctcacccatcggcatatgaaatgtacgcgtctccggccgccaacgttcaataacggcagacacaaggtgatgatcgatctgaacaaagaattttacgacacaagtttcatctacattgcaatacattgaaaacatcaaattgcatacttgtcatttgtcttcatatatttacctcgtggttgtgcaggtgcgcaacgtgataaaatcctgcctgatgaagccatggttggatctcgtcaggtataccctggtgatcgtgtgtcgcggcgatcctaacattaataacacgatcccgcatcgatgaatcagcctaggaattccacacataagtggaaatatgcttctcctgtagtgtaaggagactacgcacggatggacctggatcaaccacactcagtggtgactcagatgatgaggtggatggaacatgttcatcgtgatccatgactgtatgtcagttgtttaaaaaaaataaattccattaattaatgtacattgatatcaaaaacattcgatatattgacgcgttgtaattcaatgtttcaattaaacctatgttgttgtaattgttaaacctaacatcattttaaaggatggtgaaggtcaacggcttcagggtgacaacagatagggaaggaagacagacggagatgtttatgaagaaggaatccggcaagcattattcaagtctggcgacgaattttggatgttcgggttttacggaaagacagaacttttggtacttgaaaatgtggcatgggtcttcagtaagttccatttgtgtgtgctgggacatgacggttcaccctgatccctgaaaccccaacgtccaaaattcctcgccaaactcgaaatatgttcccccgattcgttcaccgtaaacacctttcggtctgtcttccttccgtattcgtcgttcgctcaagcccttgcccttcaccatccttaaattattatactttaattattataccttcaattcatcatatatttaattaataatttttaaatttgtaataattatttttattatacgtataattacttttttttaaatgaactcttcaccattctttaattattaaatcattacttatttaatcttaacttgtaattattattaatttataatttttatatttatcaaatcaaaactttaattataattttaactacatcatatatttaattattaattttcaaatttttattaattatttttattatacttataattatttatattaaattatttctttagttactctatttattacatcaaatcttaaattattatactttaattattatattttcaatttaacctttaattattaaatattaacttgttatttttattacatcaatacgtatcaattttattatatcttcaaatatttttatattaaattaaatgtttacttataattcttattaaatcaaatattgaattaaacaatttttttacttattatttttattaaataaaatcatatgtttaaatttttgtcattaaaaaatcatgtttaattttatacctttaattttttttaaattaaatcaaatctttaatcaaatcattactttttgaccttgcaatccatcattgtatgtcaaagttttataaaaaaattctataaattaatgcatgcaaaatttaaaattatttagttttattacatcaatacgtattaattttactatatcaacaaatattattaatattaaattaaatatttcaatataattcttattatatcaaatccttaagtaaacaattcttgacttattatttttattaaataaaaactttatttaaatatttgatataaacattatctcacaatatttttttaactaaataaatttctgaaacttaaaacttataatctaatatattattcctacattttatcctatattttttttaatctttcctacaaaaataataattataaactaacaatttcatcatctaacctaacatttataaaatatattattgaatacctattactatttacatataaaatatattaaccatgcaattaataattataaataaacaataaaaatcatctaacctaatgtttaaaataaacctttaatctaatattttaaatcttcaactacaatattatctaatatctaactctatttaaataaaaaatatattcaatatttaaaatataaacaaaataaattaaaaataatataaactaacctaaaatatattattgaatatctgtcactatctacatataaaatatattaaccatgcaattaataattataaacaaacaataacaaatcatttaacctaatgtttaaaataaacctttaatctaatattttaaatcttcaactacaatattatctaatatctaagtctatttaaataaaaaaatatattcagtatttaaaatataaacaaaattaattaaaaataatataaactaaccttatcagtagtatgcagggagcaagggagcaaaatgagaggttagggagcaagattcagatacgagagaggagaaatttttttttacgaaagtgacaggggacaacacgtttaaatagtgggccaagcatacctaaatcgcaggttcctctaccaaattagccaaaaccgctggtcccaccaccaaattaggcctccacgtcagcgatccccaccttattcgcccaagccgcctgcggtttacatgctgcacctaattcgtccacggaagcagcgagttagcatatttcgcccacgttggctgcgaattagccccgtcagctggccgtcccattaagccaatgcatggctgacacgtggcggtggtatttagcccatggatgctacgatttcgacaccgtggcatttcggcaaattttttgatggtcgtggcagattgacaaattattttctccattgtggcattttgactgttgttccaaatttttttaagttaaacatccaaattactaaagtgtttctaaattaaatatattataacaaaggaaatgtttgggtttcttttttcaaaaattttggtgtaaaatactaatatactctaactgaaaaaaggatgaaggtcagaaggtatattaacaatataactttttgatagaacactgtaaatcaatttcttggtgattgtctcaaaccatatagtgacttctgaagatgacaaactttgccatttgctggagatgagaagccaggaggaacacacatgtacacttcttcatgcaagtctccatgtagaaaggcattattaacatctagttgatggagctcccattttttagcagctgccactgccaagaaagtacgcacacttatcattttggcaacaggtgcaaagatttcatcaaaatcttctccctcaatttggttattcccagcgatcacaagtcgtgctttgaagcgttcaattgttccatctgacttgtatttgatgcgatatacccacttgcagggaagagctcttttgcctggaggaagagtagtgagagcccatgtatgattattttcaagtgcttcaatttctgttttcatcgcttcacaccaacgaggatcaagaactgcttctttaaaattacgaggttcagtacctgcatttactacagcaagaaaggctctgtgcttggccgaaaagttagtataaccaacatagtgattaagaggatagggactacctgaggctcgatcaactgacttgtttgcactagagtgtatgtgtgcatgcactgtattgcactgatagtctttaagataggacggtgcccgccgttcacgtcgttcacaagaaggcataatgctactctctgtttggggccctagttgttggtgtgcttcaggttgagatgtatttatgctccccctgtcttccatacttactgatggtgctgagtcagtaatatgaggcatgtctgtgatagattcttcatgtggttgttctggaacaacatcctccaccacaacgtgttcatctaaatttgttgagaaagatggataataacttggtagagctactggttgttgtgcagatgctccagttggatcaggaatagaggggaacacatcctcgtagaaaactacatcacgagaaacaaatatattatgtgactgcaagtcaaatagtttccacccttttttattagtaggatagccgaggaacaaacatttgcgggaacgagcttcaaacttgtcagattgttttggattttggtgcgcataacataaacatccaaacactctcagatggttgtatttaggtggtgaaccaaacaacaactcatgaggtgtttttccattatgaagagctgtaggcgttcgattcagaagatgggcagcagtcaaaatgcatttccccaaaaactcaatgggaaggttagcttggaaacgtaatgctcttgcaacgttaagtatatgtttgtgctttcgttcaacatgcccattttgttgaggtgtatacgtacaagatttttgatgcaggatgccaagctcattatacaaattggttagaagtttatgctggaattccatcccgttatctatgcacaaaatttttacacaacttccaaattgatttcggatcatggcaataaagcttttaatcagcagtggtgtttcaatctttttcgccattaaataaatccacacagctcgattgaaatcatcaactagtgtcagaaagcaatgtgcacctgtgaatgatgtcttcctatacggtccctatatgtcacaatgtatcatatcaaaaggttttgcactttaatggtcactgagagaaaatgaactacgagtttgttttgccctgtgacaaacattacaatttatacaatctttattcttacgcttatgctgagagatgacaggaagaaacgataaacactgacttgatggatgtccaagcctttgaggccaaagttccacagattcagtttattgtaaagtaagtgcacttgcttgacgtgcttcatacacatacactccactgctttgattacccagtccaatacaagtcctcaagtctgggtcctgcaagaaacattgtgtgttagtaaacacaatgtcctatttacttgatcgtagaagctgattaacagaaataagtttgcattgtaagttaggtacgtaaagcacgtcagtgattgaaaatttgtagtcaaacattatttttccttgctttttagcacatgtttttgttccatttggcaacccaatgatgactagatctatatttgtaacatcggtcataatatcgagcctgctcgtcatatgccttgaggctccactatcaatcaaccaagaaagaggtaaggtatggttaccagataaattagcagcactagaatgctttatgtccaccaaggatagaagccattccacaacttcaggtgttaaggctgttagagacttagaaatattttgtttatcaccatatcgacctgcattagcttgaataaactggtttccacagctaccacctctaataggtttgtttggaaaaccatgtagcagataacatttgttgacgtggtgatttgattatccacagtgtgaatacaaatgaaagtacagtagtgctattagataaaggagtcacaggttatcatggaccttgtgctctgataccataataaaatatgaaagtatggtatgaatcttcacacgttttattaatcatcaaaagttgccttatataggcattgtacaaactgacgtaaatataaaagaataaagaataaaaacagaaaacaaaactaacaaatcttatcctatctagagtttgttatctcataatacaaatataaacttatcttataaggtttgttatcttcatatcctaactaatagatttaatctccaacacactgccaaattttcttttttggccaattacttttcttctttcgaaactattgttttctcaattgtcacacttgatttttctacatttcatattttcttttctcaattgcttgtaagttactaagtttaaaattatctttttttcttttcagatttcatattacactaatcaattttttttcattcttatattttggcggaatttgtttctataatctttgtttgatatccaacatatgagtgtctatctataatctttgtttgaaggaaaagaaaaagataagaataatttttttcctaattcttgtacccattatttattttatattcatgaaattgtttaacattataaagttgatgttgcttttcattcaaaattgaaaaatctatcaacaaatctttagttatgacaagttttggtgaaaacaagaaagcatttttatttatcctttgattgattgtctaatccatttggtattgactcttcctatctcaattgtcacaatttagagatcatttttaactataaaaattgtcaaaaataggcttaaaaataagatcaaaaatgaaaatctagctaattgtttgattatatacattgaaagaatgattgctgaaaaatttgacacattgtattgttgatgaactttatgatacgaaggaacgacatgcacgatttaaataaaaaggtatgatacatttaaacttttagtatattataatttgaattttaatgaatatttattattaataaatagtccatttgattgacttttggattagtctttatatataattgaaatgcacaagttaataattaaaatattagttaaattgtaatttttctcctaatttttttagatttatgattttggtcccctggtaaattattaactaataattatgattaatataattattaagttaattataaattaaataaaaattattaatcattagaactttgataaaagatcattactcataatataatgctagaagtggcgtgtaacaatagaggtgaaaaagatttttaatgaggagaggaggaatataatattgtaaaagattaggatttataatattttattaatttttaataattaatatttttaatttataattaacttagtaactctattaatcataatttataatgttgtaaaagtttagaatttataatattttattaatttttaataattaatattttaatttataattaacttaataactttattaattataatgacttgttaataatttacaagaggacaaaaattgtcaatttttaaaattaggaggatcacttattataattaaaaataagaaaaaccaaaatcttaaattaaaaaaattagaaaaatcaagattataatttaacctaacaaatttaatatatataatgtatgcactacttaaagtatgtttaacaatattcatttctcataatttttagttatataaaataaacataatgttgaaaggaacattcataacaattataagttttaaattaaatatatttttaatcaatctaatttagtatttcttttatttgtaattcttttaaattcttacaaattatatttattaccattaatcattatcgaagtattgtgaaactcgatctagtatgattggtggaacaagttgaatcgagattaaatgacctaatcaagttaatttcacaattagattggttatataattaattcagaatacctcaatcaaattcgacaagttaacttaacatatcttacttaaattgattcaacttaatcggatttacatattttatttttataagaaaatttaaatttttttaaattttaaattattatcaattattattttatattttaaaatataattaactttttcttcatcaaataaataatattaatattatatatatatttaaatttttaatatatatcagatcaaactacttcaattcttaatttacggactaaatcattaatctgttacctcaagcggatcaatcacgagtttcacaagtattgtttgtctttgtttattttaatccacaccacatcgagtaaaacctgataacctataacctcaggaggagaatgttcccctgaatccgaagcccgtgctctacccagcgacttcgccagaaggtcactctccattttctttcttttcattccctttctggttttcttttcgctctgaatttgagtattttttttccgtatcttttgttgctccctgtttggttgatcggattttgttagtttgctttcacctattgttggaattaggctagtgattgcaaaagggctattagggcatactctaatagcctttttagttgtaaaatttaaggcctgcaatatgtgtgaattgttgctgctgagggaattatgaatataatttttgtttatttaccaatttttaatttgatgaaaaaataaattgcaataactcaatgaaaaagggtattgaagtttaactaaactggttgctatgacgatgaagtttggttctgatgatactctgagcatttaactcacgtttgtgtgttttagatactcccgtattctggaaatgtatatgcttttacatattcagctttgtttcagtttatattagtttgtttgggttcatgttagatcatccagatgatggcataagaaagccaagaagacggtccttttttcttttgacaattttatccttgtcatttaggtatctctgccaaatggaatataaacgcattgatggggtaataatattttgagtatgttaataaacggtaatgttttattttttatttgtatacacttggagctttttgttgccatgcaacctatgtggttgacctcacctgatgagataagggttttattgttgattattgtccaattggatctatttattaactttgttagtgcttatgagattaccctcaagtggcttttttggataaggaatgttcgaacattcttggggaaatgacatgggaataaagtttttcatgttttttcaaagagagagagagagagagaaaagaaaccttctgggaagaagaaacatgttgctgctcatttccagtaaagcagtttagttaagaatgaaagatttcttataccaaatgccacctaaataatggatatttggaaacagaatgaatacactggtggcataaatcccagtaagtttaaactttgaacgtctgaaatcttcaatttagagaattctagctgacttaaattcacttttcatttgccaaattgtgcttcaagttcagtagatttggtttgctgttggcaagaaaatgttttatgacgtgaactgttttcatggaaaaatagtcaactatatttttatcttacttgaatagaaatttttcagttaactaaattgtttttccagctgactaaaatttccgagaaactaaattaaaatcgtagagtttatagctgccttgtttttagttctttctgtgctgactagttttgtatttcattatttcagcttctgctttggaatttacgctgagtgatttgttaagaaaatgaagaaactagctaactaattttagtacagctacacccatttcatatagaagatttttcccttttggttttctttgtttggctttgcaaataacaccattttttaaaccttcaccactttatatgactctggaatctgcctaagtttctgtttttcacctggattgtatctgttacacttggtatgtcttccactgtttcctttttgcttgttcggagttgatgagaaaagaaaatgaaagtgaagcttaaaatagactcaaattttagttttatcttattaggggatatctggtgtaactgaagatgtcccaatctcattttggagaacagtactatttgtgtgccactttctggattgattaaccatcttaggtagcagaggtcctgtaatttacttctttcatgtctcttgaataactcttttatttgtttttcatttttcctttaaaattgttagacttactcgcttcttaaggtagcatccaagttgatgatgcatgctttcttatcacattactctctctctccaacagtccacaatttcttgatttttggaggttaacagtgtttatattcaacactttgctatttcttaacttcaagtgcaagagaacaaagagcataaaatcctttagagtgtcagcagtcaagaatgcatacaggaatggcttcgttaactcaactccattataaagtacatgcctccactttcagaagggtgcattctagaagccaaggattattgaaatctggaaaactatcccaactccaaggatccgcctttcctagtattcacattaatcaatcctgcatatgctgcacaaagtttactccatgggagtcatcacctgtcacatatgctcctactgataatcaaagtgatactttgttgccgcaaaatgccaatatatttgaaactcttgaacctagtaaaacagctgactcatcaataacaaatgctggaggggttgtagagacagaatctcagccaggcctgcagcttcaggttttcaaatggccattgtggcttttgggcccttctgttctcctagcaactggcatggtcccaacattgtggttaccgatatcatcaatctttctcggccccaatatagccagcctactttccttaattggacttgattgcatatttaacctcggtgcaaccctttttctcctcatggctgatgcttgttcacaaccaaagtctccaacacaagactgcaaaagcaaggctcccttcagttaccaattctggaacattgttgcaactcttaccggttttgttatcccactgttgatgatgtttggatctcagaagggttttctccaacctcaactacctttcatcccgtttgcagttctactcggtccctatcttcttcttttgtctgtacagtttctgaccgagatgttgacttggcattggcaatcaccagtctggcttgttacccctgtcatttatgagtcttaccgtgtcttgcagctaatgaggggattaaagcttggggttgaactcagtgcaccagcatgggtgatgcacacaattagggggctggtttgctggtgggtgctaattctcggtctgcagttgatgagggttgcttggtttgctggcttagctgcacgagctcgtaagcagcaattgtcttctgatacttctagtgttaatggtgattagtgattagtgattagtacattgtaaaaatattctgaaagagacagattatagaataagtagatgttgtttattataggtatggatgttttccatcccatccatataccatagtgatagtggtacacatccaatagatatatacacaagtaaattgcatacaagacttacttcatcactgggctttatgctgtatcaatggttttgtctgtgttatcttcaagttgtgaacaaagtggtttatctgtttttacctcaacttatgaagatggaaaaattatatagtggttggttcaaggaaaagtttatggatttattatttttgataaattacaggtaataagataagttatattaattacttgttcttttgtttttttccagatagaatgtacaatatcgataatgatgatatctcggttgagtcgaggctcgtattcctttcattcataaatgataatcagtttagtctgtttttgtttttttgggtatccttgtcattctttctgctcgtttcacccttgatctgcttcttcatctgcgtcttgataaataacagtgtatagaactagtgtgattttttattttgtcttaaatgtgtgaatacaaagattcatgtataaataggagggtcaagaaactgtgaactatgaattgtagcttagttgtttttgtgaacagttagaaggaaaatttgtgttttacacacttcaaaactcatatatcttcaaatttttttcaaaggatttactttttactttggtattatactgaattattcattgtaatgcccaactgaaacttgcttttgttaggctaatgtaacagtgtaagtgcttgtttgattcacttcttacttttttgtattaattttttttttgaataattctacactattagacaatcaactcatctaaattctattaagttttaaaaattgtttgcagaataagtgtttaaaaaaaatagaaaagtgaaatatatttttagttcaaatacctaggagacaaacttttagaaaagagacatatggtcatgagacaaacactaccaaatatatagaagggaaagctaaattttagaatataaaaaaaaaaaaaaaattcaataaacaaagcttaaattttttacttctttttttcgggtcaacattgtaaggttatgtttggttttctttcaaaaatacgcttgtacggttatacttgatttgaaaccgagttccaattgaaagcaatatggttgtttatgcaaattcactttgcaaaacaaaattcattcaaatttaagttgacaaactttttaatctaaacatactttaaatttgtcaaatttggtttatggacggtggtttagtaaaaagtcccaagtgaagttatatttatattagtcataattcagagacacatgttccttaattgactgggtaaaatgcaagtattttattgtcccctatcttaattagcaatggactgacgcaacgcataagttttgcatatgacttggtgtgaagagttcctaaaagatgtgtaaagatagaaaaaacaaaaaagaaggaaaaaaacaagaaggaaaagcttcagggtccaaatcatatacattgctttcgtgggtgaggaaaataataaaatattgaagaagaaaatgcgaaactgaatggaaacaaagtgaatttacagttgtctgtgttatgtggtcctataaacaacatcagcaacagcatagcaagatgctaagaaacccaacatgaatttatcacattcatcatgcgtaaacgtgtgatttttgaagcacaaagaagcatggattaaatgcaggcccgatccaataataagtgaagactaaagtaaaatttaagaaaaatattttattttaaatatgataaaaatataataggtctttttttttcaacataggtggacttcttgttaacatatcagacatttttactttgtaaaatctaataataaataatgcttttttgttaatgaacctaaagcttgatatttagttattttatccttaggctaaaaatgttaaaatgttaacatttgagagaataaaatcctggtgggaagaaggatgaaaaaaaaaagtcataattgtgttagaccaagaatcgaaacttgattctgattttattttaatgcaattagttgaagaacggaataaagtcatttacaatcatttttcaaatggtcaaactcaacatagttgtttatattgtcaactttttatcacaaatttggtattgaaatatgtacaaagcatttacaatcatttaatcaatcatatttttttatattgaattttgtcacaaccacagggcaacggctcaaatatgttgactaagtagtgaaagaaacaaaaataaatattaattaatatctcaatgacactaattaataaattaaaattaaaatattttaattaaaaaatatatttagtgtcattaatatatttattgtgtgctataatttttagtattattactatattactatacaaatcattccaagtacttgcgggttccttaaaccattcatgggaaattaattaatagctcggttgttaattatatttttatcaaatgtggataattatactttgataaacgcaaatatatttcgataaaagaaaagaagttaattaatgttcttttggtacgattacaaagtttctaaatcattattcattagatggcatctaaggtacaccacacatgttgagaacaccattaaggacagtagttgaatatcagggatagcattgacatctacaactcacataacaggtccggtacgttattttattaaatatcccaagccccttcaatcaatagccgtcatacagttattttcagggctcaatattttcttgaaaattccacttttgagtaactttgttattgggttgggctttctccttccatgctatctcagacccattgaggattctaaaaacctaaacctatttcaccattataaatttattagttgagggtggagacaagagaagagagagatttcgatagcctcaaatgacattcttgagagcacgtttaagtaagtcttatgttttgcatttgagaaatctctagagagatgtctaagtgtgatctctttagagaagtttgaatatcactatacttggtaatgtttgattgtatctctagtgaaaggttagagaagtttgactcttgtaacccattattattatagtggaagtttgattttagaccagtgtcccgtggatttttacttcttcacattaaggaagattttgtcacattaaacaaattgattgtgttattctctatctctattctcttgcattttattattttacttccacaatctatttgagggtccttcttaacccaatagtggtatcaaagcccgagttcgatgggttctgaaagagacgagatgaagactagtagcataactcatgacggagacatgttcaagctaaccacggacaacttcacttattggagaccgatgatggaagatcatctctactgcaaagatctatatgagcccaatgtccttgacaagaaacatgcaggaaaaaacgataaggaatgggagattctaagtcgtaaggtggtagctacaataagaaaatatattgacaaaagcctctttgagcacgtgtctgagtttacaaacccgtacaagttgtggaacaagctggaatccatgattcagaagaagactctcaggaacaaagcacacctagttcgtcgacttgtgaagctggaatacaaggtggcatgagcatgattgaacacctcaacacctacaaaggtattgtgaaccagttgtccaaagtcgatatgaagattgatgacgagatgcaggctttattgctattgagttcgctaccagaaagttgggatactacggtagtgacattgagcaattcggttcctgatggaaaattgacgatggatgttgtgactgatagtctcctgaatgaagaagtcaggagaagagaacaaggtgtaaccaacacgtatgaggctaatgttactgagaatagaagtaaatctgactttcgaggtcgtagtaagagctggggtcgtggtggacgagataagtccagaggttggtcaaggctaaagtatgaactgaagtgcctctactgtgggaagtccggacataagaagattgactgttggattctgtagaaagatgagcagcacgacaatgtgaagtcagattagattgtttcaaagaagaaagaatacaagaacaccactgcggtggttgccagtgctgaagtcgagatatttctactcggaaaagataattttttgaatgttgcctatgatgattgcgcctggattgttgattcaggtgcctatgttcatgttactcctcagaaaagtttttttctcatcatacataagtggcaactttggagttgtgaagatggaaaatcaggtgaccagcaaaattgttggtgtcagtgatgtaaccttgaccacgaatatcaggtgccgacttgtgttgaaagatgtaaggcatgtacctgacatgcgtttgaatctaattttggttggcaagctagatgatgtcgggttagtgaactattttggaggatgtagatggaaattagccaagggaaacttggtgatggctcgaggtaaaaaggaaggctccttgtatgtaatgcaaggaaagataaatggtggagaagccaactcaattcatgatggacctagcttggagttgtggcacaagcgtctcagccacatgagtgagaaagggctccagattttgaagaaaaaggagctattgaccaggttgaaaggccaagcgctggagagttgcacgcactgcctagctggaaagcagcattgagtttcgtttgtgagaccgaatcaacccagacgatgcaagaacattatttacctcgtccatactaatgtttgctccatgtctaagagatcacttggtggagctcaatattttgtttctttcattaataaccattcctgcaaagtgtgggtttatttgttgaagactaaagactaggtactccaatcattcaaagaatttcatgctatggtggaaagggagactgacaagaaattgaagttggtcagatctgacaatggtggtgagtattgtggtccatttgatgcttactgtagaaaagctgggatctgacttgagaagatgcccccaagactccgcaactgaatggacttgctgagaggatgtaccaaattattgaagagaaggtccgaagtatgttatccaatgtcgggttgccaaaatcattctaaggagaagctgtcaagactgctgttaatttgatcaacctctcaccatcacgaccacttgaagaagaaatccgtgaagcagtctggaccaatcgaaaaataacttacgatcacctgaaggtgtttggatgccgagctttcgtacatatccctaaagatgaaagggcgaagcttaatgcaaaaacgaaggaatgcatttatctcggatcgtcaaaaaccgagttcgagttcagactttaggatccaatcaataagaagatagtgagaagccagaatgtgattttcatgaagatgagaccatttatgacatctcgaagcctaaagtccaggttactgtctgacaagaggaactcgacccttttgttagagctgaagcagggggagaaatcaatgaagaaaattatgaagaacagaatggccagcaacaagctgatgaggaccgagatattgaggtccgggttgatgatgagatccgggatgagaattatgaacctggttctcaagctgctgaaggataacaaccgaaataccccactaaagaaagaagaccttctacaaggtacccatctgatgaatacaccgtcattgctgaagacggtgagtctcaaagttatgatgaggccataacgagctcagaaaaaagatcgtgaagaagagatttatatggagcaacctgaagggttccaagctctaggacaagaaaagtcagtctgccatttgaagaagagtctttgtggattgaaacaagcatgccagcagtggtacaagaaatttgaattctttatgaatgaccacaagttcataaagactgaggttgaccactgcgtatttgtgaagaggtataagactgacgactttctgatcccgttgttatatgttcatgatatgttgattgtagggcaagataagatgaaaatttccaccttgaagaaggtgttgagctcgtccttcgaaatgaaggacctcggccctgcaaagcagattctcggaatcaaaataattcgggatatggtgaaagatggatagctcgcacttggcaaagtgcatattgaccagaattggtctgacatgatgactgagccgataccagtaaggaaatttgaagattgttgtgaaggtattgggctattgtgaacccgtcgcattgaagatgccaggttgtcgcattgaagaagccaggtttactgatgaacccagagtttttgtgaagatggtgggctgcaggtgaactcggcacattgaaaccgaaaggtgttttgggatgtttatctgccgcattgaagtcgaaaggggagaattgttgggttgggtttccttctttaatgctagcccaggcccgttgaggattctaaaaccctaaacctactccaccactataaattcattagttgagggtggagacaatagacaggagaagagagagatttcgatagcctcaagtgacattcttgagagcacgtttgaacaagttttgtgctttgcatttgagagatctctagagagacgtctgagtgtgacctttttagagaagtttgaataccaccatacttggtgatgtttgattgtatctctagtgaaaggctggggaagtttgactcttgtaatccattattattattattattatagtggaagtttaattctgaaccagtatcccgtgaatttttacttcttcacattgagaaaggttttcccacgttaaacaaattgattgtattcttttctatctctgttctcttgcatttattgttttgcttccgtaatctatttgagggtccttcttggcccaacacttgtatgatagtgaaactactaagctagtattcgtgactctttatgcttacttaaatttgatagtgttttcctttaaaaaaattgtcatggatcaaagatcatagttactcatcaatctattatattagatattaatcttgttcatatgttatatgattatgattgatttaaagaaattttacatataatgataataaaacagattgaattctttagctacatatattgtttttcatatgtgaacacaagaggatcttagaccactgcgtcatccctacatattataatgttttccaagattagataagagactttggattttgtcaagtgggtatgcttttccaaacataaaattccccacactatataagatgtttatatttactattatttgattaaatctaatgcaacattttccatgaaattccaatagtcacccactgtctctgaatcctgctctatattctactttctacataacttgaagcttgcatttttgcttgtaattgcaagtatttgagccgaattatcccccactcattggcaatcgtgcagactaatattgagtaacagtgggggttaaaattgtaatttgattacttcgcttcaaatttttaaaaatgtttgattcattctttaaattatttaaacacgttgaacatgttaatgttatgatatgagaatgatggtgttgattggctattacatattgaaatttcgctgattcggcaagtaatgttttgaacatataaaagcatgggtgaaaataaatttgatgtaaattcacaaaggaacttttagaaaattaatgtataacgtggggtggggagccaaatcaatccatttaggagtcaaagctaagtcagggatgctttagctaatgcatattgcttcattttaaacccacccacaaattctgatttgacaagtacctacttgttcattgtatattttttggtctctttaatataattaaattttgattttttttatctttttaaaatttaaaatcaacatttttttatcatataatattggttaattacttgtatgtttataacataaaatcacatagacatagtaaatagcatctaataatgtatcttctacaataatctattatattcaaattaagtattattataattgataaaattcttctgttgaatatttatcacacttatattgtaggactcgaaattaaaattgttgattaagcttaaacaaccacgtgagtcaacacacaattgtcaaattatttattaagacttaaaataaatttatttatttgtcttaaaattaaaagaaattgttaaaagtactttatggtcaatttgtgttggccatcactatttcctaaaaaattttctcactttgttaggtgtgctcaatccaaaaagttgaaattctatatcgattaaagtttatcagatagtcatgagaagaaagaatgaattgtgacctttaacaaactttggtcaacttgtgcaattgaaattcctaatatatttttgctcaatataccttcttggttatcagaagattcttatatataaataagaaaataacgtttactcacttaaatatacttggaaaatataaaatggcagtgcacaaatgtttagaagcaagttattaatattttttattagaaattattcttctaaagttattagaagctaatttctcaaattagaaaactttgatgttgcttttgaaggcataaatcaaatcaattttggatgaaactttggatatatgataagcaacatgtattttagccaatacatttcacaaaataaatgtttattttatataactaaaatttataatttataataaataaatatttctaaatacgcaaattattttataattaaattttggaacaatttaataccttttaaagtataaattatatttttagatttataataaataatatatgttgtagtatattgctattttaaattattgataaaaaaaatattcaaattcaagttgaaattaaagatgctaaatataatatattgaaaaggatataagatgttaagataaattgttcatgagaatgagaagagagtattcaaatgaaaaataaatgtgaaggaaagggatgagagtgcaggcttgagaaagtatatatatatatatattaacattcaaaacaatgttttgttgtagaagttataagtagaagttgaataacatatcaaaagtaaaatgatagcaatatataagactagaaactaatagagaaaggtaagatgatgatatttagttcaccttatatatcacttaggctatatattcagtccctaagttcctgctttagtaggtatttcttcactgtaatcactcagggattgcaagaagtatgtttactcataagtttccaaaggttttttaacatttagtgacgaaattacgtataaattaaggctttcgttactcggttgtcaaccccgatagatataaaactttcttaatattttaggttgttaaaatatcaaaataaaattcatccaagcaagtgattaattgttttatgtaactaaattgaaaaaatatatggtacatggtgaaattacccgtgatcattaaggtggatcatgtgtctacttagaatatatccaattatttttaagggaatatttataaattattatttatttacaaggtaaatattatctcttatttaaattatacaattgcatgctattatatgttatcttattaaccaattaattatcaaacaaaggtccatgactcatacttgatccacactgtaaatattcatgtccatattcatccagtacacactcaaaaacaatatccaagaccatctcagagatcttctacctgcatttacttactcagttatattttcatacaaaatctgaaaatcatctgaaccacttccaactctaccgatatttccaaattttgatactaacacatattatgtgacataacatatatagaaagccattacaagcacatattttaaacccaaaaggacatgagtttagttgtttatgtgccaacaaatacttgcatccaattgaatgtatcactattaattgcaaacatcaacaatccatttaagcatatgtataccttccaccaataatttactaaggtagaatgccaaattttaccctaaatatttatttgttgcattttttggtatggtttccgttctcctggactcgaattaattcttatatagcaaaagtacaccaacaattagagtcaaatttgtttaacaatgctgtaaaaaaatgtttaacaccgctgtcaaaaaaaatattgtttaacactatcctacatcgttcaaggtcattaatatttcttcacagaaatcatctaaaataaaaatataaattattactttagatcgtttaatgttaataggaagttaattaaaatttcatattaaaaaagaagataaaaaggtattgtaatattttaacaagatctaatttatttagttaaccttgcaaacatttttttataactacagtaaaatacttgcttgagtaaaccacgaaaaaaaaaagtcgattcaaacagaccttccaaaaagaatatataatttaatttattataacaaaccaacaaagcaagataccaaccttgaaaagaaaaattaaataaaagagaaagaaacttacacaagtaataaagcacatcatgatggacttatttttatttacgctcgggggcggcagaaattattacatcattctattaagagaacgggagaagtgctatgaatatattatttgatgcattttttttaacaattgatatacttttaatattttttattaattataaattttaaattttaaataaaatttattaaataagacataaatttatataatgtttaataaataaaggaaaaatgttaaatagatataatactaataaataaaatacgttatgtactattatttaattataaataataaattttttaattttataatattatactaataatttttaactatagaaaagtttttacattaaaattaaattaccattaaactcttacctaaattttctctatattttaataaatataattttaatattttctatatattaaaatataatatatttttatctgtattttataattaaaatataatatatggtataccatttaaattaaaaattaaatattatccataaggattagtatgattttgaatattagagtcaactcagtctcccactatatttaagtttatttttctaattaaagaaaccataaagatgggagtgggaccagttaatatggtcatattttgaacataaaatgacgaaattacccttccattagatgctttgtatgtaaaatataaaatattttccaaagatcagagacaatcacaaagtgtcccacgttgttgcatagcaagttgcgattgcgactctcttcctacgataaccgtttcctctcgccggaaaaccgacattgatctctctctccgtcgatccccgcccatccctccgccatgagttccggcgagctcctccacatacatccccaggagctgcagttttcctgtgagcctattcagattcaataaagattttcatttttcgcttcaaaattcaatttttcgtttttttttatttggtttctgcttctgggtcttgttctaatttcttgtttcttcctttttttttttaatttttctgggttttgggtttgtgaaaatagttgaattgaagaagcagatctcatgctctttgcagttgtctaacaagactgacaactatgtggctttcaaggtaccaattttactctttatgtttcttttctgattcacttctgagtttttttttttttttataattcatttttattcttttattttgggtgtagtcttttttttttcctttaatttttgtgtgttttggagacttgtaattttgatttgggggtgcacttcatggttttgcaggtcaagacaacaaatcctaagaaatattgtgttagacctaacactggagttgtgatgcctgggtctacttgtgctgtcataggtttctttttctcactctatcgttctatcttctctccctcattctccctctttcacacaaaagcacaattgcatgcaaagagaatctatcttttactggtgggttatatatggtgaaatattctatatttgtaattttgagtttttgtttttgtttcccccctttttttctgtacgatatttttttttttgaataaataacatataaactgacagtggaattcaatcacaaaccgcgtcgtaagtttgttgaattttataatatcaaacttaaagtcataccgatagttatacccaaaaacttttacatttacagtgtatgattattgaacttatattgttaagtaactttcttctctatgtattgactgttagtgtcttatttatgcaatcagtgacaatgcaagcccaaaaggaggcacctcctgacatgcaatgcaaggataagtttctccttcaaagtgtagttgcaagccctggggcaaccacaaaagatatcactccagaaatggtatctattcaacaaattactctgtttcttaatagaattaatacatgtgtgacatgttgcttaagttgatggttttctatgctcatttttacagttcaataaagaatctggtcatgatgttgaagagtgcaagttgagagttgtttatgttgctcctcaaccaccatccccagttcgagaaggatctgatgaagattcatcccctcgtgcatctatatctgagaatgggcattcaagtgctgcggaatttacaggggtgagtgaccagtaggtttttgcatatattttcaaacaatttttcatctttttggttaattaattgttgtgataaacatgcattataggcttcaaaagctttcaatgaacggggtgaacatcaggatgcttcttttgaggtgacatacatatataatttctctctgatttgcattctttgtcaattaaaagaaaatcggctaacattataatttctatcattctattctatgtggcacagaatactttttaattatggaaaaatctaatgcttgatgttggttgttgaccccaacccgagcatgcatgtaataacatctcctcttgaccccaaccctgaaggaccagttttgcatgtcgttgtagagaaaattcaaatatcatgataactctaatttttggaagttggaattacctttcaaatatttttgaaacacataaatttctaagctttcaagtctatgcattgatttatattactgttttggccttttgtcagtaatcttttcttcatagccttgatgtactgtgatttattttgttttttatttaagcatgttgtttggaaatgctcctgatgataaactgtttgaagtggattgattcgagtcattcatttgcattgaaaattctattattggaagaaatttgctggtaacccgattgaagcagttgtctcaactgcctcaaagaagagctcaggatcacttagtgatatattaatattaattaatttaagaaaaatggtgctcattttgaacttatttttgtttcaggcaagagctcttatgtcaaaggtaactgaggagaggaattctgttgttgagcaaaacagaagacttctgcaagaactggtgtggaatccattctgaaaaaaaatcttttaagcatgtttatacatgtgttatgttgaatgtttctacttcctagttcctatagatcttgattgttcacattttatgatatgcatttattaggatgaactgagttcaatatccttctcattatgtctaaatttacagtttggggaagaggagttcatcttagtcttgtgttcatgaatcaaagtgtatctaaatatcttaaaatcttggctgattttgagtgattaaggatcaggaaaatagaggtagggtagggaaactgaaaggaaactgttccgtttgctgcttctaaactaattttattttcagatcaaaagaaatagtaaactgaacgaacatatgcgtctgtgccaattcttgaaagcttttggttcagtttcatgttagccatatccataggcttagtctactattcattttgctaaactgagtatattagtatggttgttggacggtttgaaaatcaaccctcacaaaccaatggacatcctgaaattatctacatccttaatcaatcagcttatttcacatatagttttatatgcttaactattttgttacctatcttagaaatagaaaggagaattgtttagatggcttcttgtagtattcctatggttgacccttcccactgaaatcataccaggaaggtgggacttgtttgatgcctaatatgttttgaatcttttgactgctaagttagaagccatattcacacttttcttggttctatgttctgcttttctgatcacttcagattcatttttactcctcagactggatgcctgtttggctaacacatacaatcaattctttctaccgtgccacatgcaccaatgtaaaattgtggttgaagttaatctaggcacatatcccaaattcccaattgttttgtcctgagtggatgaggtgatgaattcaggcttgaatgttgtctggtccgaactgattgttgacttgactgaactgaatgcttgatcgtctgaactctaatttcaattgagactctggtttgtctaaagtatacgagcaatgtatacttgcaaaagacacactgacaataaatgtatatatctttcatcgtgatggtggtggtgtatgtatagatgttagatatgagcaagaatcgttaacatagggcccaaggccccttgtgagcaattatatgttactttgtgtgggtactcctagtgttgactttggtcaagactaggtgtgtaggattagtaaagatatgaggagttatgcttaagaccaatctgggtttaagctcagttcacatcaccaattacattcaactaattctactaaactttaaaacaaacacatcctaaactttaaaataaatggagtgggatttagattggcggacggtatgtcttaggacggagtggagaaaagctataagtctgatggagggttaaaccctttagtagttctatgttccagttgtttcctgttttaattcttttcttcctcttttctcttctcctctcaccattcttttatatttaactctgtttctctcttttgctttattttcgatttatcattgggttcatctaccaccgaccccaattaatttgggttaaaggtgctgttgatgttgatgttgatgatgttgactagtaagtcaaactgtagtcattactttttttcttttttgaagtaaaactgtagtcattacttgccgtaatggttaaatgtttgatgaagaagtcaataaatacatcacatgcaattattatcttcatttcataattctcatggaaaataatggattggtttggattctttcgtgtgcaggagcttttgaggcgcgatgccagcagaagccggggcggggtaccattcatgtacacagttcttgttggcatcattggactcatcttgggtttcctgttgaagaggacgtaacctgagtcatggctaagttctccaaaatgagatcaattgtagaaagcaacaagaaatatgtgcgatgatgtcgaaaaaccaatttgttgtcttattgtcatgtattgctcctacaaatttggaatgtgtggtctaaaaataggtacttgtatcagccatagcaatcatagacaagtggacaaatgtgtcatgggaagtgtattgttatctgatgtggtacatgtgaccaattctttagcagctcctatttcccaccacgataatgcgttttttaaactattaaattcttcgtggtaacacaaaattattctcaaataaaatatataatcaatcaatttggactatttactaatctaagcacaaactggctacgtgtaagcttttcctcaattactattgttcttttttatggagtaaattatattcacactcttagattttttcaaatagtacagtcttcctgttttcttaacgtttacatactttattgtggtattcgatataatgttttttaaataattaaggtgttggtgtaatatttttctaacaattaagggtattgtatggacagaaaaaggagaattgtatgtcgccttcctctcttggtcctgcgtgttcgatttgtaaatggttttcattcattattaactacaccaatgatcaatatatgaataaaatcaaatagaatccgtgcgaaggcaaagtactatactatccaagggttcaaattcaaagacaccataatgaaatagtaagaaactgatattgaaaatgtatcaaattacaggctgctgaattacattttaggttataaatgaacacatggctcacgaaagtagacctgtcaaaatgggccaatccggcccacccgagttggcccaccacgggttaacaacaaaatgagtaggaccagattgactcactttgatggtggatcagattttgtctaatccgactcaacccacattggttgatgggttatacggattggcccgcgagctggctcgtaaactggctcgcaggttgctcactttaaatttaaaaaaaataaaataaaaaattaaaaaatcacaataagtgtagaaaaatgcaaattaaatcaatttaagtaaatttaaatattacaaactgtatcaaacttaacctcaaactaaatgtacatgaaactcaaatataaatatgtttaacaatattaaaataataaaacaccaatctaactcctcaaatatcaaattctcatatctcaatcagcaatattaacttgtctaggaagagtattagaatcatggtttgacaaatcaatttcatttttatcataattttttcattatctttttttttgtccaacccgcgagccaacccaactcactcgggttcaatccaaatgggttgcgggttaagtgagccgggtccaaatgacccgagacctaggtgagccaacttttttgtaacccaacccaccaattttgcgggccaaaacgggctgacccatgggttaggcacattttgacagcactacacgaaagttactaagtatacagaaaaggaaaagcagcatagtacaaaagttatatatagtgataatgggatacaaggaatactaaatctgtatgtcactccatgaaatatatatacatttaacagtccttttaatatcttccaatgtgctatcaatctatcatctctgtctaaccatgattctatcaagattttcaagaccctttaatcaagttgcaacgaacaacaatcttccggaaatcatcaaggcttagctgcaacagagccaattatttttaacaataataattcaaacagtgcacaaaatttttcatggtaattttccacaatttttatcctaaggggtcaaattcaccaattttcatatttctctaaagatgtaagaaagaactatgttttctgaccttgaagttaaaaggaaaaatatgaataaagtgaaagagattaaactgcttagtaagtacttgcaatcaacaaaacatatttggactagtgtaagaactaagaatcctaaagaatacattctatagttcaaaaggttttagcaattatctgccaaaattaaaattgaaagtcataaaaagcttataggtttttctatgttcttcctgacctcctgccagaaaaacacacaaaagaccttctgatccttacctttccatctccatcaccatcgaagtagcgaatcatatcaactaactctttgtctgtccataaaaaatcatgagctgtagctgccctttgtatatcccttacacttatagttccatttcctgcttctgcatgccacaacttccttgtcaatacaagtttacaacagcttgcgcatgaattaaaaacagcaaagaaaaagagggaaaagacttctttattctcctatatgtcaaaccagaacttaatctagataaaacagctagatgttgatagcattattgaatctcttggcatctcattatttattaagagcttaagtagtgacttctctcttatttttatttttggtttagagaatgagggagtatttggtgtgatttgccatcatatcaaattttcaggtaagcactagtttgtgcaaatacgaaaaaccctgaaataaataatggttaaaaacttttcatgtaagttgtgttcatcttaaagaaaaacaaaaggaaaaagaatctgaactgataaaagtaacattgagtcaaataaaactatcagaaacaaaaaacagattttgaagctgatccataccaatgtcaactatctaatactttaaacaccaaatatgcaagcagttatacgttcaaataatagagtccttcaaacaatagtcctcctatgtaagcaaataaatagatgcaaaagaagagagcaattaactaccacactataagcgcaagaacgtggcttcttaaaccatactgtttttttgtacttggtaaaagtttaaaaaaaaaactccaaatattcataagttaaaagtgagggcagatcattgtttcccatttaaaattaaatggatcaaaatggctggcttacatataactctaatcatctcaacaagagcagcttttatgttggcatgatatactgaaactttaagggaaaacaaagttcctatttgatgaataatagatggagatttaagtatgactgttccaattaatctcttgccattgctctttgttcttaaacaaataaaaagtagcaagtacatatattatcaaattaccatctagctggaagaagtgtacaatgagctcatcctcggtcagttgcagccgactagcaaactgttgatgttgaaacagacaaatattaaaaatataaaaaaaagatccaatacaaactaaacagttataaacaaggaaagaaatcatttgaatagagaaatcgatacaaaccgattttttgttcttctttcttcccttatcttcttgaacatgaccgctaccttttttctcagtcttgctggtgttcactacattcttgtcaggcaaataagaaccttctgcagagtcttgcaaggaaagagcaattgcctatccacagacatcatacagttacaatgctgcttggcatcatggaaaaaagcttaaaatgtatatcagaaaaaaccaacaggatgtaaacattaaaactacctgcctcagagcttcatcatcatcataatcaatgtactctgaattactaacatgcttcttcccagagactctggctttctttttcaaacttttgttcttcacctggagttggtattaaacaaaaggatcgtgattgtaaatgtcaaaataattcttagaccagaagtgaagtgtctatgcacctaacttaccaaaacaacacaatgccaaaacatcttattattcatatcaaaccaaacaatgattactgcaaaatacagaacactttttatctttaccaacaaaagtaactcaattttgcaaaggagtaaacacaggaaaaaaatcccaataacccagtttcattaaagtcaaaacactataagatttttgttaattatcatacaatttatttaaagtgctaactaactcatttgcactttgcatgaggttctaggttcaaacctcactgcctccattgtacaccaaaaccaagtcaaagtgtcatctgccaactcatgttcttctaatgtttacactctaaacaacttggtaagttaaacaaaattataagcaactatcagcattatcagatgaaatggtttaaggagtttaaggagaaatgcaagtgacaccaacaaattgtggccacagtaccataagttcaaaatgcaaagagaggactgccatagaataacattttgtaaaacggtttattcaaaaagatacattgtgtagggtgtttgggtgagtttgtctaaacttatttcttgagaaaaatacttattttaataaaataagcagctttctgttttcttaatgtgtttgtctaaacagtttttgttttaaaaaaaaaaaaaaactgttttctacttattttgagaagcaaattctatttgcttattaaaaaagtgcgcttattttaaaattgtttttttaagtttaaattaaccaaccccgtctctatttatagagcttattagtaagttgtaacaaactaatattcctaattagttactcttaacagcaacatgtcaaatagccttaaatttctaaacttgtaacttaggtaagctacacttgttagcaaattgacacattcagagacaaatttgtataaaagagcataaaacatgctcagtttcagaaccaaagtatacgataactccacaaaataaaacataaaaaagagcattatttgaagaattttgacgacccacctttcttttccgtgaccctgaagcgttttcaattgcaaagttctcgtctttacggtcctcattttcttcacttgaagaacccgatacttgttctctctcgtcttcttcgggttcatactcttcatcatcgtcatctttaaccttcttcttcttctctttgcccttcgtggcgttgtggggctgcgaagaaccctttaacgacgaagcgatttggggcaaacccagagcctccaacctggctctgttctcggcgattctcgacatcctctgtttctcgtactccgacaaacccttcatcttcttcacaccattcccctccaccgtttgtgcatcctcggattccgaccctgaacttgaggggtcctcggattcagaggtttcgcgttccgccattttcggattgttctgtgctttttgctattctctttcgactctgtttttctttttcaccttcatcatgtgtactgattactgaatagagtagccatgtttatttttatgtttgggctttgtttgaacactgggcctgataactatagtgggcccaacttcaagcaccataaaattgtacacccattatgcacaccacctcctgttggaaagaagcaagcttcttttaagaaagagaattattttttttttcacagattgtagttttttttttttagtaatagtttgttttttaaggtgaaaaatgaacaatcatttttaaaatagaggaatccaatataagagggtttacaagtaatttacatgctttacttaactaatcgaactaaaccaattaataaaaaaatatacaaagccaagaaatgataaaagatcatacttcttggataatttaattacgaaaccaaagcccaaacccacttggaattacttagtttggtttgagatcatgtatgtcccaagaataactttgactccaatttatcatctttaaaatctagcttgcgataattttgacaaaaaaaacaatgttataaattgacattttttatttgaaataaaaactacactgaaaaaaccacttctttccctttccaacaggtggtgtgcattgtggaaccaatgggtataagttttgtttgtatgttactatcatgaacctaaaatataagcaaaagtaggtgaaagtacctattgagggtaattttaaaaaaaatttaccgtttgaaaattactatcatggacctaaaatataagcaaaaataggtgaaagtatcgattggggtaattttttttttaaaaaaattatcatttgaaactaaattttaaattaatacccattttaggctaagtcgtaataagtattatcacttctgaatttaaagtcgtaacatttattataacttctattttcttaaaaagaacattaaagtcgtaaaaaaattatgacttccatttttttaaatacaattttaaaattgtaagttttttttaattttattttacgactttaaagttgtaaagtaatatttttatattgaagtgaaaaattagattatgacttcaattttgttttattttttctaaatcataaatcatttatttattttaattatttaaagaattaatgtaaatttttttatttcatttaatattttctatattttttatatgattttatttattttctatatttttatataatattttatttaatatattttcacaagattttatttaatatttttatattattttatttaatattttctatattttttactattgttaagaattattatttgttttataaattaaaaaaataatgcaaaagacttaaattggaataaaatattaaaatatgctacatagtcatttaacaaacatattgtaacataatgagattgacgaatcaattctaaataggtttaagaaatgtttattatgtaaaactaaaaaacataatcgtaataatttttcatacaaataagttgatgattaatattgtttttactatttaaatttaactatgcattgatataatattttactttaaattattaattttcatgatataataaattctattttttactattaaatagtctcttatcactaaaattttgaatatatacacaatccaaaatttatttatgacattcattaaaaataattatgagtggttgattaaagtattaaactaatttaattagaactaaatgatttgatacaagtgattaatatgttgaaattaaggttgaatcattaaggtttttggcgaaaacaatgattgacaagaaggaaaagaaaaaactaatttaatataactagaatttagaattactttggtttggaattaagtttctatgtcttttttttattgggctaaaattctagtaaagttttttgtttgtcctttatgttcttgttgggctgctatccttgttcggctcattgcagtactcaaactccttcatgcagctacactgaacagcgtgtttggatggaagcctaaaatttgcgctaactttggaaaatacgcaaaaactatttagtgtgtgtttgtttttccattcaacaagcttcaaaagtgcgttcaagtctcacaaaacggtgcattggaacacgtgtcaatggattaaaacggtaaaacgaacacaccgttgttacttacacgtggaaattcacgttcgctctcctttttctatttacattgcgtttgtgtgtgtgtgtgtgcaatatcacgcaacacaaccttgttcgttcttcgattgttctgaggcgaaccatgacggacggtcatctcttcaacaacatcaccctcggtggccgtggaggcaccgtaagctctctctctctctctctctctctcttctaaaccctaatttttagtttgccacattcaagcatgccttttgatttcattttacatgtaccactgagagttttgctagcgaacgaatcttagggttttgctcttcgttttttcttctaatttgatttaatccattattattatcatcatagaagattacctatttatgtattttataaatgtgttgaaatttgacttgttctagttagtactaactagtgcggcatatttgtgcgttagtggttcttgtttcgttcgtaaaaccctaagggagtgctttgtttattagatgaaatgtggttcttgtttcgttcgtaaaatcttaaggttttaaattgtggtcatggttggggttttgttggggtaaatactgtcacagagaccccgacaaccttgatgatgcaatcgcagacagttttttaaaaccttagtagaaaatagacagttgaataagttgttttgggatcatatttctagttgtaccaagcaattggaaagtattttcgttccaatttttctaccttctataccagtaagtgatttcatttggtgttatgtaccatttatttaacattatgtaggaacaaacggaatatgcatagcccctactcagagttgcattgcttgttgttccatgtcaactgtcaagtttttatcagcttcattgctttttgataaaaatataatgataattagagagtcaaagaattgaatttttctagtaatttgtgcatatgagacttgaattagcagttgaattaagatgtgtgacacttcttttcatgtaaattgagattgcagaatccagggcagataaaaatatatcctggaggaattgtatggaagagacagggtggtggtaaattaattgaagttgataaatctgacataatgggggtgacatggatgaaggtaccaaggagtaaccaacttggtgttcaaatcaaagatgggttgtactacaagttcacgggatttcgtgaccaggttactttctctgccactcccgaatgcgtattttcatacatttgatgtggaaaaaggaattcaaacttttgttccttttattaactgtgacaaatctaaatattgaggacttggacttgtactgctagcaaatgctggatgttaatttctaatattgttattttattcatatttttgcaggatgttgtaactttgaccaattttttccaaaacacctgtggtatatcagtagaagagaagcaactttctgttagcggacgtaattggggagaagttgatctaaatggttggtgaaattacttgagctgacttatgtgttgttattgatattctccacatggcatgtcacgtgtatcttaaacatctatctgtcatccttacacgctaggttttgtaaatttgttttttggggaaaaagttagtttggcattatgttctgtttgatatagtagtactcatgaggaaatgacaggtaatatttgatttttggggaaaaaagttagtttggccttatgttctgtttgatatagcagtactcatgaggaaatgacaggtaatatttttagcaaagggtagagctctcctattttcaaagaaattcagttgatatcagtatatcacccagtttgttcttggagagcattggttttttctggatagtgcaggatgattttcatatatgaagaaaggctgtgattttatgtgctgcaactttttccctccccaatttgcagttgcttcttttcttttgtcatactcttgactgttgaatgcatttaggcaccactacctccactttggtaatcacatgaagtgcaattttaagtgaaaaacactagttaagataggaaagtggtctttatttgtgtatgagttttgggggtgggggtggtggacttctcaaagaggaactttatctcattcttgtttttctttggtgaagcttgtttaataaaatttgacttgactgcttttataagtagttatgctagtagagtagtgggtgttcttattgtccatttccatttcaggaaatatgctggctttcatggttggttcaaagcaagcttttgaagtgtctttagcagatgtctctcaaacgcagcttcaagggaagaatgatgtgatcttggagtttcatgtggatgacacaactggagctaatgaggtatatctatattttcatgcacttatattgtcttatatgttttagcaaattcatgccaaactggtagctttttgcaagaaaattgttctcattcaagtttgggcttgtgcaatattaaagactctggttatttggtttaattttttatggcctaatattgtttatgttatgatctcagaaagattcactgatggagataagtttccacataccaaattccaacacccagtttgttggtgatgaaaatcgtccccctgctcaggtgagtttgtttcagactataaaagatctcatgttataataacttctaggttaactgacatttaattttttctgcatcaggttttccgtgacaaaattatgtctatggctgatgttggtgctggaggtgaagatgccattgttacatttgagggtattgcaatccttacaccaaggtagtgtctttaaatgcttagacatgtatcattcaagtatttttggcttcatattgtagtttattttgtattgcttgtatttgtgtcctttcaataaatatatcaagtatcaatatttgttaattgaaatttgcacttttttgtagaggacgatacagtgttgagttacacatgtcattcttgcggcttcaaggacaggctaatgatttcaaaatccaatatagcagtgtggttcgcctatttttacttcctaaggttcatttcctgatcctgtactttcatttaataagttgactgatatttgttttcatattaagtgattaagtgacaagtaaaatttcaatgtgattagccagtcatgtctttaaattgatgcttttcttttgacttgttaagtgtactgacaatttcactatgtttctgtagtctaatcaaccacatacctttgtcattattagtcttgatccccctattcgaaagggacaaactttgtaccctcatattgtgatgcaggtaaacatgctcagtagttcatgatttgccaatttatgtgatgtgtattttacttgcttctgaacctaacattgtttcactcatttctgtatagtttgaaactgattatgttgttgaaagtgaattggcaataaatgaagatctttataacacaaagtacaaggacaagttggagctgtcatataaggtattttgcttaaactgttaataattgattcatgtcattatataacccgagatactgcctttcaagtactgtttggggaaaatagaaaagaacatcttaaccattttagatgattgagtgatgcatgaatttgttaactgttggtcatgcatatcacatgatgcagtgtctgatgtgtttcattttcaattcaataatcagggtcttattcatgaagtgttcaccacaatattacgtggcttgtctggtgccaaagtgaccaagcctggaaaatttaggagttgtcaagatggttatgcagtgaaatcatctttgaaagctgaagatggaatcctatatcccttgagaagagcttcttctttctacctaaacctcccactcttattcttcatgaagaggtaaaatctgattgttcttacagataaccaaatgtcaattactggttgatatagcatttgatatttacatgatggaggttttaattgtttttttttcttttcctattagattgactatgtggaatttgagcgccatgctgctggtggctccaatatgcattattttgaccttcttatcagactaaaatctgaacaagagcatctcttccgtaatattcagagaaatgagtaccacaatttgtatgaatttatcaggtaaatgttagcctattgccaaattctacatacaactaattgttatataaacaatttgtttttggtctgcacatccagttcaaagggcttgaaaattatgaacttaggagatgcccaacctactgttggtataaagaaggttcttgagaatgatgatgatgatgctgttgatccacatcttgagcgcatcaaaaatgaagctggtgaagatgaaagtgatgaggaggtgatcaaacagatattttatataactttcacctttatctttagttcgtaagtagcatttagtaaaattgcgttcttgttttaaaaatcaaggagacaacatttatttatgttgaccaacatctgaaaatagttgggcatgaaaaaatttaagtgaactcagcttacatttcagtttttgtaattattgaacttacatccataagtatgtggttgacaagtgtctatccatttttgttttttgtgttttctgttttgcttgctattgtgtttgtgggcatttgttgtgtgcttctgtaaggctggacttagacaaaagttgatccactttggtctttgggggggctcagtgttgcaggattttcctactgttgtttgtttctatatacattaaatggtggtaattgtctataggattccgattttgttgctgacaaggatgatgaaggttctcctactgatgattctggggcagacgattcagatgccgctgatagtggtgatgagaaagaggcaagttatttttatttatatttgtaatctgtgatacttctctactctatatttttgctgtgtctgacaccttaatggtgaccaattttcagaagcctgccaaaaaggaatcaaagaaggatctgccttccaaggcatctacttctaaaaagaaatcaaaagatgatgaagatggaaagaagaaaaaacagaagaagaaaaaggacccaaatgcacccaagagggcaatgtccggtttcatgttcttttctaaattggaaagagaggtgcgatctattctatgtcatattggttgtatggttttggatttgggtgtgtaagctgtgggtactgttccaatgtgtctggacagtgattcattgtagcaaaaaatgacctttagcaacatttttaatacctattttgattgtaagatattaaaaaatatacctgaaatcaagtaggggtttatgtaagtcaagttctatacttctatttacttaatatttgctgactttttttttttttgacagaatctaaagaaaactaatcctggaatttcatttacggatgtgggaagagtacttggagagaaatggaaaaagttgtcaggtatcgctggttgccaattgtttgatttcatgcagttccacttatgatctgagttttatgtttagggactaaatcactaattgtactttgtttttacctattgaatgcacagcggaagagaaggaaccatacgaggcaaaggcacgtgaagataaaaaacgttacaaggatgagattagtggctacaagaatccacaacccatgaatattgattcaggaaatgaatctgacagtgcctaaggctgtgaaaaaaatcttgcagttttataaatacttatgcagcaagctaatgtaagccatgcgccgtatatttctcactggtgatggcatctactcatgcttcgtaaacttacacaagtttatgactaactgatgtaggatttggaacattattttttgcttcaactgttgcacgaagaggatttaaaatattggatcaaacctacttttttattgttttttgttccagatttgcagattggtgcttgatctgggacatgcatccgtttgaatgtgatagtaaactaaatgttttcttacgtttggaaaatcagttttgtaaatgttcattgtcagaactgtccacttagaatacattatctaatacatttttataattgattgaaatttattggaaattatgtcggtttaatttattttaatgaattgtacttttaatttgtagtttttgacaaagtgttggaatgagttatagaaagtgttatttattaggaagaaatcttctccagtgaaaagaaaaactgaaatgttaaatttgagagatccaagcgtttattgtttacttgttcatctactcattttatagtgtttgactgagacacattatatcccgtaccagcaaggaaaaaagaaaggggataaatcaattgtacaaataatcctaaaattaataagattttgcttagatattttcgaaattccggaatttgattcataggcaaacgagagtagaactaagcatcaaggaaatcattgtcaattgttcaagtaaccccttcaatttcatgcttctagctccttcaatggtcacattgcctttctgattttttctatatggaacacctctcccaattctctttttttttttatcaatattattattaagaaaagtttaggtaagttggattttgaaaattcacaggaattatgacaagtctcaagactcatagcacttataaatgtatttataaattacccatcaagaaagttttcacattggtagcaggaatcaaatgcatgtcttttttatatgagtttgtttcttattaagtggatcaatctttattgatacaatcatgtcttctctattatatataaaataaaataaatttaataattatgtatagtaaatctaagtatgtaagtgtaagattttacataatttttacatagtcaatcaaacaaaaattgtcactggtgatgtgactttaaaataattatgtgaaagccaataaaattatatatgcttaattatgtttttagtacttaaaataatgaattaagttttggtcctccaaatttatatatatgtctcaaattaaaataaaatattttaaatttaagggatgtgtgtacattaaataaaaaaaatgtgatattttttatatttataaaaattatattatttgtttaatgaaataaaatatatcatttatatcattttcttatgatattatatgcctatatttatgtaatattttatatttttaagtactcaaatataaaatcactttattaactgttttgccttgaacccataaaatttcagcacccgtttgcttttcatcacattagaacacagcgatttgtttgagagctaccatttctccctttcacactaagaaattactaacttaaaatgagactttaaaccatggttggattataatacagttgacaagttaaagtatacacatctttatggatctatgtcatgtttggaatataaactttaattcctcgcctgcgtcgtatcagaagacccaaaactctaaacatacgcgcattattcaatgcttaactcctaattttagtgaactacaataatatgttaactaccatgttgatccattaaccctaatctatgtagcctctatgaatatgacaactgaaaaacccctattgcccctatattgtgcaactttttaataattcacttcatattaaataaaatgttgaaattgaaagtgaaaatgcaaaaaaaaaaaaaaaatcaatctattctatacttgattcttaagaattattgagagaaattagcagaaaaatttaaaactgttcctttgttactggtattgtgaatggaaaatatcgaaaatgctaactaagagaataacaagagtaaaatctcattttcaagttgtgtattttactttataatattttaaaattagtttttaatttataatgtaagaataaatataatggagtactatttgtaatggagaagtgtctacatataattactctttgcattagaggtaaaaaaaataaactcgaaagtaggacttacaatatttaaatttgactcctattttaaataaaaggcctaatattatctacttgtgtaaatatataatttcaaaatattataaaattttaatgcagtaataataacaatgttatattatttttatgtatttatcaatttaaattaatcaacatattaagtctaaaaagatttgtaaatgactaaaacccgaactaaatttaaacaagaaaacaattcaactaactcattcaatgaagaagcctaatttaggttatgactatctagcaagctacccataaactcctaacaaataatttaacctatttatacatctctagaaaaaagaatacaatacctgacataataatagctacctaacaacattcccgaaaatattttaaccatgtgtgcttgtataactttgcttgcataacacacattaagatggtatataacttagtagacataggctgcatttatgtgccaaagtttcatgtattgtatttttatatacaccgtgacccttaaagtatataacagtaaaatttcttttacccaaaaatatataaaaaaagaaaaaatatttaatgataatttaagaaacacccctctgttccctcttccagttattacagctaattaaattaaatactattcattgtctattttgcaagtggaactgctcttgcaggaccacataccactggcatgcctttatttcgagattatgattgtggatatccatagcatatttctcaccctagtttaattatttgtattggaaacatgcttacgaaagcatgtacgtgatacacccaaaaaactatatatattacgtgattgtgttagttcatgtattaaagaattgagttatttatatttatatatcaataaaaaaaaaagtttcaaatctttttacatggccagaagtgtacgatgttgtccatagagcttaagctagattttggcattctctgttttctgaattcaggggcaaaaaatagttataagaatagatagtagcattgtagttatgtattcccaatgtaaagtttgttttttttatatgagaataaacaactctttactttggtttttagctataattataaaatagagtttctttgtccttatattttttttttatttagtttggcattattgttttagtttcaataaaattataaattttttaaataagttctaaaatgttgcaatcgagaccataacgggacgatgaaccaaagaaactgtataccaagaataattttgataaagcctgaaaaaaaatctttaaaaagaaaatagtcctcaaagtcaaaatatttgggtttgagagttgattatgcttcgagaagatgttagcatcttacaacatatccatcataaagatgtctgactctaattaagtgtctagaattaagatgactataattttctttttccatttgaatattttctactaactataaaaatatttctttcactcctttgaaaaaaaaataagaatcaaatttaattgaatgaataacatttgtttagaatatgaattaaattatgaaaaggttaatatattttgtcataatgatttgattctcacccttgtgtatcagtcaatgaggaactcaaagaatctaagtcatgtagttcttaaaataatttttagtgtcgattgattttaactaaaatagtgtgttaactcaaaatacttaaattacgtattgtgttaaaaaaatcaaaatgctcaaggacctattaattatttattaaactttataaaatcaaaagaacgaaaatttgattaggaggttcagcatttgttttatattttaacatatttaccacttgaaaccgaaaggttttccagatgaatttatttacaggtaaaaaatagaataaactttttgcaatgtttttgttcagtcagaaagcttttgtgtagctacaatatttagaaaatgaagaaaaaaaaatgttttggggtactatatagaaaatgcagcccgataactcctcactttaattaatatatagaaaatgtaaagttttgttttaaaaaagcctttgtgtcggttatgtgttttctggcagtctgcagtgatttgttttcttcgtaaattcttgattggtagaagttatattaaattttgattattaaaattctgacagagcctttttaaaaaataattagttttcctgaaaacagattcaaacatatataaataatacatacatagacagtgtaaatcttttttttagcactatcctctctttttggtgaaatttaacactatcctctaatcataaacaacaatatatcaagtgtttcaatagtcatattaaaagttatttctgattttttgacaaagtaaaattttgtattattagtactatctattaaactctgaacatttattagtcttaaatttttcatatatatatatgaaaaataaatttcttgtcaactaaacaaatgaacatgactagcatgctaactaactaatttaatcactatttttttataaaagtacataattggtaatagagatcaaatcaccaaaaaacttaaatacatgttgtaaactaatttttaaccactgacctaactaacatgcgagttttataatttaatttaatcattgatgttggattctggttaagaatgcaagaacattaagtactcaaagaaaatgatttcaagttaaagttttaaatatataatcatgttaaatatttagagagaattttgtctttacaaaagtaataatttttgtaagtagttactttgagaaaaactcataaatttaaaactgtaatataaatataaactattattttttaaaaggacaacaaacggtttgtaaaaaaaaaatttaaaaaaatacaagtgtatactaaatgtgaaagaattgatgtttacttcttttttcctcataagtagtactcatacttgggcgttataaattaatgatcaaaagctcaacctacaataattaactttgataaacatcttaactatatatttaatttgagaaaacatagacgcccaggagagagatcttttcccttatttgttgtcacgttataaatctgaaatgttttttttatacataacactcgaattcaaaattttatttaaaaaatttaaacttagttccactcgaaactttgcttcacatgttgaactttaagtacttatttttgtttgatttaaaaatttagaatgtatttatactttctttttagtttagccagtcaatggaaaatttataatatatttattcattttcaaatatgcatgtgtttatttgcaaattgaaaaaatgtgcatcttgtcatattttcacgtcaaattgatggaataacgcaaaagctattgtgtatatagcttgtaatcagatattgttagacgtagaatcaaatgtgtagatataaatgtttactttaatttttttttcgaagagatatgtttagtttaatttaaatttaaaaatatattttttaaaaaaataaactaaaccaaacacgtattaagtgagattattaataacagtccagtataatttaaaaaccgtagtgtttgagatacccctttttttatgatgacatcaatatttttttttataaaatatcaacattagattatgaatataatttttttaaggactcttttgaaaagtatttgacaaaaaaatttaattatttaataaggtgttgaatattgtattttttggggaaagaaacgatagtatcatgagttgatcaaataattggtcaaatattttaaacatgattcacgaatgtcagtgttcgtctccttgaaagttcagtcatacacaattacattattaatacctaataattgatgttatatttaaaattacatataagtaaattaaattattttatacttaccaaatatatggatcaaatagtgcgaggttgttacaacttaattattaatcttatgtttaaattttaagtattcacttgtgtttagtactccaaaggaaaattttataatatataataatcttactcagttcaaataatatttaacttttatggagaacatgtattttatgtaaaaaaataaaaacaaaacgtttattttacagttttttttaatattttatataaaaacattttcaaattaagtaggataataaagttctcctactttaaatgtatgtttaaatacattgttgattttcttattttataaaacctgaattttttgtctcctattttaaactacaacatttagattttttttttcaaaaaaaaataaagcaattgttctcttattttaaaataatgacatttagtcttttcattttgtaaaatctttaattttggttcttccattaaatttaaagggttaaccgctaagaaataattaatttgatatgatccaaatttaatgacatgaaattatttatttaattcacgtcataactaatattcatcttttaaggattaatatttttaatttgatggaattgatcaaaattgtaaattttaaaatttgaaaattaaatgtatttattttaaaataaaaaataaaaaatacattattaaaaaaatagaggaccaaattttttaaactaagtctttaatgtatttcttttcaacacatgcgtacacctacaatgtccctattattatttttattcttaaaataaaaatacaaaaacgtttcattctagttattattattactattattaaaatagaattataagaatatccaattctagttgcaaagctgttcgtccctttcgtcccgccaccaatctgctgaacaggagggtgaggaggtgaatttgacctgctttttaaaatttgtcggaaaagccaacccattttatttttattttataagttggtgagtcaaattagttgaataatagaaatgaaataaaatattctttttgaaaaagagtaaatgaaatgataagtaaaatgcgaatgtatacaaagattgacacaaaaaattgtactgggtttttatacttaaaattgggaaattaattaaaaaaatttagtgtctggcaagttatttttaactagtttttttttatagtatatttgattaatttatgaacttacatggccataatagaatcgttaaaaaaatcatatactatttgaaattatatatatatatatatatatatatagatagatatatctgctcactaataactagttttattgagcactgttaattcaatacattaatacttttttttctgaatgacaataaattaataccttttaattaaagaagttaacatttaggttttaactaaatttttaataaattctgtgaaacataaaatttaacttctttttacatatatatgattgtaagaaatatctcccatgaaatctctttcacgagttttgaaggggcacaaaaatgagatgtcacttcttaactagatttacatatacaaaagtccaaatttgaatccttgatcactatttgtaactcaatctgtcaaaagataatgaattgacctgacaaatcaaacgtgatttgccaatactagccataaatttattggctatttcaaaatgtgaaatatttataaccaataaatctgtacgtgactgatttcataatttgatcactaacaaattcttgtgcaaagtaacacaattattgccaagttaaaatcagtcaaagaacaacaatttttcctgcattggagcaaatccaacattttctgatgattcattttatgttctgatcttgacagtaaagtcagtgtagtgtaattgagataaaatggatttcttaggttgtatttttatgatactttaaaagttattttaaaaatacttctcataaaatatctttgtgagaatataaaaataattaataacaatcattaaattatgattaaaaataatagaggttaaaattaaaatatttaaaaattaaaattaaaatttaatataatcattaaatctctaaaagattcacatcatcatcatcatgactgtcaccacctctatcgtcatgaccatatacatcattgccaccaccatcgacagcgatgataatgacaacacgacaaagatcatgatgataaaggtgataagacgacaattaatgacgatggtgatgacctcaatattgatcgtagtgacgacaatgactatcataaaggtgatgaattaatcaaaatattttagaaagataattgatatttttatagatttatttgttatttaactaatcttttagaaatttgatgatatattagattttaattttaaattttaaatggatgattattattaattattctcgtagaagtcattatatatatatatatatatatatataatttcatcggtaagattacgagtaaatcaccaatattgtccattttcttaagtggttcttaaagtaattaaactatccaagaaattcttgaaacattgaacatccatcacaatacacggcaggattggtaacacttctaggatcacccgcatacatatatagtacataaaattggcacaagacattcatgctacatattaaaaccatgtatgccaaattcaacccctaattaatacagaccaatcaggcaaaactaaagcatggacataaatgtagagcaaccacttttggctctaagaaatttgctttgccttcaacataacagcaagacactcaccaatccttagaaatggggaaaaggcatgcatatacccttattaaatgtaacacactagtaataactgtagaatctagatgtcaacccacaagtgaagaacatttgggtggtgcatctcattaaaaaagcctaaatacataaactaggtagtaagttatgaagcacctttaaatatataaggtaataattagttgctgctgctgctcagcatctccaagttgaaactgtgatgagttctttcctctgccagcatagagcaagagatgagtactttctctccaattgaaatccccttacaggtgccttctgcactaaaccctcagcttgagcttctgtgaaattgctaaatgtgaatggagagaagccatattgcagaaacatgttcctccaagtaggtaatttttcctgcgaacggaggggacttaatatgatcttcttaatggctggaaggatgaaatgcttctcaatcttttggaggacatctaggttcacattcacagcatcaagtgattcaagcaaggctgagtaaaagtgaagagcatggactacattggaggaaaatggtacatcaattctgtcgaaatttcgatctagagtgaccacaacttttggcctaagctgctttacaaagtgaaggactgacggaaacaacgatgggtggtttgtgaaacaagaaagtggcatgtacacagcaattgcctcattatcatagaactggacggagagtggacatgaaggagtgttcaatgattcaatgcttaaaacattgagctcaaaagacatgttaaagtctttcgcaaattggttcaactcttcttgagcgatattgagctcaaacccatcacaagtgaggggtgatacaatggcagtgactttgagcgaagtcacgcccctactcctcagggcaagcacttgcataagagaagaccattgcactccaagcccgatatcaaaatcgataatgtgaattcgatcaaacctttccacagcttcaatgattggttgattactagtgaagttggcaaactgaacaacaggtgatatctcagaaaaggacttatatgctccaattttgaatatggaactgatggttgagaaggccaaggcattgtttacatttgaatgaagcagtgacatcaaggcctccttcatgtagaaagcagccctttgaaaaggcttaccaattgaggagagctggtgattgagccgcgccaatatcccttgcgcttgaaccggattaccagcttctatcagctcagcagttttgtatagctggtcaaatatagcctgctgaagctggtggcttgcatcttctccggtggaactcaccttctgctgtttagcagaaggcacaacctgtggttgcatatggtgaggaaacaatggaagctgtgtgtgttgcctcatatcaaaaccctcttgccccgagtccaaaaggggcaaccttggaccctgataactgtgccctacaggttcaaaaaccgggcgttttgcctgatgctgagagaaaacttgctgctcctgcaattgggggtacatcattggcacaaagaaagaagggttatcagagaattggacttgattctggttcaacacaaactgggggttgatgacctgaggcttctcgtcaacctctccaaccacttgctgctgctgctgagaattaaacccaccaagagatgttgaaaacaacaaaggactgttaccagaaacagaaaacattgattctccaacaggcaaaaaaccagccttatcattgtggccacctatattctcagcaatgaaagggaaaccagggtaattattattccctgaagggtcaacaacacttagcatattcaacccttgatccacaacaccaaaccctgcattgaaatcaacactttgttgagaactaccctggaagagcttgctcaaccctgcagaagggtcttcagcatctcccatgattagtctcagaatggattgatcttgacactcccactcctccatcattctcacaacaccaccaccacatttttcaggtgaagtttccaatgctgcctgagaaactgttggagtgtaacaaatgatgttgttattggttgagccacctttgcttatggtgttgctgctgcctagggaagaggacacagtggaagagttagggcttcttctggtgtcaagaactgaggtgggctcagagcttcttcccacatagcaatagtcctttttgtctatggtccactttggttgtggattatgcaaaagcactgaaaatgaatctgaagctgaagagaaatccaacactcccttcccttgaaactcttcatcaaaaggaaagggcatggccttcatctaagaaagttaactattaagggtatccagtgccccccacaaaaccactccagtttcttcaaaaaagttagcacctttggctcaaaaccggtttttgaacaaatggggttggctcacaaaaaccagaaacaaacaagacttggaaaaaaggaagcaaaaactgagatgctaaagtttagaaaggtggaattttggactgcaagaagaaggctcggaattttggtgggatattcaaaattgttgaagtcacaaagagggttccaaagatgaaaacttgagcacccataaagcttgtatttttctttctggatctgtggcttattattattctccaaacagttgcagtgaaggaagagagccatgagtttgttgcttgtctttaaaaaaacaagaagcacacactaacttgaacaaacacccttaaagcttgtccttttctttctggatccgtggcttattaagctccaaatagttgttgaaggaagccatgaatgtgattctttgttgcttatgttttctgtgcgaaaacactctttgttacttgttgtgttttctgggatggaatgctctctctccctatcactgtttctactttagtttttaacttcttttagtttatgttgtctgcacagtaatttttcctccggttggtattgttgctttcacctcaatgctctttccccagtctcagatgtagcgcgtgatcaatagataattctcctttatttttattttattcaaaaaaaattaggtgaattggatttatagaactcattaaaattaagatatgactcaagattcaattaaataaacaggattttattgattattcaccaataaaattttcatacaaacaataaaatttgaactcatatataataaaatataaatataatttttatcaactagataaatatttgttaacatatatctttactcttataaacctttctggtgtccactgcattgcagagggtgtcaattttcatttatcccagtatcatatgatattttgatttggtcaattgtttgagcttggaatcaggataactaattttataatagtatttgatttgataaataggttaaaataaaaggaaatataaaatatttgatatatttaatgtttattgtgttgtaaaagtaaaataagatataaagttacataaaacacatacattttaattttaatattatatatgtttcaatcgtaaatgtcccagcatgggattttgcgatgacgatcatagagttcattcacttgtttttttttttcactcgtgatattggaattcaatcttttctggttgtgacttatgagtgttggatatttgttgaaccctttatgcataaaacgatttataaagttttgatgataacaaataatgaatgtcacattattagattaattgcaatgataataattatttgatattttgaagttactaatattttggatttgatattttgaagttattgatattttgaatttatgaagatcagcataattgataagattatttgaagataagattaagtgaagaatcctgaagattgatatcattcaagatgacatggaattaagaagatttgtttctatctcagcataattgataagattatttgaagataagattaagtgaagaatcctgaagattgatatcatttaagatgacatggaattaagaagatttgtttctatctcagcataattgataagattatttgaagataagattaagtgaagaatcctgaagattgatatcattcaagatgacataaaattaagaagatttgtttctatttattttttagatattatgtaaggagattagaagattgatcttgccaatacatttatctttaagattgcattcaaaaataggatagaatatttttaatattgcattcaaaaataagatataatattttaagattacattgcataatataatagaatatctttaagattgcattgcatgataagataaaatatttttaagataaaatagaatatcttttaggaattcattggataaaatcatatcattaaattagtataaatagacaaatactcttgtgtttagagtgatgcaattccattccaaataatattagagtttcagagagtttgtgtttgcatcattgagagagttgtggtgagatcatatagaagcatttggcaagtttgattcttcaactctccatcaggatttaaaggtacctatttgcttaaggaatagaagcgtaaaggtaactatttgaattgtattcttcttcttgactttggaagaggtcgcaactggaaaactaggataccagtttttgtctctgttcttggtgaattgagacgtgcgacttttggctgggaaactaggataccagtctggctgggaaacaaggatatcagtctgtctctattcttggtgaattgagacgagagctttttgctgggaaacaaggataccagctgggataattgttgtgtaagggtagactaggaaactaggatactaggaactcttgtacacaaaattatcatagtgaaattgtccattggattggttatccaatttggacgtcgtggttttttcccaattgggttttccacgtaaaattgattgtgttatctttatcttttatcttcatattattgttttgaatttgattttaaattgtgaattattttataaactcaattcaccccccctcttgagttcatctggggccaacagtgagtacgtgtactacttgtgacgctttaatcaatgaaggggttaacaagtagtgaagtatgtatgggtaggtagaattggattattatactttctaagtgaaatccctttatactgcatggtatcgtattaaaataaagtaataatatccctaacaagtaagaaaagattaagggtattgttttatgggaatagagtagttactcgaattccttttgagatttaagataaatttattatctaaattttgcaatgaaattgagaaaatattggtccagaaaaattgctgtttaataagccaacttagaattgtaggcaatatatcatatatgttgctatgctattgcatgctatcatttggtagcaagacatcattatggtttgctatggtattgtgtttcttgtgctaacacctcaggacaatgttaggtttccaccctaggtcgtccgcggccatgggtgtctttttatggcatataatttggcttagaagaatagaaatggagaggaaagaaatttaaataataatgtatttttttttaaaaataacttataaaagtgataattcaaatttttattattttttacttttttccattcaagttttactttgttcttgcctcttttactctctttatcattccaaacacataattgtggtctgtttgttttaaaagtaaaaaggaaaaaatgattgtggatagaggaaaaacaccataaagttcattatttccatgatttggaagctcttgtttttttttttcatcgacaaagaatgtatatttatatagagtacaagaggaaaccaaactcatacagaacactaacgtatatactagaagatagttaatgcactgcttttatacacaagaaaggattcacaaaccaaacaaacaaaaaagtaaaaaataacaccattcatctcaactaataaccatgaccacgatctaaatttaataaggtgaaacatttatggtgcattatcttgaaagataatattatttccatgcaatcatatagaccattgtgtgacaacccacaccaagccaattattttttacccttttatagcacaccaatgttgtgaaaaattgttcctacaatcatagggcatcacgacttgaaacccaaggcatttgtaacatagttgcatatatatgaatgagaaggagcatgtgaacatatgatgagtagttgtttcttcctctaggcagcaaaaaggacatcaagtatcattgttattcaacactatttctttttattaagttctctttaatttgtttgcatcatgtctcttgcaatttgaatttgggactagctcatcctacaaaatcaatttttaatatttttatcatatcactaatttatgtgtgatctccaacacatacactcatgtcaagggatacctgccacaactaaaatgggcaagaggtgatcacaattacgatggctttccaacactatgccacatgctcaaagatacccgcttggaacgtggaaaatgcagatgacccgccaattgatttatgataggttttgatgtcattttacaaattatttttgagcttaactcaatcctacacaaattacttttaaggtgagggttgtttgatatataaatcgtattttgtatgcattgggatacaagtttttgccctcaattagtttattttatgtaaactattttagtagaagtcgcgtttttgaattatgtgtgtaacaggaaggcccccaagagaataaacatgaaaataactataaaaaaaaatgatgatttggagaatatgtggacatctcctgaagagcacacccatgttttattcagaacacccatgctatttttagaacgatcatgctctttttagcacagtcatgttcagtttagaacactcagagctataacagaatgatcgttctcaatttctagttaaattccaaacaatgttacaacttcttgagaacagttgggctcttaagagcacgatcgtgttgcttctcaaattttattttcaaagttgtccgccaaaacaaagcaatcatgctctttaacaacatggtcgtgttcttgtctgtgttagttacattttattttataaaaggggaaattgggtgagggatttttattctttttctctattcacaaaaattggaacatgatgagtgagctaggtataatgtgggagctttgttggattggagagaacgtgagaagaattaaggaggctctaacatgtaatttctcttatctttctcatggattgaacacaattccttcaactattgataaaagaccaaattgttaatttattgtgaattgaattattacgggaatacaactagtgttttgggtatgatatcgaaatttaggtccattgttacttcgctcattagcgatcatattttacgcattaaagtgagagagaaaaaataattcgatattatttggttgaatagagaaatataaaatagtaaaaatatgtctggaatccactaaaaatatctctcctttgtgaaaaaaagaagagaggaatgagagattaaaaaaatgaaagctatcaaaaaattacaattttaactttgttatttcttctctatcccacaaaatctagatatagtaagaataaatatgtatttataagaaaaaattattttctttttctttaatattcaatcaaacatgtggaaaaaactcaattttttattatcaatttttatcaacaaatgttagtttattaaaatattaattttgttaacaaaagatattaaatccataatattttccatcgttttttctctcttttaaccatttaatacacattatatcttaattgtaactttattgtataatactactatataaaatctacaaagtagaaaatgtttattattatttttttgtgtaagataaattaatgttcataattataattaaactttagaaatagatctccaataccaaagaaactttagaaatatatcttttgataaaatatttggaaattatttttaatgatggcaagttaacttgacaggaaaatctagtgactaatgcccccaggttatgacttatggctaggtcatcacgttatataaatccttgataagcataagcctaacttgtttccaaaaatataaataataaacacccactgttaggatgcatgcatcctctcttatttcttaatctgtatttgactttattagtcgtctatcatcttcatcttctattatctaaacttttcacttacacgttgaacttgaaaccttcgtcattctaatattagtattgtgcgctataaaaaaattgaaataaaaaagtgtggaaacaccaatggaagcccactaatactgcaagacatgtaataatgtcaaagacacaattatatcagacaaaccttcattaaattaaattcaaatattaaaatctcaattgttatctataaaatttaaaagaatgtgtgttgacactcgtataccaaatgaggactattttttttattacaattgtatacgcttgagtcacaaactaatattattgtcctttttacaaacataaattaatatgatttataattacctaagtttacccatccataatttttattaaaaatttaaatatatgaattaaaaatggtatagaattttaatttactaaatcttatttaaaatataatttatcaataaataaactattatgtttaggattaccttcttctatctctctctctctctctctctctctatatatatatatatatatataaattacaaaaattgaattattcatatatatatatatatttgaattatagtataatatattataatatttgatgtattagtaatatattgatttcttatatcaatataatttgctggttagtaaactatatcatattgttagtttaactaataatatttatattggcaacttaatttctcctaaatgaaagttatatcttttcaatgccaaattattaatatatgttagattattagtacatgataatttgttagttaaatttgttggtgccattttgcttcattaattcagcttgccctaataatatctatgaggtggttgctatcagatcatcccgtgatctaaaagtggcggtctgtacgtcacggaggcaccgattagtccattttctaggccaaattaaccttctttcaccatcccatgtggtccaaattaattaactgaatattattttttttcgtatttattttaatcgtaacatgcttgctctctctgttttcagatacaaaaaaaaaaaaaacccaaaataaacaagggaaatagaaatgtcgaaccgaaaaaatgaaattaaaataaaataataaagttatgatcacgttatagggaaaggcactaattatatatatcttgtataaatatattaaaaagtgttgttgaggtcggctatggatattagagatgatggtttttattatactatacatatcgatgacttccatgttgccctctaatcatggggatgtcaacttaaagattgttaaatatataaattcatgcaataaaatgacgtttccgggttaaataaaatattaccattatattgaatgtgtagaagtaggcttttttttatgaaattgcttgaggtgtgaggtgtcttaagaagagagaaaagaacataacagaaacacatacgtaccctttagccaacaaacaaagaaaaagaaaatgcgagagagagagagagagagagagagagagagagagggaaaaatatttgaaagcaatgaattaaaaattcaagtagggaaagagtgggaagcaaagggttttaggcaactttacacttcatacgggagaagttagaagtaggagttgttattgttatgtaatgtaatgttattaggcttcacatggggaacgtagattatataaattaaataaattactataaggcttggccctgacatgtccaaatcatagtttccataaagaattcacaagaaacctaagcatgtcccccttctttcctgccacattgatatgtgagcaatttcaattttgtctaagacaaccaaagtactcaatttttttttttcttttttaagttcctatcatgccatagcgttttccattattgttgccccacccttcaaagatcaaacatcttcatgttcatgttcaattattcatgggggaagtacattgaatggaaagtgatggacattgactgtgcaattggggtttggccctttgcacttttagacaaaatccctttgagctcccaatggagtatggtgaaaattatgccccatgcatgatgagagagtaacttacttggacaatagaacacgtcaaataataaggctgtgaggtaaggatgttgaagcatgatagtggaaaaaaaagtgtataaaaacaacttagcaaagcaaaagttcagaaagtatgtctcacttgtaaaggaattgggtttctatctcccgcaatattattttcagatattaactaactactacatgatatatggtgtttctttcaagtaatgtaaaacaaaactattatatagaaaccttgacaattaagtcagtcatgttcctttatggaaaaccattgtttaatttaggtcctgcattcattgtttccatattctattactggttacatacctaattattattctacttaaataaaagtaaaacaaactaattaatttgtgaaaaatattgctgcatcagggaattacttactttttttatttgttttttgctacggcgtttgagatttttttatataattaacatgaaatattgtactattttttttcctaatcataacattaattttgcattagttcaagatattttttcaccaactcgtactaagcttaataagatataataaatttagagtttaatttgtatgtaacgtgagtgtaaaccaataaaaaatcatagttggtatgatttttaagattataaatataaaaattaataaacttattttagatgataatttgtaattaaataataatataaataaattttatactgtaacataatccagaaacctattaaaaaggaaagggtgctaatcttttttcttttttttaattgtttaaatgtctaatttttaaaaggcttgaatatatttttgatccctataaattagttttttttttttcatttttggtcttagtaaaattatttttttaattttaatccttgtcaattgacatttttccaattttgatccttataaaatattttactcatttttagtccctataagtgtgtattttttcaattattcatgtaagattctaaaattttcatttataatcctaataaatttgaatttaaagaaatcaaaattgaaaaggtgcaaacttacataaattataaatgagctaaatatcttacaaggaaaaatggaaaagattccaacttacatagactgtatatgagaagtggagtggaactcgggttctgcaggctgtcctagtatatagattattattttcataagtatttagcatttaattaactaaataattgtaactatttaaacgttaaaaaacttaaagtgcaaaatcaataaatagcttctttatacccccccccccccatctctgtatataatatgtacatacaatttaagggaaaaaaaaaaaaatatatatatatatatatatatatataaacgtttaaaagcgtgtcttattgtaactatatgttgcataaaatgtctcttatggcaaatatttaaatagttagccgtgcctcagggagggagcaaccaactgattcatttgcatgtgatttacggacaccaacacatgtcatcactttacaaagggaatgtttttttatttagtgacgataccagtagcacacaaatttggttgaatgtaaattattataacaatgttaattaaaaaactatctatttttgcattgcacataatatatattaatgtacgctgtaaataacacaaataatataacacataaggactaatgtcttaaaaaaaaaaaaacatgagtggagcgaggaccgtgtttgagagaggaggcaatagggggaccaaggatcaaagacgaaatgttagtatagggtaacacaacaggatctcgacattctattttttgcaattttcggatgcatatgggagcaagatctcttgaaggtgtgttttgacaatggggtaaggtctgtgaagttactatagccaagaagaagaacaaatgggggcgcgcatagatttggatttgcatgcttcaaggatgtaggaaacatgaagatgcacgtgaacaaccctaggtataagagatattagcaaggaggaggggagaacaagtatgtgggagacagcaataagggtaaacaaattagccatggagaacatgtctttggttaccaactcagagataagagacaatatgcctaagtggtaaaaggatggaagcaacaataaaatcaaagcatggcaacgggggaaaaaggaggacaaacagacgcaggatgtagattggaagggatgttgggtgggaactctaaagaacgtgaccttaattgacaaaatccatcaggtaagtttcctaacttgtacgggggaaattggactaaaatgtcttgggggatgacttggttttagtggtggtggtgatcatacatactagaaaaaggcaggggaagaggtgctctggtacatatttcaatcactagagaaatggaacctgaaacttgtccctggtaaccgattgacttggatttgttgtatgagtgaaatggaagtacataaagaaggctattgtgaaggaaagtggtgcaatttgtgtatatttaagagaccaaaaagaaacaataaaaagggagatgtgtcaagcaatatggggggagtgtgaagttgaatggattatgcaaccaactattaacattgcaggagcactcttatgtctttggaacaacaatttatttgttgctagaaatttgtttcaaggatgtggatttattggagtagagggaactttgaaggaagggggacatgatgttattttactctcattgtgacttgaaagcaaagaagaggcaatgggaagctttgaaaagtgtaaggaaactagtagggagtctttatagtttatcattggagattataattgcattaggaggtcttgtgagagacaggggggcttagtagactatggtagtggtgaaaggaggggatttaacaaatttatagtcgacatggagttaaaagacatttcattggtgagttaaaaatttacttggtaccaaccaaatggaaaacaaggtgtagggttgctagatgtttggtgtcaagagattggattgctatgtggcccaagagttcccaaaatgtgttggatagaaacatatcagactattgtccaatattgttgaaggatgtcaatgtagattggggacttaaaccttttaggaacctagattgttggtttgaagacaaacaatatggaaaattggtggtggatacttggtcaaatcttcataggcatgggaaaggggatttcatccttaaggagaaattgaaggggctaaaaggaagcctcaaaaagtggaaccgaactcactttgaaatatcaacaataacattgctacaattgaaagagagttgaatgactgggagaaaaaagagtgggttgtttgaagagaagataaatacttggaggggctttcaagatgaattttggaagaatgtggtgtataatgaatcactactaaaacaaaaatcaagatctaagtggttcaagaagggggataacaactcaaaatatttccaaatcatggtaattagagaacaacaatttcatcttattgatttttacaaaactcattcaattccaaaatttcaacttatccaagcactatctagtataaaatttgttttgttgaaagagacaaaatccactcctatgatctctttttctagcaggaatcatactttgactgtcgattgaaaatattcttggtgaaaacaaaaaaaaaactaaaaaaatttatttctaacaaaaagttaaatgttttattcagatgtaatattttgtattaatttgtatgtatatataagtaaaaaaaatgtctagtatgtaataaaatgtatcattataataaaattgtgtctatttttgtaatgtaatatatgtttataatgcttctatataaagtgtctttatcaacctttttgccttgggcccataatatataaaaattagcccatattttaaaaccaaaatctaaaaagacacgaatttctcttatatctatgtgctccgccttcaaaaccctagccacaatcttcaattgccatctattgaagatgagattttgaatcttcgcaaaaactcactgtcatctcaatattacccacaattactcattcattctatattatgggaagaagcgttcaacgatttgttatctcttaatcgtgactcaactttaggttctacaccctttatctcttcttattttttctcaatttgaattcttttttttcttggtgctatttgaactcatcgattattatataatttattgaattcgaattggttttcaagttcgatgtatttccaattgttacaacatccgattccacaacatattcacagttatttttaattaaaaaagcatgacaatgaaatggagaacaaacttagatgcttattgctaccttttttaatgttagagaataacttagttaagtttcatttgttgcgagccttgttaaataaatgcattgatcttttgaatattgatctttctcatataaaagagatattgattttatattcttatgaatgtgaatcatttgattacatgttcaaatgcattagctttttacttgcaagagagtcacattccaatggtgatgaagatggctcatgacaggtaatcaagtggtttacaatgtgaataattttttctattaaaatttttgttttgtttgggtggttgatattgatttagatggagaaagtagtgttagtaatcaactaatttttttacctttggatagtataaaacttattgaaaatatggtttgtaattaggtaaaagtaccataaattaaaaacttaatgttactctattaaatttgtttgtgactagagaagttgatttaagttttggaggcaaagtaagactttcaagggatgacatatgaattgtcatttcattatgtgtgaaaatctaatgacttttgtttactaataccttaataatgtagattctttgggtgttaacaacaatttggtgtgaaacattaataaggctaatttaatttttaaatataggttacatatctaaattattttcctatgttattatttcttttttctattgctttgagctgacatggttatactatctgcttaggatgaattaggattagttaatggctctattatgcctatatttgtcacttttgggtgagtcgtattcttcaagcaaataattaactgctcataattgtcttttactgatcgatgtgacttattttctattaatattataatatcatggatgtcaagtgcgacctcctttataggttatttttttttctattgctttagtcgagcttacatggttatactctatgcttggtatgaattaggaccagttaagagttctatgatgctcgtatttgtcactttttggtgagctttattctttagacaagtaattatccgcttataattgtcttttacttattggtgtgtcttattttctattaatgttataatgtcattaatggcaagtatgacctccatgatattgcaatatgatattaaggttataatatcaaggatgtcaagtgtcacaacacatgcatttggttgttgtaaccttaatagtcttaataggaaacatgatatgtcaatcaataagagacaattataaccaattaattacttacgagaaggatgaagaataaagcccacaaaagtttggcaacaatgagaataatataaccataacgaatcttaattattctcaatcaaagtgtaatatcatgtaagctaaaagtaatcgaaaaataaagaagtaataataataacatgaaaaacaactaagatagttaattatttatttaaaagttaaattatccttattgatgctatgtcccaagttgttagcacacaaaggatctacaatattcaagtattttcaaacagaatgtttctttgagttattgattgttaggcataacaccatagtaggattcgtaagcattaagaaatggttcattaactaactgctatggtgtcatgcttagcaaccaataacttacataaatcttttgtttaaaaataacttcaatattggagatcctttgtgttctaatttcaatttcaaatataggttacatatcttaattcttttcctctgctactttcttttttttatttttctattgctttgagttgatatggttatactctatgcttaggatggattaggattagttaagggttatattgtgctcacatttgtcacttttgggtgagcttcattctttaaacaagtaattaattgctcataattgtattttacttattggtgtgttttattttctttaatgttataatatcacgaatgtcaagtgtgacctccatgatattacaatataatattaagtctataatatcaaggattccaaacatcacaacctatgtgtttggttgttgtagccttaatagtcttaataggaaacacggcatgtcaatcaataagagacaattacgaccaattaattacttacctgaaggatgaagaattaaacccacaaaaaggtggctacaatgagaataataaaaccctaactaatcatactccatttctagcaaagtgtaatgctgtgtaaactaaaagtaatagaaaaataaaaaagtaataatagtaacatgaaaaatagttacttatgtatttaaaagttaaattaccctaattgatgtttcgttccgtaacaacccgtatgcatccggttcattaacattcaactatggccattaagcgcagtaattatctaaggtaattaattcagaagtagtaaacaaaatgacattatctcacgtcattaaccacacctattgtatataatatatggtgaattctcataatatacaatatatatgtatcaaactgtacatactcccctcagggtacaaaataacaggcacaatcaaaataattgagccaatgagctctcaaaatctatgcctaaggttcacatagaacctatccctacgcgggcctcttgctctaggatccaccctccgcttcctaagaatcacctgcaaaacatataatccctaacaggggtgagataacaatctcagtaaattcaggatccttggaggtctttcctccccctcattcacttccatgaaataaaatattaaaattggcatcatacacaatccagtcatcatggctctcaaaacatatcacatgtatatcataacacagatacaacatatacatatagatatatcatattgcttgagaaagatcatccgcaacgggtacattctcccaagacttactcggacatatatggcacttctgagagaagatcatccgtgacgggtacattcctctcaggttttattacatatatttatattgaccacttagagttgttccacgcaactttggctctaagggaagtccatatttagtccattctactagccagagaatctcatcaatcacaccacactatcacaatgtacataatatacatgttttcaataaaaaatagtaacacacaatttcaatatacatgcatcatggcatacaataatcatcactccctctgagtatggtggaacacagacaatgaaaacactcccaagaataaagagcttacctgctctgagtgttacaatggctctcccggcctcatggtcacactcaccagtaacctctgtatcacgccctacataaaggcatacgagaatcaatcaataacggttctcaaccgttaaaatgaacagaaacattattcttctacatataaccctttattactctatctcaagtctctaaggctagtcacttaactggtgactgacagatcctcacaaggatctatctcagcctaataaaggtactagagtcactctaaaaccctgcataagccaattcaatgctctaaccagactatatatccatgattatccaacttggctgaaacagttattccaacacgttttcactgtttatttagccttctgaacaacttttgtaaaacacttaggctcatatttatcatagtgccttccatttaatcaacattttccctactcatacatacttcagagtcaaaatcaaactttatcaaaagtcatgtttcaaagttcaatattcatcagaacaacctcctgagcatactttgctaaagaatccaagcctaatttcagctctaactcaaaagggttaatattcatcccaaaaacaatttcacaaatcaattggtaaaacttgagtttcttacctttaaatcgttgaggaaggctaaaggataacttctctaagcttgagtgtccttgaaacgcctcatttcccttccaaatttcagctttgagaagttccctagagaactggatttctccaattgatggttttctctaagaattgagcttggaatctagctcatagaggagttctaatcaactttttagttgagtgaaaagtgtttagatgaaggatagagaagatatgaagcttctttggtcgttaatggcggaaatggctgaaggtgggaaagaatgaagattttctctcccaaaacgttcaaatgacccttttataaagccatgcccgtgttcccacgctaatggcgccagcaattttttttgtcttttttggaaatcatggttattatacgtcccaagttgttgttagcacacaaaggatctataatatggaggtatttgaaaacaaaaggtttatctaagttatattttgttaagtataatgctatagtaggactcacaagcattaagaaattgttcattgaacatttgttatggtgtaatgcttagtaacaaagaacttagagaaaccttttgtttacaaatatcttaatactgtaaatcctttgagtactaacaacaacttgggatgaagtatcaataagggtaatttaatttttaaatacattgttagttatcttatttaactttgttacgattatttcttctttatttttggttgctatgagttgacataattataatctatgcttaggatgaatcaactggcttaaatacccctagttctagaaagcacatgagtttgaaaactatgttgttaagggttctattatgctcatatctactactttttcgtgggattcattctccaaacttcaggtacgtaattaactactcataattgtgttttattgattggtatgttttttcccctattaaggctataatatcaaggatgccaagtgtgacccttatgatattggaatataatattaaggcaattatatcaaggaggccaagtagtaatagtctgtgtgcttttggcaattcctctttgtcttccgttatctatttattatatgattttcccttcctcttttgagccctaggttgggagacctaggaattttaattattatactttattaaggggtttattgtgtaaattaactagttaaaatgtaactgaagtgattaggaatttattggtatgctttgggattgtttggaggccatggatggccattgagagtgtggatttgtgatttttgcaaaagtttgtaggtccgtaaagcttgttgatgcatgctaagcaccatgaatttcttggattcaggtttgatgacttgtgctaagcataagctatgtgtgctaagtgtgagtgctctgtaggctaagcattacctttgtatgttaagtgtagggacctctagagagcaagtttggagcccttgcattggtgtgctaagcatgagcgagtgtgcttagcctgaggtttttgtgtgataagcacctaatggttgtgctaagcatgagactcctagggcaacctagtaagtttaactcagtttcattcatatataatcaatgttcttatattataagtgactgtttgggataatatatgattgttgtggagttttcttacatatgtttagttaaaaaaatcatcctataactctaacatatttattattaattaaaataatttgttgagattgttttcaaataaaattttgatggatttcatcatttcatgcaatatcatagagggatccaataattttatagttgcctcacctatttagaattaactccagataataaggaaatgatctcataatatctagttgagaaaaatattttctaagacactttttaggaaattataaatgattttagatttcacttcttacttaatgaatatccattatcatcaaaataagtgtattagaaaatatattattaacatttcatttttttatgaggatcccattgtcttacagtagtaggaattattaggtataaccataaaagaagacgacggtgactaacctttctaggaattcataatatctcaagactctaatattggagcactaattgacttgagttggaatgaattttatatatatccctcctttcacttattaaaacttgaaggcaataaggaaattgaaactcaactgtaaataaaaagaagaaaaatcaaaactccaaaacttgaagattatagacaatgtgctagacaccccaagcctattttaggtcatatcaggttaaaggttttctcctggaaggcctctctcctcttaatcataggacacactcaattggttaagtccattgtcaatgacatgcttttatactccttccacatatatttttggcctaagcagctcctcaaggaggcggacaaatggattcttaactttgtataggcgggtgatctggatcagaaaaaaatttgcattgttaactagaagagagtatgctcactttgtgaggaaggtgggttgggcctcagacctatctctagcatcaacaaggctgcctccatcaaactttgctagaacttcctttattctaaagctcaatggatcaagtcccttagagcgtgttaccttaagaataagtgtatggccatttcttacagaaaatcctctttatggccctttcttaaatgcaatattccttatttgtgcaaaaatcatcttgggtcattcgttctagttgctctgccaacttctagaatgacccttggtgccttgatactcccatctcagattttcttggtattcctccctcaaccaaaaaatatatctcttcttctctgagagattttatttctagaaataattggtgcatttcatatatccttttttctaaaatttctcctttggaataggccattcaaaataccatatttgttccttctctccattaagacaactctgtttggtgtgatgctaataatgatgatctcactttcaagatggcttataacgttatttgttccccttccagtcctactctctgagtgaagttaatctagtctccagctctactgccatttagatcctttttggcttggagaattcttcatgataggatgcctacagacaaaaagttaaggcaacatggctttgttgtgctctctatgtggttgcactgaagaaaccattggacatctcttattcgattgcacttttgcttgtcatatctgtttgtggctagaaagtaagatttccaaaactttgaatttgtaggattgataatctcttctcaacattcttcttcttagataaagtggccatgctaaggatgtcatcctatctctcaagcttaattctctttgggccatatggacctgccccaatcaactaaggtttgacaacaaagttgcttctttcaataaggttatcatttccatctctactaccaccttcatagcaggttcttctttgacgggcaagctaaagcattatgttgaagaattatctatcctcaaatccttctttgtccccattcacccccaactcgcaattggttaagtaggttgattggttcccttcggtgctcaataacatcaagtgcaatacaaatggttcagccaagggtaggggtggaagtaggccaggccaggctttggcgggcctaagcctggcctgtatcattatgattaagcctaagtctggcttgttacctgttaaaagtaatttatttaggcctgagcctggcctgtataaaagtctgacctggcctaaaagcctgtatacaaggcccgatcaaactagaataaataatttaaagtaaaaagttagcatgatatacatgtttctcttataaaatataattaccaaacatgatattgttctaaaaaaataagtaacaaaccaaaagtccagaacaaataaaattcataacaaaagtctcataaacataaatataaaagtaattcatatgataatatcaaatatgatctcaagccacaaatttaaaattcataactaaagtttcaaaatcataaacataaaaagaaggtctcaattttgaaattacaaatcaaaaacaaaaactcaagtctcaatcaaaaacataaaagtaacataactaatgatatcgaataaagtttcaaatcttcagattgaccagcattaagagtaagacatcaaatcttcaaattgatcactttaagttgttcattcacctacaatacaaggataaattttattattagaaaaatcaaataagttaaataattacaagaatggaccataaaattcaaaaatattaaacctttttgtagaaaataagaaacactcacaattaaccaagaaggggggtgaattggttaagtatagatatttaaaattttcttgttcaaaaatcagagttaaaaatgcccgttggatctttatcacaaaactaaatgaatatccttatccaagttcaatccaagacttgttatgcttatattttaaacacacagaaaacagagttcaatcagaaacaataaagaatgcagtaattaaaataagaagcaagatttatactggttcacctcaaaatttagaggctacatccagtttcttctactcaacactagagtagagttctactattgaaaatatatttcttacaagatattacaaacttctctttctcaaccctagagaaagttcagtgatctaaaaccctattagacccttagaagctacacccaaactgagaaacctactcagttgtacatggaaaaaccctatctcccttgcaagaaaaccaacaaaaacagagttactgtagaaaaacgaaatacccacaaagatttaggaaagaattcacttgatgatccaagatagaagtgcatatgaatgagaaacctcaggttgaatgtaatctaaagatgcagaatcaattcttaagcctttgtgactgagtaagcttgcttcactaacaatcttagtgacccatcaatgaatcattggaagcaagattcaagaatccagaagaaacctttgtgaactcttagatgcctttagagaatgctcagaaatcgtaaaaaatcaactcagtaatgatctctcttagttgttaattcaaaaaggcaaagggttctatttatagttgaaatcgtaacagagttaatcgattaaatgcgctccccacgctcctgtaatcgattaaaattattaatgcagaatcagattttcaactaatggttaagataatcgattaacccgatgcgtaatcgattaaatcagtttgagcaaaaatactgatagtaaagtgtaatcgattacatccaattgtaatcgattaagtcagacatatgctaaaatcaattttatgaagaataatcgattacatccagtggtaatcgactaatgcagtcctacacttaaatcatgtttgtgaagaataatcgattacatctaatggtaatcgattaaggcagagtgactaagtttatccaatgagcatgtaatcgattacaacaccatggtaatcgattaaagcagttacacgaccaaatttcaagtatgctgagttgtgtgtaatcgattaacccgataaggtaatcgattaaagtgtttatgcttggttttccagaaaccttaagaacaaaataatcgattaagatttagccagtaatcgattattgcttctatatgctgttttcttagctttctcttaagtttctaattaactacttaactcctctatgatgcaatacttaaatgatacatgaatgctataatggcttggatcatcatgatgctttcaatccttttacattaaatcacaaacaatcgtcttcaatgcttgagccatgttgaaagccaaaactccaagacttgcaccttgattgaatcttcacttgatcttcattcagctccccctcaactcaacactttttcttcttcaagttatatttgtgacgaaaccaatctcctccacaaatgagagcttcaatagattcttcattcaactttgatcggtattcatctataactctccctccagcactaaaagtagcctctgatgcaacagttgagattggaatggctaatatatcaactgccatctttgataaaatcttatatttgaaactattgttcttccaccactccaaggcactaaaagagaagctatcactttcagtaacacaaacaccctcttcaagataaacatccatttcagatttcattgaagggacaacttctttctctctcaccatattaattatttcatcaaatccagtaataattgtggacttgcacacagaattagaagagatggtgctgccactagtattcccttcatcagtaaatgattcttcaacactcaaattaacatattcattgtacaactcatacaaagaagaccgaactttattcacattatgattaataagttcttcagacttaaatatcaaaggaaaacatttgtcaataatgtgaaatttgcaccttggatctaaaacacttgcaatggccatcaacagattgcattcaccccaatatttatcgaacttggctctcataggaactgtcatttctctcataaagagatcttcatccgcagctgcagcatcaagtacttgtttcaccttccaaacttcagcaagatatagattggaagtaggatactcggtccctgaaatgacatgcgtggcaagattaaatattgataaaagtttgcaaactttgtgaactttctcccaatcttcaggtaaaggatcatagttataaagtggatctctttctttataggctgaaaaggcaatcttgaagttcaatgcagttgatagcatttgatatgtagaattccacctaaatatatggaatcattagtaccatgtaaaataggcaacaataaatgtactaaaaagcatttaaaatataaataaatttactaccttgtaggacaatcaataataagcttcctttcttttaggtgcttttgttcaacaacatcactaaatgcctttaaccttgaatcattatgattgatgtatgtcacactttcacgaatgttgtgaattatggttttgatcttgctaagaccatcttgcaccaacaaattaagtatgtgtgcacaacatctaacatgaaataggctaccatgaagaactagctttgtgctcagtgacaaagtatcctttatatttttcaagcaagagtcgttataagatgcattatcaacggacacagaaaaaactttatcttcaatcccccatgccttcaagcacttgaatattgcatcagctacgtcaataccacgcctaggagcaggtacttttacaaagctcaaaacccttttctgaagtttccactccgcatcaatgaaatgactagttataaccatgtactcaactacttgatgacttaatttccacatatctgtagttaagctaatcttggatacacctttcaatgttgccttcaatactttcttctctgcctcatatattgctaaacaatcattccttactgttttgcgacttactttctgaaaatcagaatttgcatattggaatgcccacatccaagcttcatcctcaacaatgctaaaaggaaactcatgtaccataacagcagttgcaataatttctctcatcttttcattagagtatctactgcatgtattaacaaatgggttagttgaattggaagggagaaatggaatgcatggttgtttcttttcttttgccatctgtaacctcctttgcaagcaaatttcactatgcctcttaagatgacttgtgctgcttcccctcccaccagttgataaaagggctttgcaatacttgcatgcaacctttgtttcacctttagaattcttaacttcgttaaagtcatgccaaacaattgaagtttttctcctctttggcttgatgacagattcttctccatcaccatctctggagttgtcattgtcatgtccattagcttctggtgtgggttgagtagtatgattaacaggcacattagtagtaggcgtagtttcagccatcaaggttaggtttccttaatactctgcaacagaacagcggagaaggaaccaaattaatgacactgcaaacttgaaatgttgagtataaggatcccaaacaaataaaccggcttgtttctcatcttccactgcagcatttacacaatatagaaacctttaacaagctatgcttgtagctggaatggtgcattacaatgttacatactttgttcactaaatagcattttgaaaaatatcaccataactagagaaaattacagtgaagcaacaagcaaacaaataaaccagtgctattcataattttaaacggctcttattctaatcaacaagtctcttattcttcctattccaatttgaaaaataactataaaacttatagataaattcctatcaagaaattaccaatctgcaaaaaacaactaaccatctaatattgattcaagaaacaaatattactcagtgcaaaaaagtaaaatctgctcgtgaattcatccttctatccatatgcaccattaccaaacccattattctaacagatttgtattcagctgtacccaacataataaattaagtatgtatatgatgcatgatgcaaatttgtattcagatgtatgaccaaaatacaatacaccattgaaattaaaaacattgtattccaatttgaaaaataattataaaacttacagattaattcctatcaagaaattaccaatcaaagaaataagattcaatcaaagttaggcatgaatacttttaaattcctataaaacactattctatgggagaattagtttcacgatgaataattttgtggaacttaggcatgaataaatttgtaacaacatccctcacattcattagccaatgtctattttaaccatttacaaagttattacacaagtaattaaacaagtcaagcatacattaaaagtaagaaggctggctttcggaatttccaaataaaagctggaaaaaaaagaattaaagatattcttacagtccaatgattatgacaagttaaaggggaaattataagctttcacttgaggagataggctggctttcggaattctgttagcgttccagtgggtgcaccagaaaaggtttcttcaaatgattttccaccaatagaaaaggtttaggcattattaaaattaatagattaaaaactaaaataaagaagtgttaattggtacacaaaaaatttcacggtggaagaaaaacttgccccaagttctggattttctttctccccaaattctgtgtttttttttttgtgttcaacgaaaaagaaattagggaaagcatgtaactttgtagtcaaagagtgaagggtaatctattcaaagtagagagatgcaatgttcacagcatattggacagcagagagacacaatgtttactcaatattcacaaaatcacaacataagcatgtagaaaataaaaatactcacaaatcacagagatgcgcagcagataacggaggacagaggttctccttcttgtcgttgtcgttgctgttgccgggatgtggtagttgagaagatgacggtgcacggctgaggtaggaggtgaggaatgaggacttgtgctgctctgttagggtttaaagtttagaaataaagttgaaagtgaggaatgactgaatgaggcacaaatgaaatagatggaccaagaatccgtgagcgtaaatgtgatttatacaggcccactattcaggctttgtgagctttttttaaagcttacagcctcgccttttaattaaataagctttttaaaaagctcaaatttagcctttttaataaacaggctaggccaagccaggccttaaccaggccaggccataggcccctgacaggctgtctggcctacttccacccctagccaagggtaatcctgagtgtgctagtagtggtagcatttttagatatcacaacatgggtttgattggttgcttatcttcttacattggcattcaaagtgtttttatgctggaacttttgtagttattttggctatagaggttgttcttgcttacaactggaggaacctttggattgaatgtgactacaacttaatgattcaagcaatcaagaaaccttctttagtcccatggcaactccattctcactaggaaaatggttttttctttaagatatagttttggtttactctcatttcttcagggagggaaacttttgcgttgccttttaactaattatggtactgattctgggcttagctattctttgtgggatcataccctaagttttgttaggcatgaattttttcggaataggacaatttttctaattacaaattatgttaactttttgattgggttttggcctagtccctccaatttgttcattcttttttactttcttttaatgttatttggtgtgatatcttggtgggtttgtatgggtgtcaacttaattgcgatgcatacacatccttcatagatcttacactaactttttatataaataaaaaagaacttgacgattatatatccatatattcatcctttcacttattaataccaggtgttaagttaatccctcaataacgtataatgtttgagtcttttatcattgtttttctacttaggtattagtttggtcccaaattattttataagagtcgatttgatctctaaattttttaagttttaatttagtattttaattcttaaaaatgagtcaatttgatcaattctaccaaattgatactcacaatgttaggataaatttttgacaattttattcataaatagtagcaactaaaaattgttaatgtaatataaaaaacattgatcgttccaatttttatacccacgacgtctctttgtttttagctaatgtaaatcttaaattgtaactaaaatttgtcgattttctattttatgatcatttcaatgcttagtataaattacaccggaagataataaatcatttatgttacaatagaagttaatatattattattattattattatttaatttattttttaaaacctaaatttatttaaataaaatattatataaattatacacattttgtattattagactagctttaatacttgttaggctccgtttaaagataaaataattaaaacttatattttaggtttattagaaaaaaaatgtattattaatatatatatatatatatatataatttttttatttgtaagatttaaatatgaacttgtaatatttatattcatgtttaatcaattaaactagatttttcgatattcctgtttataaattaataaaagtctcatataagtcaaatattttaacaaaaaaagcctaacatattaaagtaaaaaataattttaaaatttatttaacatctagcatttcgatggatgaatactctcaatgagacaatgatcatactaccacgtttgacaaaaaagaaatatacctaaattctacacgcacagtaaattttaccagactgtcacgcagcataatttccttatcagtctaatgaactaggtgatggacatgtgacagtcagaagataattcgctagagaatccaatgaattaggtgaacacgtgatagacaagtaatattttgctaggaagtccaacgaattaatctatatctatcacgtgtcaacctaattcgttggaatttccaatgaattattgctaatctatcacgtattcatcatctagtttgttaagcaaaatacaactcctgacaattcgataaaatttactttactcgtgacattcaattaaataatttttgtttttgtgacggtagtacggtggatgtctctactgtcacttgtgccaactggtttctccgatactatttactaacaccgtaacacgtaaatgcataactaataagtattttaaattgaatttagtcaattgtcatgaaacaaaattttcgtacactgtcacgagcctttgttgcattaaattagaaatattagtagaaatacatttaacataggaaactgaagttcacgcgcgagatgctggagtggttgaaatcaagggtggcgacagcaaccttaccaaccagaggggaaaactacgtatgcagtcaagctgcacaaaaataaattaaaaaacaataaaatataaaaaaaaaaaaaagttgaaacagtgagagagagagagagaacactttaccacttttatacgctgcacgcatctacctcacaaaacacaagcaacaaagagggttccacacagaaaacacaaagaagaatcacattcatttatttcatggctttcttcttcttccctcatcacaccttcttcaactgtttcaatctcaacatgccacggaagaatcagagagaagaagaaaaaacaagctttatttttagagggtgcccaagttgtttttccttttgtttttcctgccgcactctatgtgtttgttcagtgttcctcaaagatttgtattgtccccaaaacaaaaacaaaaattcagcctttttagctcttccaacccgaaatttcttgtcttttgtacgtgttcttcatttggggtggtttaaatttgcttaatttgtaatcttttttttttctggggtgggttgtggggaaacaaaggtggtaccttttgaaaaactggagtcttttgggtggttggttttgtggtcaccaatattattgttcttccccccctaggcaactttcttagatgaaggccatgcccttgccttttgaggaatttcaagggaagggagtgttggatttctcttcagcctcagattcattttcagtgcttttgcataatccacaaccaaagtggaccatagacaaagacgactattgctatgtgggcagcatcactgagcccacctcagttcttgactccagaagaagccttagccctcccacttcctcctctacaatgtcctcttctcttggcagcagcaacaacagcactagcaagggtggtggtggtggtggcacctcagccaacaccaccaacaacccaacactaccctcagacaacaacaactacaaccctcctcaggaatccagccctgaaaaatgtggcatcaggatggaggactgggagggtcaagatcaatccatcctgaggctaatcatgggggatgttgaagacccttctgctggattgagcaagcttctgcaaagcactgcctgtggctctcaaagtgttgatttcaatgctggatttggtgttgtggatcaacaagggttgaatatgaatatggtgagtggtaatattgacccaaattaccctgctggtttccctttcattgctgagaatatggatggccagaatgccaaggttggttctgggactggccaggtttcagaatctgttgttttctctgccaacaatcctctcatggtgtcatcatctgtgtcccctggtgtgttcacttctcagcagcagcaggagtttggagtggtggatgagaagcctcagattattaatacacagtttatgttgaaccagaaccaagttcagttctcagagaaccctactttctttaaacgccatctctttgacacaattgggcacaattttcaagctccaaggttgccccttttggattcagggcaagaggtgtttggtaggaggcagcaaacacagcttccattgtttcctcaccatatgcagcaacaacatcaatcaatggttatgccttctgctaaacagcagaaggtgagttccgccggagacgatgcaagccaccagcttcagcaggctatatttgatcagttatacaaaactgctgagctgatagaagctggtaatccggtccatgcgcaagggatattggcgcggctcaatcaccagctctcccctattggtaagccttttcagagggctgctttctatatgaaggaggccttgatgtcacttcttcattcaaatgctcacagtttcatggctttttcgccaattagtttcattttcaaaattggagcttataagtccttttctgagatatcacctgttcttcagtttgccaattttacttgcaaccaagcctcattgaagctgtggaaaggtctgacagaattcatgttattgatttcgatattgggtttggagtacagtggtcatcttttatgcaagagattgccttgagaagtagtggtgcaccttcactcaaagtcactgccattgtgtcaccctcaacttgtgatgaggttgagctcaatttcactagagagaatttgattcaatgcgcgaaagacatcaatgtgtcatttgaattcaatgttttgagcattgaatcattgaactctccttcctgtccactgcttggtaaattctttgataacgaggcaattgtggtgaatatgccggtctcaagtttcacaaactatccatcattgttccattcagttcttcactttgtgaagcaactcaggccaaaagttgtggtcactttggacagaatttgtgatcgaatggatgtaccgcttcctaccaatgtagtccacgttctccaatgttattcggccctgcttgaatcattggatgcggtgaatgtgaatcttgatgtcctccaaaagattgagaggcatttcatccaaccagctatcaagaaaattatacttggccaccaccattctccagaaaaattaccccatggaggaaccttttatgcaatatggattctctccattcacatttagcaacttcacagaagctcaagctgagtgtctagtgcagagggcacctgtgaggggatttcatgtggagagaaagccttcatcacttgttctatgctggcagaagaaagaactcatctcagtttctacttggagatgctgaggactgaggagcagcagcagaagctaattaccttatatttttaaaggtgcatggtaacttacattgcagtttatgtaattgtttgtgtaatttaggcttattgatgagatccacacccaaatgttttcttaactgcatgggttggaatctaccattctatagttctaatattactagtatgtcactttgaacatgggtagtaattatgcctttccccattcccatcatctaaagatgggtaactgtttctttgttatcttgaacacaaagcaaattgcttagtaagaaacgaacaatttagccaagaatgcagcctctattttcttcctcatggtttagtctattctttcttgattaatgtatgatgacctgaatttggaatacatgatttaaatatgtagcatgaaaatcttgtgccaattcaattatccaaataggttgctgggtttgagtgaaaaacgggaaggaatataatgattcatttgtagtctttaaggaaagatgcccaaaacaaattcatgtataatagtacttttgtttgtaatttaagaatttgaaataaatataaaactgggtgttgatttaataagaattcaccaatgtgtttgaaaattgaaatgttggctgacaaaagacataaaacagtttttgaatctggccatgttttgatacaagtcctcgtgcattggattcatactttgatatacgaaaaacgttttcttaaactaccctcaaaatacaacctaaagaacacattaattgcacttgcgttgactctctttttgttataatttataatttagaacatgaaatgaatgatcagaaaatgttaaattttctcttggtctacagaggaaatttggtgatgtcaacgtagcaattatgttacactagagcgacctgagtccgcacgttgcgccattcaattgggcgttacttatgggtctgtttttcaagacataataatgacatagcagttaataaaagtctaatacaagcaaattgtatcaatcctactactattaccttacactttctcaatgaatttataaatggatatataagagttttcagctcttaaatttgaataattttattaagatgttggtccgaatgaagttgagtttggtatctttaagcgtttatttagatcactggtgggacaatccaaaacagagattagagaagcaacaactcatacttctgtggtgaagtgatctcaagcttggtgttgtagtaagtctacgggaaaaacgaacacgcattaagtgaagtctcaattttgagttttatgtacaaaaattcactatgggtggttaattaggctttcaacataaatggatatacaattcttaattttaatttactaacgtgttagtgcaaatgaaattaggttagacaaggtcttaatttcgagttttatatatataaagaaatagttaagagagaaggttcattatgggtgattagttagattttttttttatcaaagattaatcattgacaaaattatttgtagatacttgatactacaattatgaaaatcggtccgatccgattggtcagatcgggatccagtaggttaatcggtctggttttgttattgaatcgtttatgtaattgactcagttaaaatcggtcaaacccgaccgagttcgctttttttttttttggatttttttatttaaaattttggattattatcaattattatttttggattttggagtataaatgagtttttcttactcaaataatgttaattataccaattactggtacaaataacataaagaaatataaccaacgtttattggaaaaagcaaccccaaagagacttataatatatatatatatataattttgaacttttaatatatatcgtatcaaatcagaccaattgttgacttatcaattagaccactaatctattacctcgattgggtcaatgatcgggtcggttttaataacactgtttgatacaaatatcatgtgatccaaaatttgaataaattcaaataataatatattaatttgatctctctatatattattaatatttttttatttaacaatttgatgaatagatgacaatgcaatggcagactattctatccagttcctttcataaaatgtttatataattttttttgacagcaaactaaagaagtaacagccttggataaatttttcctaaagaaaatttccttccttaaaattattgtttggactgctgttggactttgctaactaaaccacttgacatattttaagcaacttacaatttataaaagtttgttcattttttaatggttaaaggaagagaaaagttggtcgatggatgattgagcttcagaggtaaacatcataatgaatttttgaagatttcagcgaatgataattattgccaacgctgaatatatcatgagataaatggtattattatgtatgccaaatgtttaaaggaaacattctttttttatgtcttctttctttttgccatgagactgctattttcagttatttttattggtaagaatagaagataggtattagtacatgccaaagagcatttaattcacattataaaaaagagaatatttaatatactttattaaatacttttaatcattaacgagtagtattaatttttatatttttattttcttaataagtgacttcaaagaagcatatttaaagtaagtattaaagcgacctaacataattaattgaataatatgtgtcagttgttataaattttttggtatttaaattcctattctgaataaaaaaagataatgaaagaatgagttagactttgacattttctaataaacatacaccatcaatgtttttgtaatcactatttaccatgtaactatcactattggtagaatgccacaccatttgttcctctaggatatcctcaacaacttggggaggaagaagatgccttgcctcctctttcttccaaagccaagtattctgacccatctatgcaaggaaccacgtcctgaatgaagaccaaaataaacattactagctttagtatatatagcacaatcgataaacattcactattcattggatccatttttggaaaaccacacacacacaccaattgctttgttgagaatttctcctttactaggctttgcttgtattaatttcgaaagtcatgcctcaagatgatataaatgcttacatttgtaagcagctgcagtgctgcacaaattaccttcgacaaaattggagattcacgttataaaatattttacggttatttaatttacaatataaaatattttatatgattatttaatcataaattattatttatatgatttttaatatatttattataaaaattaacaaatttatcatgtataataatttatgattggataatcatataaaactattttgaactattactacatagtcatttttctcttataaagatgaatttcccacttaatattacatcacattttttttattattttgatatatgacaaagtatattaaacttatacattatatataatatttatttttttccttgtttgcaaatatgttaattttttatttatttttcaatcatgtattatcttttcatttttgctctagaaatttcttttcttttgttttttagtctttcttttttactataatattgtgacattttttttgttgatgtgagacattgataacatcacattatgttgatgtcttttttttttttttatgtgatgtgtgttaatatcaatatgatattaacaatttaacattttttaaactttgacggtagagattaaaaataaaaattttaaaatttataaaaaaaaacaatcgaatttttttttacagagacaaataataaagaaacactaaaatatatgtatgaaaaactaaagcctaaattttatctaaaagccatttggtatctagaagaatgaattaaagttctttcatacctttgtggcttcgttgttatattctattatagtacaccttatgccatctttatcatatattgattatggaaaatgttaacaagtgtttttgggtagtgtttaaggagctataagataagtgtttttattggaaggtataaaattatattatccaataaatattttattatttttgtttcttaattaatgttagttagcaagactccttgattattgatctatctcatcctttctttaagttgggtttgatttggggaggaaaaagaaaaatatgagagaaattttatggatttcatatgaatctcacaccttttatattttattttaataaaaaattcttctatttttatctttttttatatttttatcctcttaatcaaagacaaacttactacattaagaatgacaatgggtagtaggattagatatgaataagggcaattcgttatcctctcgttgaaaaaaacctaccctctaaccatccattacttgttgggtatccgtttaaaaatactcacgaattttcatgatacccatgaatatccatgggttcaaatttaaagttaaataattttttccataaaaaaggtcgtggttcgtgaacctctgtggttgaaaaagagaggaacaaagggtgaagcgttattgactactgagagattgactactaagagagtgaggggcaggggacttagggtgtgaatgatggcgttgcttagatttaggaactagggttatatatataaggatattttttgtaatttcataagtagtaggtagatatgaatattatgatactcatactctatccattaacaaagagataaaatatatttgtatccgtgggtgatcaatacccatttaaagtatttatcatttttataacgaattttattcgcaaatatatgtggatatattttttattgttaccccagtactataaccctcaatttcctatcaattacaccatgtaaaacattgttcaaaaaagtcaaaattcattaaaggtttcgtaaatgatttgtggaggaatagaagaaaactctgtcgtgttcttattctgcgtgtgataataatgccttgttgaaatctcaccaaaccgaccaatcttcaatatgtttgctcgtaaaacatggccctagcagctaataataattcattgcttcacataatgattatcaatctatacttatatctccctatatttattagtataacactcctttattaaagagtcatggaaagaataagaaattgactcatcataaggaagtatgaactatatatcttcaatcaaggaatgatgaggttggatgaacggatgccaataacaattactgacattgcaggttgaaatttactaaacatataacctttgtaaaataagaagataacctggtaaaaagtaatgtgggtttaacaagagtcttgctatcaatatgcttaatacattatttaaaaaactaaaaaatatttattataaaattataaacaacacaatttatacattctaataaaaactaatatcttaataatactgataactataaatatatatcaaaagtcattagtataagcgatgcaatacttatattatttaattaaagacaagggattaatattttgagcatagaattatgactcaaagcaacactttaaaaatgggcaacttgtagaaaaaagagtcgttggatgtaaaaatagaaaacccaaatatacttcatagttataaaaaagaaactataaaaatgtaaataataatactactttttagaagatgtatttttttttcgttttttttttctttctattttcacctttaatataataataaaaaatatcattataattttactatttttttattttcaaaactttatataggaaatagtaaaagtaacattttattattttctattttatttttatataaactttctaaaattggaaataaagtgtcacccaaaaaaattagaaataaagtaaaacaatgatagttttgtaattgaaaaagaaaataaaactaaaataattttcttaaactaaacatttcactttaatccttaaaaaaacataaaatatattttttattcttgtaaaattttaaagtttatttttgttcttacaattttttatacattttttattcttataaaattataatatatgctttttttatccgaagttaaatttagacgaatccaaactttaacctacttgacatgaaattcagctttcatcgtttatgattttaggattttggctcataatcccgattttcattctaagcatatataaaagctagtttttagaatcaatcctcgagcatagaatgtgatcgatttataaatgattaaaaaacattcatatatagtcacgtcattttctccaaagctcaacccacgctagaaaaacaatttattaaaattttgaactcaggctcttgaaacgtgaattatttttaggccatcttgataatctttgtcctaatctttaaaagggatagactgtgactttggggcataatcttataaggaatgatgatgttcatccttgagttaatttattgatgtcctacatatataactcctcataatgtacaacaaaatatacattaacatacccaaacttctcccctgagaacccaaaatcatgataagtgtccaatctcgtaaaagaaacaaaaagcttatcaattatcattcgacaacaacctagaactaggtcataccctatgcctttgcttttaaaaatgactagaagtagaagggcaatgtgctgtacataggtaaagggcaaggctcctggtgccatggaggtagttagtgagaaccttttagtcttcatgaaaatgaaggaagatgttgggagcttggtggaggtaaagtagcactatggaagaaggacaaagagaaatatataaaaaaaataaagttcaagttttcaaaatcaaatcaagttaattattttttaaaagatcaatttggatctttatttgacattttaaaaaacattttaggatttaaaaaaataattttttttctatattactacttttagtgtttattattaaataataagttagttgatgaaataatatcaacttcaatgatttaccacattattaaggagttttgattatgtatatttgtttagaaaattatttttgatccctcatctcatcattcaaaataattgatgaggaattaaaaatattttataaaaaaataattacaagactcttatcaaactccttaatgatgtcataaattattagttatcatcatctttattatattaccaattaacattgttatttgataataggattaaaagtgataataagaagaaaaaaaatcaattaatcaatcaaaattttgattttgattagagagtaaaaaaaagtaataaaaaattaaatccaaaaaatcatgtagagttctttttttgctaaagaaaaaataaatacactattttttgtgtttactatcttattaatctttatttttttttggtaaaaaatgatgtagtattatctcaagaagttaaatattccgtaaatagttatatatatgtcaaataaataaagatctgttaatgaaggtactaatgtatcttatcttatcttttatataaaaataaacaattttataattatgaagatctgatgtagaaataaaactttaaaaataagattgagtatatgtttgaaaatcaagtaagaaaatgtgacagagtacttttgaaaaacaataaaaacccttacttttgtttttattcattgaattgcacgtgaatgtgcactattatcattttaattacaaaacaaatatgtagatttaatattttgaaagtgtactgtagaacacattgccaagcatctcagccatacgttttcacgttccaactgaaaatctcgtccgtccaaatctgcctcgatatcttcgaacctctaaaaagctttcattatgtcgtgtcgtcagattcagcttcgaaaaacagatcaatgttgcatatggttattaaattaccataatgttcctgttttcatctcgctttactcgggggaacagcgaaagaaggtaagggtagaaatggaaacttaaaaatcatgaaaaaacagtgagcccaattaaccttttctctgtctcgttggtctccgttaaaagaaaaatcagatataaaaaagaaaatagctctgaatttactcgcgtttggagagcgtgtgagcacttgcgttcaagctaaaagaacaattttataatgagtagtatatggtaattttctttttgttgtgatttaattttataactgtatcagaaattaataatattaatcattaaaattcgtctgtaacaaagaattaggcatttattttaggcccattaataaaaaaagttattgattatatatatatatatattttgacggatatacattatgacttaaattcataagtcttaattaatcttgaattaaattatcataccacgattaataataataataattataattagacagcaactctcacatcctgtctcatataatttgcattgcttctgcattctaatatcaaatagttaacttaaaaatgaagtaatgtattttagttagatgtggaagaagaaattaattttcttatcattatttatttatatatgtctagatattttagtattaattgtttttgttaatgatattttagtggtagtttggcaaaatcctagataaaaatgctacaacaacattctaatacaaattcaataaataaaaaaataagaactttgatccgttgataacttttttttccccaaacgtaattttggtccagtagaacttttgcaaaccaaacatattcttaatatttggagtgtcgttttagttgggcattgaactcgaaatgaagtgtaatgcattgaactcgaaatgaaataggaaatcatattttaatgtattgccgtagtgaaagcacatgggtctagtatgaatggggcccacatgaaaatagtttaatatcctctttctgtggtgtaggaaaagcctttttcagaactgcgctttcaatcataatatatttaatgattgatgccaagttgcatgaggttgatgtttgtttggctgctcgttgcaattgtaactattttatttcttcattttttcttataaagaaagaagcccaaacacgtcacctccatggacaacagaggactttgacgtttcaaaaatagacaggtcattaaattattaaaaatacttaaataacaaaaaagatgttttatatattttattttattttagttatttcatttatattttttagttttagtactttgaaatttaaatatttaaaattattaacttcagatcctattgttaaacaataatattaattaataatgtaacaatgatattactttttattaacaatctattaatcttttatgctattaaaaggtctaacaaggtgattatataatatcttttataaattatatttcttttaatatctcatcaactcatccgatagtatcaactatttttaatatataagaattttgaaacataatttttttttaaaaataatacaattgattatcttgttagactcacaattatgtgataatcaattaattattattgtcattaatacaacaccaattaatattattatttaacaatacagattaaaattttaaaaaatatttaaaaagactaaaattatgataattttttttaaagattaaattcaagcccctttaatcggttatttgttaaggcatcatctaccccagtttgtaacatgactgattcactgatttttcaatcaaattctgcaaatagatctaagttcattaatcattgttgcttgcccaggaacaacattcttagaaaatatacttatattgatatccttgatatttaaattcaaaagaaataatatctgtgttaggaacaatgtacagaagcatcttgtagttcatattatcttacattaattttatacaagtgataacaatatattaaagacctcttaaaatagaataaaaataaatgaaaattacaataaattaataattgtaatataataaaatcatatgaagggtattattattattcaagttttagtgcagtacgtgcttttgaaagcatgttgcaaataatcatcgatccttgtcatccatggcggtgctctcgtgacggcaccactgtcttacaagatagaaaatggagaggaccacactccaacctcgtgctttctttatacgtttatttactcgtttttatttttattttttattttacagcaaaaacatttgttagatatgtaacaagggttgttttttatatatatacatattatatttgtagaaattaaaccctgattatatcaaagaatttagaatatttacatatttgattattcaatttgagttggagtcttttcataagaatacttttgtattaagtgtgagtattcatttttttaaaattatatttgtaaagttagtttttatgaaaagttatacatttgcagggtacacgaatataaaataagcatacgcggttaattaaaattttcggggaaaactattgggaaccccacgtattattcttattttttgattgagagcatctttaggttataattttttttttttcatatcacactatattttatgagaaacaatcttatttaagttaaataaaatatgattattatatacaaataaaatatttaatataattacatattataaaatatataatttcatatttaagatcacatatcaaacaaaataaatatcacactaatttattcagatggtcagtgataaaatcaatttcttttgatgcataaaaataattgaaatagactttatttaattttttattgagtgaaatttcgaaagtaagtaacatttaagaaaaaaaagtagtgtagaggaatgcggaaaaagtagtgtagaggaaagaaaaaaattgaaattgaaattgaaattagaagaaagtgaaagaaaaagtaattttgaatttttatttttagaaatcatttttttcttttttattttcttttaaaccaaacaaaagaaaatatatgattattcgtattttttattttcttttttccttgccaaatataccacaagagtttgaggaataaaaactttttaagcataaaataaataataatattttttgtttataattttagagtacattttttaaaaaataaataaataataaaatgtgatatattatattacatgtaaaattaattttccatattcaatgcggttaggttggtaagaaaataaatgataaacaggacatgacgcactagacatagttcatttgtcaaatccgtaggggttgccaagataaggctcgaagggtcaacgtctatatgataattaatagcctttctagttgactaaaattaggaagctaatgttaggacttagaggttatttggacacaaattatatatatttttgagaatttttttttattaaaaatatagaatttcaaaagtacttttgattttgtatccaaataatatcttagtatataattataactttggttcaatggttctaattaacacgacacatgttgagaataaatttatattttaaacttgacataaatccaaaataagagtgagaataaaaatgtaactgagaagtctatgagataattgaataatgaaattacaactaaatgataacacaaacctcttacccctccctcaagcaataggaacaatatgtttggaccaacttacgtatttttagaagaaaaaaaatattttttaacttaaaattaatttgtgtataaaataatttataaaagttctcttgtattaaaagatggttttaacttatgcgttaattaattttaatttctaaaaaagtccatatctttttttttttttccatatttccttagcctaaaagtacttatatgcataagcttactgagcaaacagttcataagatggtaatttctattgataattgttcgtattatttttgttgcatttttgttgtacccattttatttttcatattttctgtcattgatcacatagatatgtataattcatgtcctatttatcctataaaatgcttagtcaactatgtccacataatgttgctcactggtttacaagtattgtaagatactctcaaagaactgcatttgaagaagcaaggaatacggtttggaacaaatggaatttcaatctgctaatgtcattttcagttaagcaaagtgcttttcgtaaagaagtggagcttttgccccacacaaatttgaacccacacaacatgtgaaagatttaatttgccctgggtagctttaactgagcaaaaccttatggaccacggttcaaagtacgttatggtaacccattccaattactaaattaacaatggtattgattattttaatgcaacaatatgtggtggaaaaagaacaatgatattgatatatttacaatgtattttcttttttaccttttacacaacaaaataataagatttttttttttatctcttatcaaataacttaaaaaatcatctcattttttatttattcaatcttttcacttttccctctactttttcttccaaaaccaatgtaccctaatgggacctaggatgatcacgaatatcattttctaccaaattactaagccctaaggctgggtatggtagcgtggaagagaaaaaatggaagaaaattaaaaacaatatttgaattaaaatagaaaaaagaggtgcaaaacccacactattttttaaaaatagtctcatgaatgataaattcattaacacaaccaaatcaaggttaaaccaatacaggttgagtctagtgtaaagaattaatctcttcttataacatggtgaaccaatgttagaatccctattataggaggtattcacatttaatttaatgttggaccaaatttcaaaaagtattaagcagattacatgtgggaaaaaaaaccatggccaagtacgggggatacatgcatgatgcaaggtgagtaagattggtaaatggcctggccaaagtgaaaatgttattattatctcctaaatacaaaatgtggccttttgggtatacctttggccacattaggagaaagaaagggaaagaacataaacaaatgaaagcaaaagaggtcatcatctattattttcacataaccaaactcaatggcctcatgctaataccgtcctgccattcatgcctttagtcacctcattcattgaaagcagattctcacaaaggaaagtgagaaccgtccaaggcatcttctagatatatggaaggccacataaacgtaagtgtcattgttttatttatttattttgcaacttctgcaaaatttccctccctttgaaaagtagtataatgataaacacctttccattaaggaattctagtaagcaccttttgtctggaagaagccacctcctaggagtgtgggattcagttgttattaagaacaaagatatgtataaagctttatacatttggcagctttttattgtctcaaagttatagatttttgtcccaaaaaaaaatacaatttttaatttaaaataaagtggagttggcacaaaataaagcttcgttagaaaattatcttcaaaattaattgtcacaatcacattataacttaaatgcatacttcaagaattttgatgatccttgatatatatgaccttttcgaccgagttattataggttaaattgctttcgagttttgtaaaagtcttcttcctttgatatattaagaattaattactaccactatattaaacgataatcgatatttagctctcaactagctttatgaaaatccttcatgacttcattgttcaagaattttaatgaaccttttaccaacatatgaaattagagggaaataacgtattttttctcctttaattaaataatattagaagcatcgatcccttgatttatgaatctactaaggatgatctaccatgataatgaaaccaaacttagagtctaattccataagcttaagggaatatgtgtcatgttgagaaggatatgcacaggggtggagggaggggggacctgtacggcccatggcccccaaaaaatttcaaatgtatttgattaccatgaattttttttatgatcctcctaaaatttataataaaattatagaaaatatataagtatgaagttaatgtgatctaatgtcttcaagagagataaaaaaattatgtattaatgaaatgttgataatgttgagatacttacgtataattatctaaaattaatgattttatctatctagtttttttctcatatagtattacctttgtacttaatgtagtcatatatttttttttttatttataaaaaatattcggcatatatagatataatattaatttctttaaaatttttgcatgcaaaaatttgatatttttataaaaatataattttttccttggtccccggaatcaaatttctggctccacccctggatatatgtatatgcctttgattagttataccaagaaaaattataaacatttacacacttggtcttctatttcattccacttctacttcatttctttcatatcttttcttttccatcatgtcacttaaatatcacattcattattttgtttctataccttttttctttctatatctcttcaatgagatagaaattgatcactactcttaaaatttataataaaattatagaaaatatataagtatgatagttaatgtgatctaaagttttcaagagagataaaaaaaattataagtattaatgaaatgttgataatgttaagatacttacatataattatataaaattaattattttatctatctatttttttctcatttagtattacctttgtcatatatattttttatttataaattttttcgatatatatataatattaatttatttaatattttttgcatgcaaaaatttgatatttttataaaaatataatttttttcttggtccccggaatcaaatttctggctccacccctggatatatgtatatgcctttgattagttataccaagaaaaattataaacatttactcacttggtcttctatttcattccacttctacttcatttctttcatatcttttcttttccatcatgttacttaaatatcacattcattattttgtttctataccttttttcttcctatctctcttcaatgagatagaaattgatcactactctaatacaaatgcgtgtctatatattgaaaagtattttttaaaactatatattgacatgttaaatatgagagtcaacaaggcaacacgacaatttaaacgttaatggatgctagtaaattaacaagtaaaataaggaacaagaaaatataattgcaattatatttccattctctttttacatcttagaaagatatttctctgaagtgattagaacttttgaatattaaacccatatggcccaaagactatgcaaacaaaactcaagctaaattaaatcccccaaaacgccaagtgagcatccaaggcatatagcattgaaaagtaaggaaaagaaagccaaaaagtttgtgaggttgaaaatggtgggggtgaagagatgggatacatgggtgtgcgtgtgtttaaaaagttgcgttttttgtcaccaaaccatctttttacccctccatctctttttcccaccttttgtagatgcttgccaaccatatctcctcaaatttatttatttttaaaaattgtgtcaattaatatttatttctcaatatataaaattgatgtagtgattaaagaagaatacaaagagaagagaggagaaaaaaattgtgaattcgaattctcttaaggaatatttttaacaaaactaacaaattaatatttagttataaaaaaatttaatatttgttcgttcttagtctttctcttatctttttcttcttttttctttttttcttagtcagcttagaaacaacgcattcttcgcaacccacacattttgttttatcctataacacacacaaaaagcaagcactgatattaaaatcaaacgtcacataagggtaggtcctccaataacaaaaatgatgtgtaattggtctctccctctcgttatgcacaagtctctttctaagatacatacacatattgagtggagctttggctccacatagctaccctccaatttaggaatttgcttctttttatccaatcttcttctcatatatatgatttcatccttttattattatttatttaattgtttcctttttgtaatgtggaagatcaatctagctatataggtcaacccaccatccaattctattgtctctttcattctattcatttttttcttctcctaatttctcaagggtggatttcttgttatgattcgaaacaagtttccattgttggtcatcaattaacgaaatattgtcctagctacactctagttttgtagatgcatgtaaatttttttcttaaaaaataatgcatgtcatgacaaaatgcatttctataaagttggtttcgaaagaaaccaataaaagacgcgaggatataacagtagttataatgaatttagagaatctgatttttcatgacatgtcatattttccgcatttcttttggggtattacattttatattaataggtcacagtttttaatgttgtaagtttcagtttttttttttttttttataaaactgtttaccaactgttttcaattaaaaaaactacaaatttacatattataaattttaatctcaaataacatgcaaatcgacatctttaaatttctattgaaatattttgaggttttaattataacaatattttcttttgaaaaataacatatataattaataatctattgatgcgcattaataagaaaaacactgtaattttttctcaataaaaattatcatctagcaactgaatttaattagattagatgttcaattgccccataaaaaaaattagatgttcaattgcctggctagttaattgcatgacattttttagtttcctttatcgatagaaatttaaacagtgcacaggcacttctagatatagcaagagaacaaattgcattatacattgatacttatagaattttttatgtttttttttaaagtattttaacaaagaaaagataccaatacttccaaagaaaaaactacattccaagaaactatgtatccaatcccactttcagccaaagttggtgtgttttgaggcaattattgatcataaattatgtgcactggtttcggctgttctttcagtttatatgatacaagatgaatttgttgtatatatataatccaaacaaagcaaattgacaactcccatatgagggtgacccatatgtaacgtcttttggggtgacattttaaggcccttgtccaattggatctttcagtgtatctcagaagtaaggttgacaagtttcaatatcaatatcattgttagggcatgacgtcgtgattatataactaagttttaggtcaaatacggccaagaggtttgacataaataaacatctattacatttcaatgagtttaggttaggacgcggaaaaataaattatgatttaaactttttttttgggtgatcaattatgattttaactttatggaaagttctaattattagttgatttttgtgtgtaatgatggacctaattaagtgtcgtgcaaattggagatttactatcataaccaccaaattatgaatgaaggtggggtcaattttaacaattgggaagcaatcaaagtttaaaaacacatgcataattttttttaacgctatccataagttagaatagtttttaactcattaggtgattattgaatattatgtgtcttatgaagataaatgcaacactgaaggttttttttggtttataaccccacaacccccctgcccccacacatatacatatatgtgtttaaaatagttgcatatttaaaatagttgtatttcatcagagtatttaaaatagttgtatattcaaaacttaaactctagatcattaattaaagaacaatccctcactaattgatcacaagtttaggtaccataaaatttgcctcatgaaaagttttgtaaaagactatgtacacttaaaacattaagcataacttatctttagctaaattgcaattctaaccctcctttaatttctaatatgattttttgtggtataatctccacaatttagaaaattcataattttgattttcctttcaattttacatatgtttatttttattttattttattttatacattttaattgattaaattattttcagatgatacttcaaatgaattcattagatctagagttcaattagaccaagataaaaaaagttatacaaaatttataattaaactaaaattatagattttctaaaatgtaaaaaataaaattacagaaaaatagaatgactgaaatagtagagcataaattataaagtcaaaattacaatttagcctttattaacctagaaagtggtaacattttcccaatattttaatggaatgactgaaatacggttttgtttatttttttagtccaatttgttttgattgttaagattaggaggaaaagtagttttcatcgttatgggaccaccaacctttgcactaaagggccacagttttacaatggatcaaaggttgtttagtctttacgatgttttaaacttgggccatgagtcagttttcgttttaaatgaaaaattagttttataaggaacatgctatatccactccccttctttgctaattcaccccctttttcaatttgttttctaaaaatgtcatctttaaaaaaagcaccccccttctggaaaaatcactcacccccaactaaaggaagggggcatgcatctttattctatcgaaaacatgtaggtttgttgtgtccagattgcctaacaaagccactcaaattacaatattttgctaaatcgtagataatccaataataagaaagtaaaccaaaaaccatgaggatggggtgaatagaaaggatagcaagtgcagcaaaatggcttatgcaatgctacttctcacccacagaaccttcccccatcaagcaataaggttccacatccactacatacataacatgttcaactctctagttagctacttccaaaatgtttacttcattgtgcctttcttgttaggcaatctgtagacaacaaacctacatgctttcgatagaataaagaagaacaccccctttctttaatttacactacactgtttgcatcaattaaagtggatacgaatctgagtacaaaagaaagaggtgggtgattttctggaaactgtcaataggggtgtgtattttttaaaacaaattaaaaagagaagtggataagtaaataagacaagtgtatatagcaactgccttttataataggcctagcattcttttccacatgatcataattgtttatctacaaacaaacgatttgcttgttaagtttagcaataaaaaaaactaaaaaaactacatacctcattgttcagaggctccacattatgcgtaggtaagagagagggatattatacgcagtcttatccttacatatacaaagaggctgtttccgacttcgaacgcataaccaacaagttaccaagatacaactattgtggcagggctcaccctccttattaagtttagcaatacttcttaaaattgagaaatcccttttccttttgataggaaaagctttgcaataatccaacaatccattagggtcggcatagtattggaggatttagacagtatgcatgagaatgcaagtttgatcgacgttgtattgaaaataaaataaaatagagacaagctttgcattaaagggcctctgctttataatgggccaaagttctcttcctgtcttccacattattagtttggtccattttttaagtttttattttaaaacccaattgattcatttagaagtccttaaactttgatcctttaagaaagtgttaacactgaacacaaactaagaaatcgtcttaactgtttttatcttattttattaattgttaattattagtatttgttagtaaggagaatgaaattcatgagattgttctcttttcattctttttctataataaaaaaaattgtctcatctggtatttaaaaattacaacaattgatcattttcatccaatgatcatcaagttattaacaggtgagcaacgaagacaaaatattaataacttaaatataaaaattacaaatcgaattgtaaataattaaataaaaccaataagtaatagcttataacatcgtggcagagatcttgttgtgcggggctgtgcgtttttttggttaggatcaaatcgtgtattggattgtgtttaggctgtgagcaaccaccatgcatctgcgtggagagtaataatagcttataatatcaatgtatttacccttatttgtcaatttgtcaacaacttgttatagattacaaacattcttaatatatgatatcttttttgctatcaaaaataaattctcagcatggtattgatataaaattgatcaaatgaaagtaacgataaatcttcattaaggaactgtgaacatatataagataagtattttttcctaacacaatttattttatatcaaagatttaattattcaaattttgaaccacttaattagaaaacataaattgttatcacttgtgttaatcgttattggttgcagaatttaaatgttagtaaaagttttgaaattaacctacttagttaacttaaactatgatttgatgtcatggttttgtttacgcgaatgaacaaggtgaggaacttgcggttagggcgttacacagttttcatctttttaaagggcatgattaaagtagtagtttttggtaatgattaaaattggttaacattcttcttcttattaaaaaataaaattggttaacattcattgtgagtttttttctctcttttatatgaaaaatgttagttaattttatattgtattcttaaccaatttgatttatctacaactaggtttatcctttttttttaggcagcaactaagttaatcctaagcacatgaggtctgtagtgtatataatggttaaagatggaccaaatcacattcaatggcattaaactccattcataactaataatgacaaaggcttgataggacagtgattctgtgatttagtatttcttccgtcttaactataattatcatgtcaaaaatagttctaaaataattattattttaattttttatgtaacattaatttttttatttatatttcttatatattaatgataaattataaaatctaaaaataaattaataataatataaggttaattttataaaattataattctttttcatctatttattattatgtttatctgtataaaatatcccttatatatagcagtgcatttttgtccatatattgagagaagcaaataatctggcagatgtgtttgctaaggagggtttacatttaagcaatgatgtttgttattgcaatagtattcattcttttgctgtaaattcccaatatgggaatgctgttcctatctcaaacttgagtaaataaaatgtctaacgactcctttttagcacagacaatgcagaaaaaaaaacaaactaacaacaatagttattttgggacagaggaagtacagtttttgttaggaaatccatttccaggctttgtatgtgaccctgtctttatcatggagaaattgaaaacaatagtaggtattcactactctctagtctttaataaaagacaatttgaacattaatcacacgtaccaataaaaataattaatttagttaattttattattttcttaaaatattattaatgtattaattatatctttattaattattaagttattatgagtaattcaataatgtaaaaatattaaaatctaaaagtattatacaccactttttataaagaaataaaaatatttagaatatttaattagagcaactaacgaaaaaaagattaaatgcttcacaaaaattctaaaatgcgttagaaaaatgatcatcaatttctttaaaactataccttataataaaaacaagagaaaatattaaatttattgtgaatgttaaaataaaaatttaacgacaatgcatatagtgatacagtgtgaacaagttttatattattattcaattaaaaatcattaatatattatttaagataattaatataagagtttaatagtgatgataataaatataattttatatttttgtttaattatatataatgattaatataattttaaaataattttattaaagtcattaaatttataataaataataataattttaattgaatgataatgaatgtataattttttcttcttattggaattgtaaaaatcaatcaacttttctttttcatacatactttatgattggtatttggatgagagttcgacagagttacactatcacgagagttacactgttagtgaatatatataattgagttttttgagtttcagaaatgtttcctaccttacctaccatagtaccatctctaaagtccaacattttgatatgtcacaacatttttatccatacccaaattacctatgcccccgattttgcttccgtgccaaattcgccaaattctgaataaccaaggttgccaaattctaccatttcttcccaaacttctcatcatcaccaaagtggtggagcaaggaagaagcaagtgctcatggctactacagtggcatcatcaatggtagtagcatccttttgttccttttcaaaccccgccaccccatcctcatcatcatcactctctttcaaaaccaaaaccatcaccagaacaagaccaagaacaaaaaccagaactagaataacgaggttaacatggctgaatcctcaccctcgtggtgctttggttgaggcaacaccacaaccaacaagttcacctccttcaccgagagatggatccatcaaggtgcttgcgcttcctgagaaccgtgctgatgacattcaagctgaggccagagccctggctcgtgctgccaatgcaacttcgtacacccctcagcttgtggcctccaaatatggctcccaacccatcaaggtttttcacctctttctacttctgttcctcccaaagattgagtctttttcgtgatattttttgtgggtgtgatttttttggtcttgggtcagaaaccacgggtgtcctccaactcagttactgtgttagagattaatctcgcttgcggtgcgtgactgatgctggcactgaggaattttgcacatggtgggggaatcaaacacaggttctcccccgaaatagatcctccccacgtgtgggaaagcaccggggccttacaccagtgcgccaaccctttgggtttttgtgaattgatttgacctttttttttgtaggtggtggggagggcccttcaggttctgggtgcggtgggtttgtttgggttgaagctgttgttggaccagaaaagtggagtgcttgatcagaataaaaggattcgtgctcttgagcttagggacacattcactcggctgggaccaacttttgtcaaattgggtcagggattgtctactaggcctgatatatgcccagctgagtatctggaggagctctctgaacttcaggtattgaatttttgtacccttttagctcttaatttgattggtgtagtgtagcttgttagatttttctagtgaagcatgttctaggggttaaataacttggcattgtgtgggaattttgattggttcagtgattatgtacatatgcagcacaagaagctattgactatttcatttgactatattggtctttgaagatttggtcttaaattgaattgactgatatcgtgtgatccatgtagctgatctcacctagacctagttggataaggcttttgttgtatatgctcttgtattgtcaatggacaatgttgatgatatccaatgaaaatttattcgcttatatagttttttttattgacaaatgttagttgttagaatgtagttttgttaacagagaggatcaaactcgcgacctttccctccttcccttctcccttaaccatccaacccaccttatatcttctattcagttatatagtggagtcattagtagcagtgagttgtgtggattttatatatttgtttgtactgtgaagatgtttatgaatgaactggttacttaggtttccttgattatttctgtgctttaccaggatgggttgccaacatttcctgatgaggaggcctttgcatgcattgagagggaactaggactatctattgactctattttctctactatatctccaacggctgtagcagcagccagtttgggtcaagtttataaaggccggttgaagtactctgggaaacttgttgctgttaaggttcaacgccctgatattgaagaagctataggaatggacttctacctaattagaggtttagggtctctcataaataaatatgtggactttatcaccagtgatgttgttgctcttattgatgaatttgcacgtagagtctttcaagagctcaactatgtgaaggttagttcttctgccaatatgaaaatttgtattttaattgaagccaggcatgcatcatgattcatctattagcaattttctgcatttgttgcaatccttgatgatgctatagttgtggtcatggttactccgaaaacctcaacactgaagccaaatccgctgtcatggactgttttttaaaaccttgtttatgaaaataaaaaaaacaaaaataaacattgaaccctttgtagttttgccaaattttaggcaaaaggaaagcatataaccatgttatccttttcatttgtaattcaaatcttccctagggtggtatatgtgtcatatggatatagatacatgtttgtaaattatgcaagatatttgttggaattgaatgttaattttgacaggttcctgcaggagggacaaaatgcaaggaggttcagaaaattgtatgctgacaaggaagatatctttgttcctgatgttttctgggactatacaagtgctaaagtactaacaatggagtgggttgatggagtcaaactaaatgagcaacaagcaattgagagacaaggattaaaagtcttggatctggtaaacgcaggcatacagtgcagtctcagacagttactcgagtatggatattttcatgcagaccctcatcctgggaatcttttggcaacatctgaaggaaagcttgcttttcttgattttggcatgatgagtgagactccagaagaagcaagatatgccataattggtcatgttgttcacttggttaaccgagactatgaggccatggcttgtgactactatgatcttaattttttatcaagggatgttgatgtatctccaattgtgccagcacttcgaaacttttttgatgatgcacttaattatactgtgagtgagctcaacttcaagacactagtggatggtctgggaaatgttttgtatcagtatccatttaatggtgagataaactatgcttttcagtgacttatcatttcctatcatttcttttcctatattagactgatttataaatatttactgcttatgcccaaatcctaactttcatgcagactctgataggttgacttttgtttttctgttcttttccccttctgttgacagttccagcatactatgcattaatatttaggtctctcactgttttagaaggtttagcattgtatgctgatccaattttaaggtacttgctgcatcatacccatattttgctaaaaggctcctaacagatccaaatccatatctaagagatgctcttatcgagttgcttttcaaggatgggaagttcaggtttgaaatcggctactatcttaaatctattgttgtttgaacttgatgctgtagaataatttatatgaagtgcagttgaatattcattaatctggtccagtgcagatggaatagacttgaaaacctgctggaccaggggaaaaaggatagagatttctctactaaagaggctttacaacctgtcctaaaggtattattgagtccagatggtgaagagctcaggaatctagttataaaagaggctgctcgcgtatctgaagcttttacccttggcacaatgtctgaaacataccggtatattcctgacttcgttaggacccttgtcttcaatggcaatgcaaatggaccctttatgatgtcagaaactgaaatgcaaagcatgatagagcttagagatcaagtgattagaatatggggacttcttcgatcctccaacgattttgatccagctattttgctaccaatactacaggtgtttaaattattttaatagagcattttgtaaatatcattgcatactaaattgaaagttaatttgtggaacatttcaatcttggagcatctaaaacatgttgtatgatggagtaatggatcaaggaatttgatagttgaaaaggtgtgtccatgcaaccaaaatatagcaaactattactatagccctcaatcaacattaaaaaaaagatgatcttgaaaagtgaattgtatattagtttagatatgggacaaggttaactgttgaaatttgcttatttacattaataaatttctcttaaaagtatttagtggaattgaattgaaactttttcagctttttttttttttttttgcaattgtaattttacaaaaagcaatatttaatatgaacaggtccttgagaaacctgaggcacgccaacttggggggcgtgttgtgggtgggatcactcaacgacttgcagcacgctttcttcagcaagtactccgagttccaacaacagcttcagaataattttgtggcactgtaaatgctagaaaaggcatgcatcttatatattttccctatgaagtttgaattacttttgtggtgctcaaggtttattaagttctaattactggtgtcatccatagtgtgctgtggcattatagtccattcttattgattgaccagatgggccagtttgtttaaactttaaataagcatttttttttaaaagttcttatttaataagcatataggatttgcttatcaaaataagcagatttttttttttttttaagtaaaaacagtttagaaaaacagactaaaaaaaatataaagctgtttattttgtacttttttttcaacaaataagtttaaacaaactagctctatgtattaacgacgatattctgtttttgctaaagctaatgtttttggtttctttctttatttctgtcaggctattgtggacagggaagataggagtcacatagaagtgagatattgattcttgcgaaaattatttgattttcttttgtgtttcttattctccaattttgtcaaaaatttgtatatatgatgtgctcatcattattgatgctggatatgaagatcagcatcaacattcaagagatcacaatattataaaaaacaattggtatatcattgctcttacaataacatgttgctgtttatcttttgatatggcacactcatttctcttacatgtattgtacctggaatcgttttagtaacttgcttttaagtgttttggaggggttatacagctgaatatgaattttaatattgtgatcattgctaaaacgaagggagtgtgccatacatgagagtgaaaggaagataaatgaaaggagaggttatttatgtgtttcgggctcctattggatgtggtgggtatttgttttgtagttgacacaattttcaaggcacatctacataaaaacatgtgttttgttggattggatcaaacttcagtttaagcatctcaaacataaaatcaaacacaccggtagattgatttgtcttagtcatggtagagatactcatttaatgtctatagcaatatacatgtcgacataatacatctcatcaatgtcgatcgattggtcaccatatcaggttgtagttttggagagttgagtctttctcataacccacccgttcaggaagaactatatatgtgtatacacgttcaataagtggatatggtataaactgattaataaaaatagatttagttgggggacaaaatgagaaagcatcatgtgttagtcttaactatgaactagttattcatgagacaaaattgggcatttttgctaatttcattcctcgtgtctcaacaactctaattaatataggaaaatgatagtgtactctccaaattttgaccagcaaaagtgagaaaagaccacataagcgtgtttatggatgattagtgttgactaaattaatttttaataaaatttattttataaatttttattttagttaaaactaattttatagtgatattatttatgttttgaatgtttttattttaaaaacaagttcatggaaaaatttaatataaaattttgttgaacataacaattatctaaaattattcaacatcaacatctttcatccaagttaattggggtcgatggtaaatgaacctattgataaatagaaaatgagacaaaaagagaaagggagagggaaagataaaagtgaaaataagacaaaaaagagaaaaaggggtgaaaggaagaagggataaaagtagaggaaaaaaaactaaaacaagggaatgactgagacatagaactactaatgggtttaaccctccaccaagtttatagcttttctccactccgtcctaagacataccatccaccaatctatattccactttatggaaacctaagactctatcttcctggcataaaccaaattgatttatggaaaccttggtctccctccttaggcgatgttcgataactctctcccacaacttcatagaatgactcatgagcttgatacctctatagtttgaacaatttgggaaatcaaggaggataaatattagggagatttacacttgagtaaccatataagtgaactaaacaccacactttaacccaaaaccttaaggctcatgtttatgagtgtaacaccccgtatgcatccgatgtattaacatattacttaatcagataagcgcataattactttaattaaaaagctgcggaagctatttcaaaaccgtatttcttgattcattatgtatggttcgcgttgagtacacatcataactatatttagcctcattgatccacaacaacaaaataaaaccatggcagatgcataaacaatatctctacagatatattaggaggtaacaaaggtgtatataaacatcagctgacactcacagtgtctatacaaaagaataggcatctcggtgctctgatctcaaagatcacttcctcacacgagagcatacaatcatatacagtccatgtccaaaacataaacataaacacaatatgtgcacacacacatatcttccctctacaggggtacaaggtataacaacatatacaaaacgagcctcccagctcacaagtagctgcacagctgtccctactggggtcttctgtcctgggaaccatcacctctggtatcagagtcacctgcaaaacataatccccacacggcgtgagatacacatctcagtaagctcagggtccttggaggcatctcctccaccttggctcactttccatgacacacgtcatcaaggcatcacaatcactaggcctctcggccctcataacaatatacagccaatcatctaactctaatgtatatctgcggaactacgccgccacgatgcatcatcatcagcatcaggcatctcagtcctcagtgtgagaccgaaactcacattcgtgccatcccatcgggagctatcccttacgcatggacgcacgtatatggcacatccgagaataggcttcaactgcaacgggaccacctatctcttggtcttaagggatcatcatcacccatgacgtgagcaaaccaaactaggaggtgcgctcttctcctagggaggtccatatctatctaactggccagaagatctaatcacaggtatccatacacacaaagcatagaatcatgcatacatatcattatgagcaagtaacaaccatttcaatgcatgcatcatgaatgcaaccatcactccctcgaagtatggtggaacacatcagtgggaaacatccccaaggaaccaagaacttacctggcaaagtcgtgctctgcggttcagtccctgaacgatagtctacgccactgacaccctcgatgtcacgccctatacaaggcatataagctcaaatcaaaatccaaatcaaccatacaaggcacacaacaacggtcctcaatcgttacagatgaaagaaacatccttcctttccaaataaacccttaagtcctctatcttaaggttattaaagctaaaacaattcactagacaacttatagaccctctgcggtctatctcggcctaaccaaggcactagagtctccacaagactcggtacaagccaaaataaagaactcaaagctctatatataggccaaatactcaagaattcacaatgtggtttgaacggtttctttcacgcaatgtagccattcatatagcctctcaggcacatctagagcaaatatcaaggctcatgcatggtctataatcattaattaaccaacaaaataccaacacatgcatctctcagagccaataatcaaagttcatgaaactaacatttgaaagctaatccttcatcacaacaactccctaaacatacatttctaaaggatccaaggctaatttcaactctagctcaaaaaggtcactatttatcccaaaatcaatctcacaaattaaacggtaaaactcgagtttcttacctctaagatgacaaggaaggccaaagaactactcccccaagcttgggtgtctgtgaatcgcctcatttcctcgccgaactcgagtttttcgaagttccttagagaaagggatttctccgtttgaagcattttaggaggaaagtgatgaaggattctagctcacaagagggttccctacaagtttcatatttgtaggaaggtgttttgatgaataaacgaaggtttaagaagcttgggttctcagcaatggaggtgcacggccagaggaagaagaagcaaaggactttgggccaaaactcataaaatgacccttttatagtgggtctgcccgtgctcccgcgctggtggcgccacaatggcgctaccggcgccagttcccagagcatatggcgctaccggcgccacattccagagaaaaatggcttcttgaagcaattctgatgctaccagcttcagttcccagtgcatatggcgctggtggcgccactctggcgccagattctagtgaaaaatggcctgcagctacagtgccacgccatcagcgccatataaatctacagtgccacgccatcagtgccactcccacgctactagcttgagattttttttaggaccaagggttattataatgagtcttctcctcacttatatggtgttcaacttgtctatttctatccgatatgagactttaaatcacacttgtactccaacctaatcctattaaaaagattggtcaactattttattgttagatctattaattaatttagaattggaatatatcgaattgcacaagggtcaaaatctgagtagtcaagatgaacaatataatctactacaaatgcacgaaaaatcaatttaaatagaacctgtatgataagtatgaatcagaaacagatgcaaagagatgaaaggatccgaccctaacaatgttgtctccttaagacaatttgttccctccaattgatgccaaaggttgatgaacaattgtctcccaggatagaacggatcaacgtctgaagattgatagcacttcaaatcaacagcccaaacgaacaaagctaatgcttgaggaaccactcagaaagagtgaagagttatgtgatatgaaaatgcaccggtatctaagcgaaaatatcagaaaagattaactatcaaaactctatcaatttttctacttcctattttttgattgtctctgtgtctatttatagacaacaaacaaccatgttgaagagttgtcggtaaaccgtcatgacttttggcgatgaaccatcgtaaccgttggttattggagcggttaggagtatttattatttttctaacctttaccaggagcggttgagagtagttattatttttctaacctttttccaactgcctcttattcataacccatggagtttaaacaaaaaactccaacatttattgctacatctcctaagtctctccacactttctgaaactttattatttttcatcctctttaaaacctcattaacttcatacgtattaattctgcgtacaaatcttctattcagatcataaaaatgtcctccaaatattattaaatattaaaccaaacatgcaaatatgcatcttaaatcactttagctaatatcttaacataattttagtgaatttaacatgaaatcaaacaagttataatatgtttggattagatttatactatgaaataattaattaaattttcatgataaaagaaaaaataaatttttttatggcatcattttgtgttattcaagcactattaagcatcactcccaccttttttccatcagttgagatttggcggttacacatgtgtccatgagattgtgccacgtgtactaactggtcggtactggcggttggaacactcaactgtgcccgttgattgaggaacactgaggccaagttaccatgtatctttgtctgctgcccttaccttacaccttagttcttgtaggtcccactgtttctttcaatacatgtggcttctggctcctatttaattgctaaacagtttttactgtcagtgagagatcacttcgtggcatttgattcattcaaattcttatttgaagctttgtaataaaaacacaattttttttttgtttaaatacggtaatacactttcactaatttgatagagttattgttatgtgatgtgaaagggttaatctaggaatagaaggatttaatttaattaattgaataagatacatgaatttttataaatctttgatacttgataaaaaatgaattaatctaattatagacggtttcttttatcaaagaaacaaaaaagaaaaagaaataaaagggatcaatttttcacatcatatcaaagtgagaatttcatttctaaggaaatataattcaaagtaaaaaatttcatatgaaaattggcagggaaattgatatgtaatactaaaatttctaacagtgaaaagttaaaaaaccgtagctgttcatataagaattatcaaatgaatttaaataatttcacatatattttattatatatgtgtaattttttatttgataattataatttttttgtttcttaagtatttttttttttacattacgtgagttttattttttgcatatgtcatgaatttagttatttattcccacttcttgtaatggcatatattatggctatgattttgacagattgactcgtgtaaccccatactttttaatgtgtttggccggatattataacctgttgaccatttcaatttgtcttatttatttacccatcatcataaatatggtcaagatgagttgatatgttagaagattactatttttttttaaactgagacattaacaatataaaatataggaaattatagagttcatgtttagatttagcactcttcttgatttctactcctttggacctaccctatgacacgtgttgctgcattaggttatgattgcagaaaaaggtatccaatgttttaactctggcaagatactagtcaataagtaataaattacaagattaatctgtgacattagtcaagtgatcataggttaaattcgcacggttaatttgttaaaattaaatttatctatattagatttcggacctcacaaaatctaacacacaagactttaaaaacaataataaactcaaaataactcttgattctccactcttagctcctaggcttgttcttttgaatctcaactatatacaccttagctcgatgctcaaattcactaaattagcaatgtgtcctagttggcaaagcaaagaaccctaatttcttaggcgcactcattaattaagcactcgtgcattacacttggattctcaaagtgcacataacctacacattttcattcctactgcttatgcaaattatgtgttccaaatctcagttcaactcaaaatctctttttcgagttaaccctaagctagattcaattgtctgatttccacctcacccatataacattaaacacagagaaatgaaattgaaacataaagcacgcgtttaaaacgcaattaaatagtctaaattagaagttcataacattgtatttaatcattacaaaacaaacgaacaaaaataacaaaataacataaggagatcaaagaagaagccaaggaagctctccattaaagttccatatccattcctaaaatgaatctgtactgatcaaaatctccaaaatatcactaccctaactctcttacacactaagattacacatgatttggtgaaagctatatatgcaataaattgcaaagaagagggttcagcttagtagcattctgatttcagttgcttaattatattcatgtattgtattacacaagggttgatcttctgcatatctacttttgtctgccgtagtagttcataaaacagatttgctgtatagctgaatatattttgtcgctaagtcgtattgtttttatgatttatggataaacctatacttttatatatgttgcaattactttgttgccatcctgtccgttttatgctcagaaatacatgctcagggttgcactgagggatctagaaattttttttagtaaaataagaaataatttataatatcattataaaaaatatcactagttattacaaaatagtaatattattgttatggaataatagttgggcctaatatcgaagcccaatttcctttaataccacgtgtgttaacagattcaatgaatgtggactatgacttg
